United States Patent 11,602,557 (BUNYAVIRALES VACCINE) - sequence listing, part 8

SEQ ID NO: 10187 - RNA, 3402 nt, Artificial Sequence
  derived and/or modified CDS sequence (opt3) from SEOV(11CSG)__AB618131.1__GP
auguggagccugcuccuucuggccgcuuuggcaggccagggguucgccuuaaagaacguguuugacaugagaauccaaugcccccacuccgucaauuucggagagaccucuguuucagguuacacagaacugccuccacuaagucuccaggaggcggaacagcuggugccggagagcuccuguaacauggauaaucaucagucucuuucgacuauuaacaaacugacgaagguaauauggaggaaaaaggcuaaucaagaaucagccagccagaacaguuuugagguggucgaguccgaagugucuuucaaaggcuugugcaugcucaagcaccggaugguugaggaaagcuaucgcaaucgacguuccgugaucuguuacgaccuggcaugcaacucaaccuuuuguaagcccacagucuauaugauugugccuauccaugccugcaauaugaugaaaaguugucugauugggcucggaccauacagaauccagguaguuuaugagaggacuuacugcaccacaggcauauuaaccgaggguaaguguuucgugcccgauaaagcugucgugagcgcacugaagcgggggauguaugccaucgcuucuauugaaacuaucugcuuuuucgugcaccagaaaggaaacacauacaagauugucaccgccaucacguccgcgaugggcucaaaguguaauaacacugacaccaaaguucaaggcuacuauauaugcauuaucgggggaaauagcgcaccuguguacgccccagcuggugaggauuuucgcgccauggaaguauucaguggcauuaucacaucuccccauggggaggaccacgaucuuccuggagaagagaucgcaacuuaucagauuuccggccagauagaggcuaaguuuccacacaccgugagcucgaaaaacuugaagcugacagccuucgcggguaucccgucuuacuccucaaccaguauucuagccgcaagcgaagacgggagauuuaucuucucccccggacucuucccuaaucugaaccagucugucugcgauaacaaugcccuuccacugauauggaggggcuugauugaccucacgggcuauuacgaggcugugcaucccuguaacguguuuugcguucugagcgggccuggagcuucaugugaagccuucagugaggguggcaucuuuaauaucacuuccccaaugugcuuagucagcaaacaaaaccgguuccgcgcagccgaacagcagauuucuuuugugugucaacgaguagauauggacaucauuguuuauugcaaugggcagaagaaaacaauacugaccaagacucucgugaucggacaguguauuuacacaaucaccucacuuuucagucuguugcccggcgucgcucacagcaucgcgauugagcuaugcgugccggguuuucaugggugggcaacggccgcucugcucauaaccuucuguuuuggcuggguccugaucccugccugcacacuugcaauucuguuggugcucaaguucuuugccaacauccugcacacuuccaaucaggagaacagauucaaagcuauuuuaaggaagaucaaagaagaguuugaaaagaccaaaggaucuaugguuugugagauaugcaaguacgaaugcgagacacugaaggagcuaaaagcccacaaucucucgugugugcaaggcgaaugccccuauuguuucacucauugcgagccaaccgaaacagcaauccaggcgcacuacaagguaugucaggcuacccaucgguuccgugaggaucugaaaaagacugucacgccucagaacauugggcccggaugcuaucgcacacuuaauuuguuuagauacaaauccagguguuauauccugaccauguggacucuccugcuuauuaucgagagcauacugugggccgcaucagccgcugaaauuccauuggugccccucuggaccgacaacgcccacgguguuggcagugugccuaugcauacagaccuggaguuagauuucucucugccaagcuccucaaaguacaccuauaagcggcaccuaacuaauccggucaacgaccaacagagcgugucucuccacaucgaaauugagucccaggggaucggagcagauguacaucaccugggccauugguacgacgcucgacuuaauuugaaaacaaguuuucacugcuacggugccuguacgaaguaucaguaccccuggcacaccgcgaaaugccauuucgaaaaggauuaugaguacgagaacagcugggccuguaacccuccagacugccccggggugggcacuggaugcacagcuuguggccuguaucucgaucaacugaaaccuguugggaccgcauuuaagauaaucucuguccgcuacuccagaaaggugugcgugcaguucggagaagaguauuuauguaaaacaauugacaugaaugauugcuuugucacuaggcacgccaagaucuguauuaucgguaccguuucaaaauucagucagggcgacacgcugcucuuuuuggggccaauggaaggaggcgguauaauuuucaagcauuggugcaccagcacaugucacuuuggggaucccggcgacgugaugggaccgaaagacaagccuuucaucugcccagaguuucccggccaguuccggaaaaaguguaacuucgcuacuaccccugugugcgaauacgaugggaauacaaucucgggauacaagaaaguacucgccacuauugacuccuuucaaucuuucaacaccagcaauauccauuuuacggaugagcgcauugaguggagagaccccgauggcaugcugagggaccacauaaacaucgucauuucaaaggauaucgacuucgaaaaucuagcagagaacccauguaaagugggucugcaggcggccaauauugaaggggcuuggggaaguggcguugguuuuacacuuaccugccaggugucccugacugagugcccuacauuccuuaccucuaucaaggccugugauauggcaauaugcuauggcgcugaaagcgucacuuugucccgugggcaaaacaccgugaaaaucacaggaaagggcgggcacucaggaagcaguuuuaaguguugccauggcaaagaguguucuuccacgggucugcaggccagcgcaccccacuuagacaagguuaaugggauuucggagcucgaaaacgagaaaguguacgaugacggagccccagaaugcggcaucaccuguugguucaagaaaucaggugaguggguaaugggcauuaucaaugggaacuggauaguccugauugugcuuugcgugcuguugcucuuuucucugauccuacugaguauccucuguccgguccggaagcauaagaaauccuga

SEQ ID NO: 10188 - RNA, 3402 nt, Artificial Sequence
  derived and/or modified CDS sequence (opt3) from SEOV(5CSG)__AB618130.1__GP
auguggagccugcuccuucuggccgcuuuggcaggccagggguucgccuuaaagaacguguuugacaugagaauccaaugcccccacuccgucaauuucggagagaccucuguuucagguuacacagaacugccuccacuaagucuccaggaggcggaacagcuggugccggagagcuccuguaacauggauaaucaucagucucuuucgacuauuaacaaacugacgaagguaauauggaggaaaaaggcuaaucaagaaucagccagccagaacaguuuugagguggucgaguccgaagugucuuucaaaggcuugugcaugcucaagcaccggaugguugaggaaagcuaucgcaaucgacguuccgugaucuguuacgaccuggcaugcaacucaaccuuuuguaagcccacagucuauaugauugugccuauccaugccugcaauaugaugaaaaguugucugauugggcucggaccauacagaauccagguaguuuaugagaggacuuacugcaccacaggcauauuaaccgaggguaaguguuucgugcccgauaaagcugucgugagcgcacugaagcgggggauguaugccaucgcuucuauugaaacuaucugcuuuuucauucaccagaaaggaaacacauacaagaucgugaccgccauaacguccgcgaugggcucaaaguguaauaacacugacaccaaaguccaaggcuacuauauuugcaucauugggggaaauagcgcaccuguuuacgccccagcuggugaggauuuucgcgccauggaaguguucaguggcaucaucacaucuccccauggggaggaccacgaucuuccuggagaagagauugcaacuuaucagauauccggccagaucgaggcuaagauuccacacaccguaagcucgaaaaacuugaagcugacagccuuugcggguaucccgucuuacuccucaaccaguauacuagccgcaagcgaagacgggagauucauuuuuagccccggacucuucccuaaucugaaccagucugugugcgauaacaaugcccuuccacugaucuggaggggcuugaucgaccucacgggcuauuacgaggcuauucaucccuguaacgucuucugcgugcugagcgggccuggagcuucaugugaagccuuuagugaggguggcaucuucaauauuacuuccccaaugugcuuaguuagcaaacaaaaccgguuucgcgcagccgaacagcagauaucuuucgugugucaacgagucgauauggacaucauuguguauugcaaugggcagaagaaaacaauccugaccaagacucucguaaucggacaguguauuuacacaauaaccucacuuuuuagucuguugcccggcguugcucacagcaucgcgauugagcuaugcgugccggguuuccaugggugggcaacggccgcucugcucaucaccuuuuguuucggcuggguccugauuccugccugcacacuugcaauccuguuggugcucaaguuuuucgccaacauacugcacacuuccaaucaggagaacagauuuaaagcuaucuuaaggaagauuaaagaagaguucgaaaagaccaaaggaucuauggucugugagaucugcaaguacgaaugcgagacacugaaggagcuaaaagcccacaaucucucgugugugcaaggcgaaugccccuauuguuuuacucauugcgagccaaccgaaacagcaauucaggcgcacuacaagguuugucaggcuacccaucgguuccgugaggaucugaaaaagacugugacgccucagaacaucgggcccggaugcuaucgcacacuuaauuuguucagauacaaauccagguguuauauacugaccauguggacucuccugcuuauuaucgaguccauucugugggccgcaucagccgcugaaaucccauugguaccccucuggaccgacaacgcccacggugucggcagugugccuaugcauacagaccuggaguuagauuuuucucugccaagcuccucaaaguacaccuauaagcggcaccuaacuaauccgguuaacgaccaacagagcgugucuguccacauagaaaucgagucccaggggauuggagcagaugugcaucaccucggccauugguacgacgcucgacugaaucuuaaaacaaguuuccacugcuacggugccuguacgaaguaucaguaccccuggcacaccgcgaaaugccauuuugaaaaggauuaugaguacgagaacagcugggccuguaacccuccagacugccccgggguaggcacuggaugcacagcuuguggcuuguaucuggaucaacucaaaccuguggggaccgcauucaagaucauuucuguucgcuacuccagaaaggucugcgugcaguuuggagaagaguaucuguguaaaacaaucgacaugaaugauugcuucgugacuaggcacgccaagauauguauuaucgguaccgucucaaaauuuagucagggcgacacguuacuguuccuugggccaauggaaggaggcgguaucauuuuuaagcauuggugcaccagcacaugucacuucggggaucccggcgacguuaugggaccgaaagacaagccuuuuaucugcccagaguuccccggccaguuucggaaaaaguguaacuucgcuacuaccccugugugcgaauacgaugggaauacaauuucgggauacaagaaaguguuggccacuauagacuccuuccaaucuuuuaacaccagcaauauccauuucacggaugagcgcauugaguggagagaccccgauggcaugcucagggaccacaucaacauuguaaucucaaaggauauagacuuugaaaaucuggcagagaacccauguaaagucggucuacaggcggccaauaucgaaggggcuuggggaaguggcguggguuucacacugaccugccagguuucccucacugagugcccuacauuucugaccucuauuaaggccugugauauggcaaucugcuauggcgcugaaagcgugacucuuucccgugggcaaaacaccgucaaaauuacaggaaagggcgggcacucaggaagcaguuucaaguguugccauggcaaagaguguucuuccacggguuugcaggccagcgcaccccaccuggacaaggugaaugggaucucggaguuagaaaacgagaaaguuuacgaugacggagccccagaaugcggcauaaccuguugguuuaagaaaucaggugagugggugaugggcauuaucaaugggaacuggguaguccucaucgugcugugcgugcuucuguuguucucucucauucugcuaaguauacuguguccgguccggaagcauaagaaauccuga

SEQ ID NO: 10189 - RNA, 3402 nt, Artificial Sequence
  derived and/or modified CDS sequence (opt3) from SEOV(80-39)__S47716.1__GP
auguggagccugcuccuucuggccgcuuuggugggccagggguucgcauuaaagaacgucuuugacaugagaauccaaugcccccacuccguuaaauucggagagaccucugugucagguuacacagaacugccuccacuaagucuccaggaggccgaacagcugguaccggagagcuccuguaauauggauaaccaucagucucuuucgacuauuaauaagcugacgaaagugauauggaggaagaaagcgaaccaagaaucagcuaaucagaacagcuuugaguugauggagagugaagucuccuucaagggccucugcaugcugaagcaccggaugguggaggaaucuuaucgcaaucgacguagcguuaucuguuacgaccuggccugcaacuccaccuuuuguaaacccacaguguauaugauugucccuauccaugcaugcaauaugaugaagucaugucucauuggguuaggaccauacagagugcagguaguuuaugagaggacuuacugcaccacaggcauccugaccgaggguaaauguuucgugcccgauaaggccgucgugagugcucuuaaacgggggauguaugcaauagccagcaucgaaacuauuugcuuuuucauccaccagaagggaaacacauacaagauugugaccgcuaucacgucugccaugggcuccaaauguaauaacacugacaccaagguccaaggcuacuauauaugcauuaucgggggaaauucagcgccuguuuacgcaccagccggugaggauuuucgcgcuauggaaguguucagcggcauuaucacaaguccccauggggaggaccacgauuugccuggagaagagaucgccacuuaucagauuucuggccagauagaggcaaaaaucccacacaccguauccagcaagaaccugaaacuaacagcuuuugccgguauuccgucguacucuuccaccucaauccucacggcgagugaagacgggagauucauauuuagccccggacuguucccuaaucuuaaccaguccgugugcgauaacaaugcccugccauugauuuggaggggccucaucgaccugacuggcuauuacgaggcaguccaucccuguaacguguucugcguuuuaucugggccuggagcuagcugugaagccuuuucagaggguggcaucuucaauauuacaaguccaaugugccugguguccaagcaaaaccgguuucgcgcugccgaacagcagaucagcuucgucugucaacgaguggauauggacauuauaguauauugcaaugggcagaaaaagaccauccucacuaagacacuuguuauuggacaguguaucuacaccaucacgucucuguuuucauugcuacccggcguggcacacaguauugccauagagcugugcgucccggguuuccaugggugggcuaccgcggcacuccugaucacauuuuguuucggcugggugcuuauuccugccugcacucuggcuaucuugcucguccugaaauuuuucgccaacauuuuacacaccagcaaucaggagaacagauuuaaggcaauccugaggaaaauaaaggaagaguucgagaaaacaaagggauccauggugugugaaaucugcaaguacgaaugcgagacucuaaaagagcucaaggcccacaaucugucuuguguucaaggcgaaugccccuauuguuuuacccauugcgagccaacagaaaccgcuauucaggcccacuacaaagugugucaggcaacucaucgguuccgugaggaucuuaagaaaacgguaacaccucagaacaucgggcccggaugcuaucgcaccuugaaucuguucagauacaagucgagguguuauauucucacuauguggacccugcuucugaucauagagagcauuuugugggcggcuuccgccgcagaaaucccacucgucccccuguggacagacaacgcccacggugugggcucaguuccuaugcauaccgacuuagagcuggauuuuagucuaccaucuagcucccgguacacuuauaagcgacaccucacaaauccggugaacgaccaacagucagucagccugcacauugaaaucgagucucaggggauaggagcugaugugcaucaccuuggccauugguacgacgcccgcuugaaucugaaaacguccuuccacugcuacggugcauguaccaaguaucaguaccccuggcacacugcuaaaugccauuuugaaaaggauuaugaguacgagaacaguugggccuguaacccuccagacugccccgggguaggcacaggaugcaccgcguguggccucuaucuggaucaauuaaaaccuguggggacagccuucaagaucauuagcguuagauacucuaggaaggucugcgugcaguuuggagaagaguaucuguguaaaacuaucgacaugaaugauugcuucgugacccggcacgcuaagauuuguaucauagguacggucuccaaauuuucacagggcgacacccuuuuguuccucgggccaauggaaggaggcgguauuaucuuuaagcauuggugcacaaguacuugucacuucggggaucccggcgacguuaugggaccgaaagacaagccuuuuaucugcccagaguuccccggccaguuucgcaaaaaguguaacuucgcaaccacaccugugugcgaauacgaugggaauauuaucagcggauacaagaaagugcuggccacuauugacucguuccaauccuuuaacaccucuaauauacauuucacggaugagagaaucgaguggagggaccccgauggcaugcuacgugaccacauuaacaucguaauuagcaaggauaucgacuuugaaaaucuggcugagaacccauguaaagucggucuccaggccgcaaauauagaaggggcguggggaucaggcguggguuucacacugaccugccagguuagucuuacugagugcccuacauuuuugaccuccauccgggccugugauauggcuauuugcuauggcgccgaaucugugacucugagccgagggcaaaacaccgucaagaucacaggaaaaggcgggcacuccggaagcucauucaaguguugccauggcaaggaguguaguuuaacgggucuccaggcaucugcuccccaccuggacaaagugaaugggauuuccgagcuugaaaacgagaagguuuacgaugacggagccccagaaugcggcaucaccuguugguuuaaaaagagcggugagugggugaugggcauaauuaaugggaacuggguaguccugaucguguugugcgugcuccugcuauucucgcugauccuccugucaauucuuuguccggucagaaaacauaagaagucuuga

SEQ ID NO: 10190 - RNA, 3402 nt, Artificial Sequence
  derived and/or modified CDS sequence (opt3) from SEOV(93HBQ3)__KM115585.1__GP
auguggagccugcuccuucuggccgcuuuggugggccagggguucgcauuaaagaacgucuuugacaugagaauccaaugcccccacuccguuaaauucggagagaccucugugucagguuacacagaacugccuccacuaagucuccaggaggccgaacagcugguaccggagagcuccuguaauauggauaaccaucagucucuuucgacuauuaauaagcugacgaaagugauauggcaaaagaaagcgaaccaggaaucagcuaaucagaacagcuuugaggucgccgagagugaaguguccuucaagggcuugugcaugcucaagcacaggaugguugaggaaucuuaucggaaucgccgaagcgugaucuguuacgaccuggcaugcaacuccaccuuuuguaaacccacagucuauaugauugugccuauccaugccugcaauaugaugaagucaugucugauugggcucggaccauaccguauccagguaguuuaugagagaacuuacugcaccacaggcauauuaaccgaggguaaauguuucgugcccgauaaggcugucgugagugcacugaaaagggggauguaugccaucgcuagcauugaaacuaucugcuuuuucauucaccaaaagggaaacacauacaagaucgugaccgccauaacgucugcgaugggcuccaaauguaauaacacugacaccaagguccagggcuacuauauuugcaucauugggggaaauucagcaccuguuuacgccccaagcggugaggauuuucgggcuauggaaguguucaguggcaucaucaugucuccccauggggaggaccacgaucuuccuggagaagagauugccacauaucagauauccggccagaucgaggcaaaaauuccacacacuguaagcucgaagaacuugaaacugaccgcuuuugccgguaucccgucuuacuccucaacaaguauacuagcggccagcgaagacgggcgcuucaucuuuucccccggacucuucccuaaucugaaccaaucugugugcgauaacaaugcacuuccacugauuuggagaggcuugaucgaccucaccggcuauuacgaggcuguccaucccuguaacguguucugcguucugagcgggccuggagccucaugugaagccuuuagugaggguggcauuuucaauaucacguccccaaugugcuuagugagcaagcagaacagguuucgggccgcagaacagcaaauuucuuucgucugucagcgcguggauauggacauaaucguauauugcaaugggcagaaaaagacuauucugacaaagacccucguuaucggacaguguaucuacacuauuacaucacuuuuuagucuguugcccggcguggcccacagcauagcuaucgagcuaugcgucccggguuuccaugggugggcgaccgcagcccugcucauuacguuuuguuucggcugggugcugaucccugcuugcacccuugccauucuguugguccucaaauuuuucgcaaacauccugcacacauccaaucaagagaaccgauuuaaggccauauuaagaaaaaucaaggaagaguucgagaaaacuaagggaucuauggugugugaaauuugcaaguacgaaugcgagacccugaaagagcuaaaggcucacaaucucucguguguucagggcgaaugccccuauuguuuuacacauugcgagccaacugaaaccgccauccaggcacacuacaaagugugucaggcgacacauagguuccgggaggaucugaagaaaaccguaacuccucaaaacauugggcccggaugcuaucguacgcuuaauuuguuccgcuacaagagcagauguuauauccugacaauguggacccuccugcuuauaauugaguccauccugugggcugccucagcagccgaaauuccauuggucccccucuggacugacaacgcucacggugugggcaguguuccuaugcauaccgaccuggaguuagauuuuucucugccaagcuccucaaaguacacauauaaaaggcaccuaaccaauccggugaacgaccagcagagcgucucucuccacaucgaaauagagucccaggggaucggagccgaugugcaucaccugggccauugguacgacgcacggcuuaauuugaagacuucauuccacugcuacggugcuuguacaaaauaucaauaccccuggcacacggccaagugccauuuugaaaaagauuaugaguacgagaacagcugggcguguaacccuccagacugccccgggguaggcaccggaugcacugccuguggccuguaucucgaucagcugaagccuguggggacagcuuuaaagauuaucucuguucgauacucccgcaaagucugcgugcaguucggagaagaguaucuguguaagaccauugacaugaaugauugcuuugugacaagacacgcaaaaaucuguauaauugguacugucucaaaguucagucagggcgacacccuuuuguuucucgggccaauggaaggaggcgguaucaucuucaaacauuggugcacgagcaccugucacuuuggggaucccggcgacguuaugggaccgaaggacaaaccuuucauuugcccagaguuucccggccaauucaggaagaaguguaacuuugccacaacuccugugugcgaauacgaugggaauaucauuucgggauacaaaaaggugcuggcuaccauagacuccuuccagucuuucaacacaagcaauauccauuuuacugaugagcggauugaguggcgcgaccccgauggcaugcuaagagaccacaucaacauuguaaucucaaaagauauagacuucgaaaaucuggccgagaacccauguaaggucggucuccaggcagcgaauaucgaaggggccuggggaaguggcguggguuuuacccugacgugccaaguuucccuuacagagugcccuaccuucuugacuucuauuaaggcuugugauauggccaucugcuauggcgcagaaagcgugacacuguuaagggggcagaacaccgucaaaauuacuggaaagggcgggcacuccggaaguagcuuuaaauguugccauggcaaggaguguaguucuaccggucuccaggcuuccgcuccccaccuggacaaagugaaugggaucagcgagcuugaaaacgagaagguuuacgaugacggagcaccagaaugcggcauaacauguugguucaaaaagucgggugagugggugaugggcauuaucaaugggaacuggguaguccugaucguguugugcgugcuccugcuauuuucacugauucuccugucuauacuuuguccgguccguaagcauaaaaagaguuga

SEQ ID NO: 10191 - RNA, 3402 nt, Artificial Sequence
  derived and/or modified CDS sequence (opt3) from SEOV(93HBQ4)__KM115586.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaagcugacgaaggugauauggaggaaaaaggcgaaucaagaaucagcuaaccagaauagcuuugaggucgccgagagugaaguguccuucaaaggcuugugcaugcucaagcaccggaugguugaggaaucuuaucgcaaccgacguagcgugaucuguuacgaccuggcaugcaauuccaccuuuuguaagcccacagucuauaugauugugccuauccaugccugcaacaugaugaaaucaugucugauugggcucggaccauacagaauccagguaguuuaugagaggacuuacugcaccacaggcauauuaaccgaggguaaguguuucgugcccgauaaagcugucgugagugcacugaagcgggggauguaugccaucgcuagcauugaaacuaucugcuuuuucauucaccagaaaggaaauacauacaagaucgugaccgccauaacgucugcgaugggcuccaaguguaacaauacugacaccaaaguccaaggcuacuauauuugcaucauugggggaaacucagcaccuguuuacgccccaagcggugaggauuuucgcgcuauggaaguguucaguggcaucaucaugucuccccauggggaggaccacgaucuuccuggagaagagauugccacauaucagauauccggccagaucgaggcaaagauuccacacacuguaagcucgaaaaauuugaagcugaccgcuuuugccgguaucccgucuuacuccucaacaaguauacuagcggccagcggggacuccagauucauuuuuagccccggacucuucccuaaccugaaccagagcgugugcgauaauaacgcacuuccacugaucuggaggggcuugaucgaccucaccggcuauuacgaagcuguccaucccuguaauguguucugcguucugucagggccuggagccaguugugaggcuuuuuccgaagguggcauuuucaacaucacgagcccaaugugcuuagugucuaaacaaaaucgguuucgcgccgcagagcagcagauuucauucgucugucaacgaguggauauggacauaaucguauauugcaacgggcagaagaaaacuauucugacaaagacccucguuaucggacaguguaucuacacuauuacaagucuuuuuagccuguugcccggcguggcccacuccauagcuaucgaacuaugcgucccggguuuccaugggugggcgaccgcagcccugcucauuacguuuuguuucggcugggugcugaucccugcuugcacccuugccauucuguugguccucaaguuuuucgcaaauauccugcacacaucuaaccaggagaauagauuuaaagccauauuaaggaagaucaaagaggaguucgaaaagacuaaaggaucgauggugugugaaauuugcaaguacgagugcgaaacccugaaggagcuaaaagcucacaaccucagcuguguucaaggcgagugccccuauuguuuuacacauugcgaaccaacugagaccgccauccaggcacacuacaaggugugucaggcgacacaucgguuccgugaagaucugaaaaagaccguaacuccucagaauauugggcccggaugcuaucgcacgcuuaacuuguucagauacaaauccagguguuauauccugacaauguggacccuccugcuuauaauugagucaauccugugggcugccagugcagccgagauuccauuggucccccucuggacugacaaugcucacggugugggcucuguuccuaugcauaccgaccuggaauuagauuuuagccugccauccucaagcaaguacacauauaagcggcaccuaaccaacccggugaaugaccaacagucugucucccuccacaucgagauagaaagucaggggaucggagccgaugugcaucaccugggccauugguacgacgcacgacuuaacuugaaaacuagcuuccacugcuacggugcuuguacaaaguaucaguaccccuggcacacggccaaaugccauuuugagaaggauuaugaauacgagaacucuugggcguguaauccuccagacugccccgggguaggcaccggaugcacugccuguggccuguaucucgaucaacugaaaccuguggggacagcuuucaagauuaucuccguucgcuacucaagaaaggucugcgugcaguuuggagaggaauauuuauguaaaaccauugacaugaacgauugcuucgugacaaggcacgcaaagaucuguauaauugguacugucaguaaauuuagccagggcgacacccugcuuuucuuggggccaauggagggaggcgguaucaucuuuaagcauuggugcacgucgaccugucacuucggggaucccggcgacguuaugggaccgaaagacaagccuuuuauuugcccagaguuccccggccaguuucggaaaaaguguaauuucgccacaacuccugugugcgaauacgaugggaacaucauuuccggauacaagaaagugcucgcuaccauagacucuuuccaaucuuuuaauacaucaaacauccauuucacugaugaaaccauugaguggcgcgaccccgauggcaugcugagagaccacaucaauauuguaaucaguaaggauauagacuuugagaaccuagccgaaaauccauguaaagucggucugcaggcagcgaacaucgagggggccuggggauccggcguggguuucacgcucacaugccagguuucucugaccgaaugcccuacuuuucuuacaagcauuaaggcuugugauauggccaucugcuauggcgcagaguccgugaccuugucaagggggcaaaauacugucaaaauuaccggaaagggcgggcacagcggaaguucuuucaaguguugccauggcaaagaauguuccagcacaggucugcaggcuucggcaccccacuuagacaaggugaacgggaucucagagcucgagaaugaacguguuuacgaugacggagccccagagugcggcauaacguguugguuuaaaaagucuggugaaugggugaugggcauuaucaacgggaauuggguaguccugaucgugcuuugcgugcugcucuuguucagucugauucuacuguccauacucuguccgguccggaaacauaaaaagagcuga

SEQ ID NO: 10192 - RNA, 3402 nt, Artificial Sequence
  derived and/or modified CDS sequence (opt3) from SEOV(B1)__AB457790.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucguggagagugaaguuuccuucaaaggcuugugcaugcucaagcaccggaugguggaggaaucuuaucgcaaccgacguagcgucaucuguuacgaccuggccugcaauuccaccuuuuguaagcccacaguguauaugauuguaccuauccaugcaugcaacaugaugaaaucaugucugauugggcucggaccauacagaauccagguuguguaugagaggacuuacugcaccacaggcauauuaaccgaggguaaguguuucguccccgauaaagccguggugagugcucugaagcgggggauguaugcaaucgccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuucgcgcuauggaaguauucagcggcaucaucacaaguccccauggggaggaccacgaucuuccuggagaagagauugccacuuaucagauaucuggccagaucgaggcaaagauuccacacaccguguccagcaaaaauuugagacugacagcuuuugccgguaucccgucguacucuuccaccucaauacuagcggccagugaagacgggagguucauuuuuagccccggacucuucccuaaccugaaccaguccgucugcgauaauaacgcacuuccacugaucuggcggggcuugaucgaccucacgggcuauuacgaggcugugcaucccuguaauguuuucugcgugcugucugggccuggagccagcugugaagccuuuucagaggguggcauuuucaacaucacuucaccaaugugcuuagucuccaagcaaaaucgcuuucgagccgcagaacagcagauuagcuucgugugucaaagaguagauauggacauaaucguuuauugcaacgggcagaaaaagacaauucugaccaaaacucucgugaucggacaguguaucuacacaauuaccucucuguuuucacuuuugcccggcgucgcccacaguauagcuaucgagcuaugcgugccggguuuccaugggugggcgacggcagcccugcucauuaccuuuuguuucggcuggauccugauuccugcuuggacacuugccauccuguugguccucaaguuuuucgcaaauauacugcacacuagcaaccaggagaauagguuuaaggccaucuuacggaaaauuaaggaagaguucgagaaaaccaagggauccauggugugcgaaaucuguaaauacgaaugcgagacacugaaggagcuaaaggcucacaaccucucuugcguucaaggcgaaugucccuauugcuuuacucauugugagccaaccgaaacagccauucaggcacacuacaaaaucugccaggcgacccaucguuuccgcgaggaucugaagaaaacugugacgccucagaauauagggcccggauguuauagaacacuuaacuuguucagguacaagucgcggugcuauauucugaccauguggacucuccugcuuaucauugagagcauccugugggcugccuccgcagccgaaauaccauugguaccccucuggaccgacaaugcucacggugucggcucagugccuaugcauacagaccuggaguuagauuuuagucugccaucuagcuccaaauacaccuauaagcgacaccuaacuaacccgguuaaugaccaacagucagugagccuccacaucgaaauugagucucaggggaucggagccgauguccaucaccugggccauugguacgacgcacgccuuaacuugaagacauccuuccacuguuacggugcuugcacgaaauaucaguaccccuggcacaccgccaagugucauuuugaaaaagauuaugaguacgagaacaguugggcgugcaauccuccagacugucccggggugggcacuggaugcacagccugcggccuguaucucgaucaacugaagccuguagggaccgcuuucaaaauuaucagcgugagauacucuaggaagguuuguguccaguuuggagaagaguauuuaugcaagacaauagacaugaacgauuguuucgugacucggcacgcaaaaauuugcaucaucgguaccguguccaaguuuucacagggcgacacgcugcuuuucuuggggccaauggaaggaggcgguauuaucuuuaaacauugguguaccaguacaugccacuucggggaucccggcgacgucaugggaccgaaggacaaaccuuuuauuuguccagaguuccccggccaguuucgcaagaaaugcaauuucgccacuaccccuguuugugaauacgaugggaacauaaucagcggauacaagaaggugcucgcuacaauugacucguuccaauccuuuaauacuucuaacauccauuucaccgaugagagaauugaguggagggaccccgauggcaugcugcgugaccacaucaauauagugaucagcaaagauauugacuuugaaaaccuagccgagaauccaugcaagguaggucugcaggcagcgaacaucgaaggggccuggggaucaggcgucgguuucacgcucacaugucaggugagucugaccgagugcccuacuuuucuuacauccauuaaggcuugcgauauggccaucuguuauggcgcagaaucuguuaaauugagccgggggcaaaauaccgugaaaauaacuggaaagggcgggcacuccggaaguagcuucaagugcugucauggcaaagagugcaguucuaccggucugcaggcuuccgcuccccacuuagacaaggucaacgggauuagcgagcucgaaaaugagaaaguguacgaugacggagcaccagaauguggcguuacaugcugguuuaagaaaucgggugagugggugaugggcaucaucaacgggaauuggguaguccugauugugcuuugucuguugcuccuguucucacuaauacugcucucuauccugugcccggugcgaaagcauaagaaaaguuga

SEQ ID NO: 10193 - RNA, 3402 nt, Artificial Sequence
  derived and/or modified CDS sequence (opt3) from SEOV(B1)__AB457791.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggcagaaaaaggcgaaucaagaaucagcuaaccagaauagcuuugaggucguggagagugaaguuuccuucaaaggcuugugcaugcucaagcacaggaugguggaggaaucuuaucggaaccgccgaagcgucaucuguuacgaccuggccugcaauuccaccuuuuguaagcccacaguguauaugauuguaccuauccaugcaugcaacaugaugaaaucaugucugauugggcucggaccauaccguauccagguugccuaugagagaacuuacugcaccacaggcauauuaaccgaggguaaguguuucgugcccgauaaagcugucgugagugcacugaagagggggauguaugccaucgcuagcauugaaacuaucugcuuuuucauucaccaaaaaggaaauacauacaagaucgugaccgccauaacgucugcgaugggcuccaaguguaacaauacugacaccaaaguccagggcuacuauauuugcaucauugggggaaacucagcaccuguuuacgccccagcuggugaggauuuucgggccauggaaguguucagcggcaucaucacaaguccccauggggaggaccacgaucuuccuggagaagagauugcaacuuaucagauaucuggccagaucgaggcuaagauuccacacaccguauccagcaaaaauuugcgccugacagccuuugcggguaucccgucguacucuuccaccucaauacuagccgcaaguaaggacgggagauucauuuuuagccccggacucuucccuaaccugaaccaauccgugugcgauaauaacgcccuuccacugaucuggaggggcuugaucgaccucacgggcuauuacgaagcuguccaucccuguaauguguucugcguucugucugggccuggagcuagcugugaggccuuuucagaagguggcauuuucaacaucacuucaccaaugugcuuaguguccaaacagaaucgguuucgcgcagccgagcagcaaauuagcuucgucugucagcgaguggauauggacauaaucguauauugcaacgggcagaagaaaacaauucugaccaagacucucguuaucggacaguguaucuacacaauuaccucucuuuucucacuguugcccggcguggcucacaguauagcgaucgaacuaugcgucccggguuuccaugggugggcaacggccgcucugcucauuaccuuuuguuucggcuggauccugauuccugccugcacacuugcaauccuguuggugcucaaguuuuucgccaauauacugcacacuagcaaccaagagaauagauuuaaagcuaucuuaaggaagauuaaagaggaauuugagaagaccaaaggauccauggucugugaaaucugcaaguacgagugcgaaacacugaaggagcuaaaagcccacaaccucucuugugugcagggcgagugccccuauuguuuuacucauugcgaaccaaccgagacagcaauucaggcgcacuacaagaucugucaggcuacccaucgguuccgugaagaucugaaaaagacuguuacgccucaaaauauagggcccggaugcuaucgcacacuuaacuuguucagauacaaaucgagguguuauauucugaccauguggacucuccugcuuaucauugagagcauccugugggccgcauccgccgcugagauaccauuggugccccucuggaccgacaaugcccacgguguaggcucagucccuaugcauacagaccuggaauuagauuuuagucugccaucuagcuccaaguacaccuauaagcggcaccuaacuaacccggugaaugaccagcagucaguuagccuccacaucgagauugaaucucaggggaucggagcagaugugcaucaccugggccauugguacgacgcucgacuuaacuugaaaacauccuuccacugcuacggugccuguacgaaguaucaauaccccuggcacaccgcgaaaugccauuuugagaaggauuaugaauacgagaacaguugggccuguaauccuccagacugccccggggucggcacuggaugcacagcuuguggccuguaucucgaucagcugaaaccuguggggaccgcauucaagauuaucagcguacgcuacucuagaaaggugugcguucaguuuggagaggaauauuuauguaaaacaauagacaugaacgauugcuucgucacuaggcacgccaagauuuguaucaucgguaccguguccaaauuuucacagggcgacacgcugcuuuucuuggggccaauggagggaggcgguauuaucuuuaagcauuggugcaccaguacaugucacuucggggaucccggcgacgugaugggaccgaaagacaagccuuuuauuugcccagaguuccccggccaauuucggaaaaaguguaauuucgcuacuaccccugucugcgaauacgaugggaacauaaucagcggauacaagaaaguucucgccacaauugacucguuccaguccuuuaauacuucuaacauccauuucaccgaugaacgcauugaguggagagaccccgauggcaugcugagggaccacaucaauauagugaucagcaaggauauugacuuugagaaccuagcagaaaauccauguaaagugggucugcaggcggccaacaucgagggggcuuggggaucaggcguagguuucacgcucacaugccaagucagucugaccgaaugcccuacuuuucuuacauccauuaaggccugugauauggcaaucugcuauggcgcugagucugugaccuugagccgugggcagaauacuguuaaaauaaccggaaagggcgggcacuccggaaguagcuucaaguguugccauggcaaagaauguaguucuacaggucugcaggccuccgcaccccacuuagacaaggugaacgggauuagcgagcucgagaaugaaaaagucuacgaugacggagccccagagugcggcgugacguguugguuuaagaaaucgggugaauggguuaugggcaucaucaacgggaauugggugguacugauuguccuuugccuguugcuccuguucucacuaauacugcucucuauccuguguccgauucggaagcauaagaaaaguuga

SEQ ID NO: 10194 - RNA, 3402 nt, Artificial Sequence
  derived and/or modified CDS sequence (opt3) from SEOV(B1)__AB457792.1__GP
auguggagccugcuccuuauggccgcucuggugggccagggguucgcauugaagaacgucuuugacaugagaauccaaugcccccacuccguuaauuucggagagaccucugugucagguuacacagaauuaccuccacugagucuacaggaggccgaacagcucguaccggagagcuccuguaacauggauaaucaucagucucugucgacuauuaacaaacuuacgaaggugauauggcagaaaaaggcgaaucaagaaucagcuaaccagaauagcuuugaggucguggagagugaaguuuccuucaaaggccugugcauguugaagcacaggaugguggaggaaucuuaucggaaccgccgaagcgucaucuguuacgaccucgccugcaauuccaccuuuuguaagcccacaguguauaugauuguaccuauccaugcaugcaacaugaugaaaucaugucugauugggcugggaccauaccguauccagguugccuaugagagaacuuacugcaccacaggcauacucaccgaggguaaguguuucgugcccgauaaagcugucgugagugcauuaaagagggggauguaugccaucgcuagcauugaaacuaucugcuuuuucauucaccaaaaaggaaauacauacaagaucgugaccgccauaacgucugcgaugggcuccaaguguaacaauacugacaccaaaguccagggcuacuauauuugcaucauugggggaaacucagcaccuguuuacgccccagcuggugaggauuuucgggccauggaaguguucagcggcaucaucacaaguccccauggggaggaccacgaucugccuggagaagagauugcaacuuaucagauaucuggccagaucgaggcuaagauuccacacaccguauccagcaaaaaucuucgcuugacagccuuugcggguaucccgucguacucuuccaccucaauacuggccgcaaguaaggacgggagauucauuuuuagccccggacuauucccuaaccucaaccaauccgugugcgauaauaacgcucugccacuuaucuggaggggccugaucgacuugacgggcuauuacgaagccguccaucccuguaauguguucugcguucucucugggccuggagcuagcugugaggccuuuucagaagguggcauuuucaacaucacuucaccaaugugccugguguccaaacagaaucgguuucgcgcagccgagcagcaaauuagcuucgucugucagcgaguggauauggacauaaucguauauugcaacgggcagaagaaaacaauuuuaaccaagacucugguuaucggacaguguaucuacacaauuaccucucucuuuucacuucugcccggcguggcucacaguauagcgaucgaauugugcgucccggguuuccaugggugggcaacggccgcucuacugauuaccuuuuguuucggcuggauccucauuccugccugcacacuggcaauccuucugguguugaaguuuuucgccaauauacuccacacuagcaaccaagagaauagauuuaaagcuauccugaggaagauuaaagaggaguucgaaaagaccaaaggauccauggucugugaaaucugcaaguacgagugcgaaacauuaaaggagcugaaagcccacaaccuaucuugugugcagggcgagugccccuauuguuuuacucauugcgaaccaaccgagacagcaauucaggcgcacuacaagaucugucaggcuacccaucgguuccgugaagaucucaaaaagacuguuacgccucaaaauauagggcccggaugcuaucgcacacugaaccuuuucagauacaaaucgagguguuauauuuugaccauguggacucugcuccugaucauugagagcauccuuugggccgcauccgccgcugagauaccacuggugcccuuguggaccgacaaugcccacgguguaggcucagucccuaugcauacagaccucgaacuggauuuuaguuuaccaucuagcuccaaguacaccuauaagcggcaccugacuaacccggugaaugaccagcagucaguuagccuacacaucgagauugaaucucaggggaucggagcagaugugcaucaccucggccauugguacgacgcucgacugaaccuuaaaacauccuuccacugcuacggugccuguacgaaguaucaauaccccuggcacaccgcgaaaugccauuuugagaaggauuaugaauacgagaacaguugggccuguaauccuccagacugccccggggucggcacuggaugcacagcuuguggcuuguaucuggaucagcucaaaccuguggggaccgcauucaagauuaucagcguacgcuacucuagaaaggugugcguucaguuuggagaggaauaucuguguaaaacaauagacaugaacgauugcuucgucacuaggcacgccaagauuuguaucaucgguaccguguccaaauuuucacagggcgacacguuacuguuccuugggccaauggagggaggcgguauuaucuuuaagcauuggugcaccaguacaugucacuucggggaucccggcgacgugaugggaccgaaagacaagccuuuuauuugcccagaguuccccggccaauuucggaaaaaguguaauuucgcuacuaccccugucugcgaauacgaugggaacauaaucagcggauacaagaaaguuuuggccacaauugacucguuccaguccuuuaauacuucuaacauccauuucaccgaugaacgcauugaguggagagaccccgauggcaugcucagggaccacaucaauauagugaucagcaaggauauugacuuugagaaccuggcagaaaauccauguaaagugggucuacaggcggccaacaucgagggggcuuggggaucaggcguagguuucacgcugacaugccaagucagucucaccgaaugcccuacuuuucugacauccauuaaggccugugauauggcaaucugcuauggcgcugagucugugacccuuagccgugggcagaauacuguuaaaauaaccggaaagggcgggcacuccggaaguagcuucaaguguugccauggcaaagaauguaguucuacagguuugcaggccuccgcaccccaccuggacaaggugaacgggauuagcgaguuagagaaugaaaaagucuacgaugacggagccccagagugcggcgugacguguugguuuaagaaaucgggugaauggguuaugggcaucaucaacgggaauugggugguacucauuguccugugccuucugcucuuguucucacugauacuacugucuauccucuguccgauucggaagcauaagaaaaguuga

SEQ ID NO: 10195 - RNA, 3402 nt, Artificial Sequence
  derived and/or modified CDS sequence (opt3) from SEOV(B1)__AB457793.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggcagaaaaaggcgaaucaagaaucagcuaaccagaauagcuuugaggucguggagagugaaguuuccuucaaaggcuugugcaugcucaagcacaggaugguggaggaaucuuaucggaaccgccgaagcgucaucuguuacgaccuggccugcaauuccaccuuuuguaagcccacaguguauaugauuguaccuauccaugcaugcaacaugaugaaaucaugucugauugggcucggaccauaccguauccagguugccuaugagagaacuuacugcaccacaggcauauuaaccgaggguaaguguuucgugcccgauaaagcugucgugagugcacugaagagggggauguaugccaucgcuagcauugaaacuaucugcuuuuucauucaccaaaaaggaaauacauacaagaucgugaccgccauaacgucugcgaugggcuccaaguguaacaauacugacaccaaaguccagggcuacuauauuugcaucauugggggaaacucagcaccuguuuacgccccagcuggugaggauuuucgggccauggaaguguucagcggcaucaucacaaguccccauggggaggaccacgaucuuccuggagaagagauugcaacuuaucagauaucuggccagaucgaggcuaagauuccacacaccguauccagcaaaaauuugcgccugacagccuuugcggguaucccgucguacucuuccaccucaauacuagccgcaaguaaggacgggcauuucauuuuuagccccggacucuucccuaaccugaaccaauccgugugcgauaauaacgcccuuccacugaucuggagaggcuugaucgaccucacgggcuauuacgaagcuguccaccccuguaauguguucugcguucugucugggccuggagcuagcugugaggccuuuucagaagguggcauuuucaacaucacuucaccaaugugcuuaguguccaaacagaauagguuucgggcagccgagcagcaaauuagcuucgucugucagcgcguggauauggacauaaucguauauugcaacgggcagaagaaaacaauucugaccaagacucucguuaucggacaguguaucuacacaauuaccucucuuuucucacuguugcccggcguggcucauaguauagcgaucgaacuaugcgucccggguuuccacgggugggcaacggccgcucugcucauuaccuuuuguuucggcuggauccugauuccugccugcacacuugcaauccuguuggugcucaaguuuuucgccaauauacugcacacuagcaaccaagagaaucgauuuaaagcuaucuuaagaaagauuaaagaggaauuugagaagaccaaaggauccauggucugugaaaucugcaaguacgagugcgaaacacugaaggagcuaaaagcccauaaccucucuugugugcagggcgagugccccuauuguuuuacucacugcgaaccaaccgagacagcaauucaggcgcauuacaagaucugucaggcuacccacagguuccgggaagaucugaaaaagacuguuacgccucaaaauauagggcccggaugcuaucguacacuuaacuuguuccgcuacaaaucgagauguuauauucugaccauguggacucuccugcuuaucauugagagcauccugugggccgcauccgccgcugagauaccauuggugccccucuggaccgacaaugcccaugguguaggcucagucccuaugcacacagaccuggaauuagauuuuagucugccaucuagcuccaaguacaccuauaagaggcaccuaacuaacccggugaaugaccagcagucaguuagccuccauaucgagauugaaucucaggggaucggagcagaugugcaccaucugggccacugguacgacgcucggcuuaacuugaaaacauccuuccacugcuacggugccuguacgaaguaucaauaccccuggcauaccgcgaaaugccacuuugagaaggauuaugaauacgagaacaguugggccuguaauccuccagacugccccggggucggcacuggaugcacagcuuguggccuguaucucgaucagcugaaaccuguggggaccgcauucaagauuaucagcguacgauacucucgcaaggugugcguucaguuuggagaggaauauuuauguaaaacaauagacaugaacgauugcuucgucacuagacaugccaagauuuguaucaucgguaccguguccaaauuuucacagggcgacacgcugcuuuucuuggggccaauggagggaggcgguauuaucuuuaagcacuggugcaccaguacaugucauuucggggaucccggcgacgugaugggaccgaaagacaagccuuuuauuugcccagaguuccccggccaauuuaggaaaaaguguaauuucgcuacuaccccugucugcgaauacgaugggaacauaaucagcggauacaagaaaguucucgccacaauugacucguuccaguccuuuaauacuucuaacauccacuucaccgaugaacggauugaguggcgcgaccccgauggcaugcugagagaccacaucaauauagugaucagcaaggauauugacuuugagaaccuagcagaaaauccauguaaagugggucugcaggcggccaacaucgagggggcuuggggaucaggcguagguuucacgcucacaugccaagucagucugaccgaaugcccuacuuuucuuacauccauuaaggccugugauauggcaaucugcuauggcgcugagucugugaccuugagcagggggcagaauacuguuaaaauaaccggaaagggcgggcauuccggaaguagcuucaaguguugccacggcaaagaauguaguucuacaggucugcaggccuccgcaccccauuuagacaaggugaacgggauuagcgagcucgagaaugaaaaagucuacgaugacggagccccagagugcggcgugacguguugguuuaagaaaucgggugaauggguuaugggcaucaucaacgggaauugggugguacugauuguccuuugccuguugcuccuguucucacuaauacugcucucuauccuguguccgauucguaagcacaagaaaaguuga

SEQ ID NO: 10196 - RNA, 3402 nt, Artificial Sequence
  derived and/or modified CDS sequence (opt3) from SEOV(B1)__AB457794.1__GP
auguggagccugcuccuuauggccgcucuggugggccagggguucgcauugaagaacgucuuugacaugagaauccaaugcccccacuccguuaauuucggagagaccucugugucagguuacacagaauuaccuccacugagucuacaggaggccgaacagcucguaccggagagcuccuguaacauggauaaucaucagucucugucgacuauuaacaaacuuacgaaggugauauggcagaaaaaggcgaaucaagaaucagcuaaccagaauagcuuugaggucguggagagugaaguuuccuucaaaggccugugcauguugaagcacaggaugguggaggaaucuuaucggaaccgccgaagcgucaucuguuacgaccucgccugcaauuccaccuuuuguaagcccacaguguauaugauuguaccuauccaugcaugcaacaugaugaaaucaugucugauugggcugggaccauaccguauccagguugccuaugagagaacuuacugcaccacaggcauacucaccgaggguaaguguuucgugcccgauaaagcugucgugagugcauuaaagagggggauguaugccaucgcuagcauugaaacuaucugcuuuuucauucaccaaaaaggaaauacauacaagaucgugaccgccauaacgucugcgaugggcuccaaguguaacaauacugacaccaaaguccagggcuacuauauuugcaucauugggggaaacucagcaccuguuuacgccccagcuggugaggauuuucgggccauggaaguguucagcggcaucaucacaaguccccauggggaggaccacgaucugccuggagaagagauugcaacuuaucagauaucuggccagaucgaggcuaagauuccacacaccguauccagcaaaaaucuucgcuugacagccuuugcggguaucccgucguacucuuccaccucaauacuggccgcaaguaaggacgggcauuucauuuuuagccccggacuauucccuaaccucaaccaauccgugugcgauaauaacgcucugccacuuaucuggagaggccugaucgacuugacgggcuauuacgaagccguccaccccuguaauguguucugcguucucucugggccuggagcuagcugugaggccuuuucagaagguggcauuuucaacaucacuucaccaaugugccugguguccaaacagaauagguuucgggcagccgagcagcaaauuagcuucgucugucagcgcguggauauggacauaaucguauauugcaacgggcagaagaaaacaauuuuaaccaagacucugguuaucggacaguguaucuacacaauuaccucucucuuuucacuucugcccggcguggcucauaguauagcgaucgaauugugcgucccggguuuccacgggugggcaacggccgcucuacugauuaccuuuuguuucggcuggauccucauuccugccugcacacuggcaauccuucugguguugaaguuuuucgccaauauacuccacacuagcaaccaagagaaucgauuuaaagcuauccugagaaagauuaaagaggaguucgaaaagaccaaaggauccauggucugugaaaucugcaaguacgagugcgaaacauuaaaggagcugaaagcccauaaccuaucuugugugcagggcgagugccccuauuguuuuacucacugcgaaccaaccgagacagcaauucaggcgcauuacaagaucugucaggcuacccacagguuccgggaagaucucaaaaagacuguuacgccucaaaauauagggcccggaugcuaucguacacugaaccuuuuccgcuacaaaucgagauguuauauuuugaccauguggacucugcuccugaucauugagagcauccuuugggccgcauccgccgcugagauaccacuggugcccuuguggaccgacaaugcccaugguguaggcucagucccuaugcacacagaccucgaacuggauuuuaguuuaccaucuagcuccaaguacaccuauaagaggcaccugacuaacccggugaaugaccagcagucaguuagccuacauaucgagauugaaucucaggggaucggagcagaugugcaccaucucggccacugguacgacgcucggcugaaccuuaaaacauccuuccacugcuacggugccuguacgaaguaucaauaccccuggcauaccgcgaaaugccacuuugagaaggauuaugaauacgagaacaguugggccuguaauccuccagacugccccggggucggcacuggaugcacagcuuguggcuuguaucuggaucagcucaaaccuguggggaccgcauucaagauuaucagcguacgauacucucgcaaggugugcguucaguuuggagaggaauaucuguguaaaacaauagacaugaacgauugcuucgucacuagacaugccaagauuuguaucaucgguaccguguccaaauuuucacagggcgacacguuacuguuccuugggccaauggagggaggcgguauuaucuuuaagcacuggugcaccaguacaugucauuucggggaucccggcgacgugaugggaccgaaagacaagccuuuuauuugcccagaguuccccggccaauuuaggaaaaaguguaauuucgcuacuaccccugucugcgaauacgaugggaacauaaucagcggauacaagaaaguuuuggccacaauugacucguuccaguccuuuaauacuucuaacauccacuucaccgaugaacggauugaguggcgcgaccccgauggcaugcucagagaccacaucaauauagugaucagcaaggauauugacuuugagaaccuggcagaaaauccauguaaagugggucuacaggcggccaacaucgagggggcuuggggaucaggcguagguuucacgcugacaugccaagucagucucaccgaaugcccuacuuuucugacauccauuaaggccugugauauggcaaucugcuauggcgcugagucugugacccuuagcagggggcagaauacuguuaaaauaaccggaaagggcgggcauuccggaaguagcuucaaguguugccacggcaaagaauguaguucuacagguuugcaggccuccgcaccccaucuggacaaggugaacgggauuagcgaguuagagaaugaaaaagucuacgaugacggagccccagagugcggcgugacguguugguuuaagaaaucgggugaauggguuaugggcaucaucaacgggaauugggugguacucauuguccugugccuucugcucuuguucucacugauacuacugucuauccucuguccgauucguaagcacaagaaaaguuga

SEQ ID NO: 10197 - RNA, 3402 nt, Artificial Sequence
  derived and/or modified CDS sequence (opt3) from SEOV(B-1)__X53861.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucguggagagugaaguuuccuucaaaggcuugugcaugcucaagcaccggaugguggaggaaucuuaucgcaaccgacguagcgucaucuacuaugaccuggccgggaauagcaccuuuuguaagcccacaguguacaugauuguaccuauccaugcaugcaacaugaugaaaucaugucugauuggacucggcccauauagaauccagguuguguacgagaggacuuauugcaccacagguauauuaaccgaggggaaguguuucguccccgauaaagccguggugagugcucugaagcggggaauguacgcaaucgccagcauugaaacuaucugcuuuuucauucaccagaaauggaauaaguacaagaucgucacagcuauaaccucugccaugggcuccaaauguaacaauacggacacuaagguucaaggcuauuacauuugcaucauugggggaaacucagcgccuguguaugcaccagccggugaggauuuucgcgcuauggaaguauucagcggcaucaucaccaguccccauggggaggaccacgaucuuccuggagaagagauugccacauaccacauaucuggccagaucgaggcaaaaauuccacauacuguguccagcaagaauuugagacuggcugccuuugcggguaucccgucguauucuuccaccucaauacuagccgcaagugaagacgggagguucauuuuuagccccggacucuucccuaaccugaaccaguccgucugugauaauaacgcuuugccacugaucuggcggggcuugaucgaccucacaggcuacuaugaggccgugcaccccugcaauguuuucugcgugcugucugggccuggagcuagcugugaagccuuuucagaggguggcauuuucaacaucaccaguccaaugugcuuagucuccaaacagaaucgcuuucgagcagccgaacaacagauuagcuucgugugucagagaguagauauggacauaaucguuuacugcaacgggcaaaagaaaacgauucugacuaagacacucgugaucggacaguguaucuacaccauuacuucucuuuuuagucuguugcccggcgucgcucauaguauagcgaucgagcuaugcgugccggguuuccacgggugggcaacagccgcucugcucauuaccuuuuguuucggcuggguccugaucccugccugcacgcuugcaauucuguuggugcucaaguuuuucgccaauauccugcacaccagcaaccaggagaauagguuuaaagcuauauuacggaagaucaaagaagaguucgaaaagcguaaaggauccaugguuugugagauuugcaaguaugaaugugagacacugaaggagcuaaaagcccauaaccucucuugcgugcagggcgaaugccccuacuguuuuacucacugcgagccaaccgaaacagcaauccaagcgcauuauaagguaugucaggcuacucaccgcuucagagaggaucugaaaaagaccgucacaccucagaauauugggcccggaugcuacaggacccuuaacuuguuccgguauaaaucgcgauguuacauccugacuauguggacgcuccugcuuauaauugagagcauccugugggccgcauccgccgcugaaauuccauuggugccccucuggacagacaaugcccaugguguuggcucagugccuaugcacaccgaccuggaguuagauuuuagucugccaucuagcuccaaguauacuuacaagcgccaccuaaccaacccggucaaugaccagcaaucagugagccuccauaucgaaauagagucucaggggaucggagcagauguacaccaucugggccacugguacgacgcuagacuuaacuugaaaacauccuuccacugcuauggugccuguaccaaguaccaguaucccuggcauacugcgaaaugccacuuugaaaaggauuacgaguaugagaacaguugggccuguaauccuccagacugccccggggugggcacaggauguacggcuugcggccuguaccucgaucagcugaaaccuguugggaccgcauucaagauuaucagcgucagguauucucggaaggugugcgugcaauuuggagaggaacauuuauguaaaacuauugacaugaacgauugcuucgucacacgccacgccaagaucuguauaauugguaccguuuccaaauuuucacagggcgacacacugcuuuucuuggggccaauggaaggaggcgguaucaucuuuaagcauuggugcacuucaaccugucacuucggggaucccagagacgugaugggcccgaaagacaagccuuuuauuugcccagaguuccccggacaguuuaggaaaaaguguaauuucgcuacgaccccugugugcgaauacgauggcaacaucauuagcggguacaagaaaguacucgccacaauagacucguuccaguccuuuaauacuucuaacauccacuucaccgaugagcguauugaguggcgggaccccgauggaaugcugcgagaccauaucaauauugucaucagcaaggauauagacuuugaaaaccuagcagagaauccauguaaagugggccugcaagcggccaacaucgaaggugcuugggggucaggaguuggcuucacacucacuugccaggugagucugaccgaguguccuacguuucuuacauccauuaaggccugcgauauggcaaucugcuauggugcugaaucugucaccuugagcagaggccagaauacugugaaaauuacagggaagggaggccacuccgggucauccuucaaguguugccauggaaaagaguguaguucuaccggccugcaagccuccgcaccccacuuagacaagguuaacgguaucagcgagcucgaaaaugagaaaguguacgaugacggggccccagaaugcggaguaacuuguugguuuaagaaaucgggcgagugggucauggguauaauuaacggcaauuggguggugcugaucguccuuugcguucugcuucucuucucacugauccuacugucuauucucuguccggugaggaagcauaagaaaaguuga

SEQ ID NO: 10198 - RNA, 3402 nt, Artificial Sequence
  derived and/or modified CDS sequence (opt3) from SEOV(BjHD01)__DQ133505.1__GP
auguggagccuccuguuccuugccgcucuggugggccagggguuugcauugaagaacgucuucgacaugagaauccaaugcccccacuccguuaauuuuggagagaccucugugucagguuacacagaauuaccuccacugagucuacaggaggccgaacagcucguaccggagagcuccuguaacauggauaaucaucagucucugucgacuauuaacaaacuuacgaaggugauauggaggaaaaaggcgaaucaagaaucagcuaaccagaauagcuucgaggucguggagagugaaguuuccuuuaaaggccugugcauguugaagcaccggaugguggaggaaucuuaucgcaaccgacguagcgucaucuguuacgaccucgccugcaauuccaccuucuguaagcccacaguguauaugauuguaccuauccaugcaugcaacaugaugaaaucaugucugauugggcugggaccauacagaauccagguuguguaugagaggacuuacugcaccacaggcauacucaccgaggguaaguguuuuguccccgauaaagccguggugagugcuuuaaagcgggggauguaugcaaucgccagcauugaaacuaucugcuucuuuauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuccgcgcuauggaaguauuuagcggcaucaucacaaguccccauggggaggaccacgaucugccuggagaagagguggccacuuaucagauuucuggccagauagaggcaaagaucccacacaccgucuccagcaaaaaucuuaaguugacagcuuucgccgguauuccgucguacucuuccaccucaauccuggcggccagugaagacgggagauuuauauucagccccggacuauucccuaaccucaaccaguccgugugcgauaauaacgcacugccacuuauuuggaggggccugaucgacuugacgggcuauuacgaggcuguucaucccuguaauguguuuugcguccucucugggccuggagccagcugugaagccuucucagaggguggcaucuuuaacauuacuucaccaaugugccugguguccaaacaaaaucgguuccgcgccgcagaacagcagaucagcuuuguaugucaacgaguugauauggacauuauaguguauugcaacgggcagaagaaaacaaucuuaaccaagacucuggucauuggacaguguaucuacacaaucaccucucucuucucacuucugcccggcguggcccacaguauugcuauagaguugugcgucccggguuuucaugggugggcgacggcagcccuacugaucaccuucuguuuuggcugggugcucauuccugcuugcacacuggccauccuucugguuuugaaguucuuugcaaauauucuccacacuagcaaccaggagaauagauucaaagccauccugaggaagauaaaagaagaguuugaaaagaccaaaggauccauggugugugagaucugcaaguacgaaugcgagacauuaaaggagcugaaagcucacaaccuaucuuguguacaaggcgaaugccccuauuguuucacucauugcgagccaaccgaaacagccauucaggcacacuacaaggucugucaggcgacccaucgguuccgugaggaucucaaaaagacugugacgccucagaauaucgggcccggaugcuaucgcacacugaaccuuuuuagauacaaaucgagguguuauauuuugaccauguggacucugcuccugaucauagagagcauucuuugggcugccuccgcagccgaaaucccacugguucccuuguggaccgacaaugcucacggugugggcucagucccuaugcauacagaccucgagcuggauuucaguuuaccaucuagcuccaaguacaccuauaagcggcaccugacuaacccggugaaugaccaacagucaguaagccuacacauugaaaucgagucucaggggauaggagccgaugugcaucaccucggccauugguacgacgcacgacugaaccuuaaaacauccuuucacugcuacggugcuuguacgaaguaucaguaccccuggcacaccgccaaaugccauuucgaaaaggauuaugaguacgagaacaguugggcguguaauccuccagacugccccgggguuggcacuggaugcacagccuguggcuuguaucuggaucaacucaaaccugucgggaccgcuuuuaagaucauuagcgugcgcuacucuagaaaggugugcguccaguucggagaagaguaucuguguaaaacaaucgacaugaacgauugcuuuguuacuaggcacgcaaagauuuguaucauagguaccguguccaaauucucacagggcgacacguuacuguuucuugggccaauggaaggaggcgguauuaucuucaagcauuggugcaccaguacaugucacuuuggggaucccggcgacgugaugggaccgaaagacaagccuuucaucugcccagaguuucccggccaguuccggaaaaaguguaauuucgccacuaccccuguaugcgaauacgaugggaacauuaucagcggauacaagaaagucuuggcuacaauugacucguuucaauccuucaauacuucuaacauacauuuuaccgaugagcgcaucgaguggagagaccccgauggcaugcucagggaccacauuaauaucgugauuagcaaggauaucgacuucgaaaaccuggccgagaauccauguaaaguuggucuacaggcagcgaacauagaaggggccuggggaucaggcguggguuuuacgcugacaugccaggucagucucaccgagugcccuacuuuccugacauccaucaaggcuugugauauggccauuugcuauggcgcagaaucugugacccuuagccgugggcaaaauacuguuaaaaucaccggaaagggcgggcacuccggaaguagcuuuaaguguugccauggcgaggaguguaguucuacagguuugcaggcuuccgcuccccaccuggacaaagugaacgggauuagcgaauuagagaaugaaaagguauacgaugacggagcaccagagugcggcgucacguguugguucaaaaagucgggugagugggugaugggcaucauaaacgggaauugggugguccucauuguucugugcgugcuucuguuguuuucacucauccugcuaucuauccuguguccgguacggaaacauaagaagaguuga

SEQ ID NO: 10199 - RNA, 3402 nt, Artificial Sequence
  derived and/or modified CDS sequence (opt3) from SEOV(Cherwell)__KM948593.1__GP
auguggagccugcuccuucuggccgcuuuggugggccagggguccgcauuaaagaacgucuucgacaugagaauccaaugcccccacucuguuaauuuuggagagaccucagugagugguuacacagaacugccuccacuaagccuccaggaggccgaacagcugguaccggaguccucuuguaacauggauaaucaucagucgcuuucaacuauuaacaaacugacgaaggugauauggaggaaaaaggcgaaucaagaaagcgcuaaccagaauaguuucgaggucguggaguccgaaguuucuuuuaaaggcuugugcaugcucaagcaccggaugguggaggaaagcuaucgcaaccgacguuccgucaucuguuacgaccuggccugcaauucaaccuucuguaagcccacaguguauaugauuguaccuauccaugcaugcaacaugaugaaaaguugucugauugggcucggaccauacagaauccagguuguguaugagaggacuuacugcaccacaggcauauuaaccgaggguaaguguuuuguccccgauaaagccguggugagcgcucugaagcgggggauguaugcaaucgccucuauugaaacuaucugcuucuuuauucaccagaaaggaaauacauacaagaucgucaccgcuauaacguccgccaugggcucaaaguguaacaauacugacaccaaaguucaaggcuacuauauuugcaucauugggggaaacagcgcgccuguguacgcaccagccggugaggauuuccgcgcuauggaaguauuuaguggcaucaucacaucuccccauggggaggaccacgaucuuccuggagaagagauugccacuuaucagauauccggccagaucgaggcaaagauuccacacaccgugagcucgaaaaauuugaagcugacagcuuucgccgguaucccgucuuacuccucaaccaguauacuagcggccagcgaagacgggagauuuauuuucucccccggacucuuuccuaaccugaaccagucugucugcgauaauaacgcacuuccacugaucuggaggggcuugaucgaccucacgggcuauuacgaggcugugcaucccuguaauguuuucugcgugcugagcgggccuggagccucaugugaggcuuucagugaagguggcauuuuuaacaucacuuccccaaugugcuuagucagcaaacaaaaucgguuccgcgccgcagaacagcagauuucuuuugugugucaacgaguagauauggacauaaucguuuauugcaacgggcagaagaaaacaauucugaccaagacucucgugaucggacaguguaucuacacaauuaccucacuuuucagucuguugcccggcgucgcccacagcauagcuaucgagcuaugcgugccggguuuucaugggugggcgacggcagcccugcucauuaccuucuguuuuggcuggguccugaucccugcuugcacacuugccauucuguuggugcucaaguucuuugcaaauauccugcacacuuccaaccaggagaauagauucaaagccauauuaaggaagaucaaagaagaguuugaaaagaccaaaggaucuaugguuugugagauuugcaaguacgaaugcgagacacugaaggagcuaaaagcucacaaccucucgugugugcaaggcgaaugccccuauuguuucacucauugcgagccaaccgaaacagccauccaggcacacuacaagguaugucaggcgacccaucgguuucgugaggaucugaaaaagacugucacgccucccaauauugggccaggaugcuaucgcacacuuaacuuguucagauacaaauccagguguuauauccugaccauguggacucuccugcuuauaauugagagcauccugugggcugccucagcagccgaaauucccuuggugccucucuggaccgacaaugcucacgguguuggcagugugccaaugcauacagaccuggaguuagauuucucucugccgagcuccucaaaguacaccuauaagcggcaccuaacuaaccccgucaaugaccagcaaagcgugucucuccacaucgaaauagagucccaggggaucggagccgauguacaucaccugggccauugguacgacgcacgacuuaacuugaaaacaaguuuucacugcuacggugcuuguacgaaguaucaguacccuuggcacaccgccaaaugccauuucgaaaaggauuaugaguacgagaacagcugggcguguaauccacccgacugcccuggggugggcacuggaugcacagccuguggcguuuaucuggaucagcucaaaccagucgggaccgcuuuuaagauugugucugugcgcuacuccagaaaggucugcguucaauucggagaagaguaucuguguaaaacaaucgacaugaacgauugcuuugugacuaggcacgcaaagauuuguaucauagguaccgugucaaaauucagucagggcgacacguuacuguuucuugggcccauggaaggaggcgguauuaucuucaagcauuggugcaccagcacaugucacuuuggggauccgggcgacguaaugggaccuaaagacaagccauucaucugccccgaguuuccuggccaguuccggaaaaaguguaauuuugccacuacccccgucugcgaauacgaugggaacauuaucucgggauacaagaaaguguuggcuacaauugacuccuuccagucuuucaauacuagcaacauacauuuuaccgaugagcgcaucgaguggagagacccagauggcaugcucagggaccacauuaauaucguuauuucaaaggauaucgacuucgaaaaccuggccgagaauccuuguaaagugggucuacaagcagcgaacauagaaggggccuggggaaguggcgucgguuuuacgcugacaugccaggugucccucaccgagugccccacuuuccugacaucuaucaaggcuugugauauggccauuugcuauggcgcagaaagcguuacccuuucccgugggcagaauacugugaaaaucaccggaaagggcgggcacucaggaagcaguuuuaaguguugccauggcaaagaguguucuuccacagguuugcaagcuagcgccccacaccuggacaagguaaacgggauuucggaguuagaaaaugagaaagucuacgaugacggagcaccggaaugcggcgugacguguugguucaagaaaucaucugagugggugauggguaucauaaacggcaauugggucguucucauugugcugugcguacuucuguuguuuagucucauccugcuauccauccuguguccugugcggaagcauaagaaaagcuga

SEQ ID NO: 10200 - RNA, 3402 nt, Artificial Sequence
  derived and/or modified CDS sequence (opt3) from SEOV(HaixingRn40)__GU592924.1__GP
auguggagccugcucuuucuugccgcucuggugggccagggguuugcauugaagaacgucuucgacaugagaauccaaugcccccacuccguuaauuuuggagagaccucugugucagguuacacagaauuaccuccacugagucuacaggaggccgaacagcucguaccggagagcuccuguaacauggauaaucaucagucucugucgacuauuaacaaacuuacgaaggugauauggaggaaaaaggcgaaucaagaaucagcuaaccagaauagcuucgaggucguggagagugaaguuuccuuuaaaggccugugcauguugaagcaccggaugguggaggaaucuuaucgcaaccgacguagcgucaucuguuacgaccucgccugcaauuccaccuucuguaagcccacaguguauaugauuguaccuauccaugcaugcaacaugaugaaaucaugucugauugggcugggaccauacagaauccagguuguguaugagaggacuuacugcaccacaggcauacucaccgaggguaaguguuuuguccccgauaaagccguggugagugcuuuaaagcgggggauguaugcaaucgccagcauugaaacuaucugcuucuuuauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuccgcgcuauggaaguauuuagcggcaucaucacaaguccccauggggaggaccacgaucugccuggagaagagauugccacuuaucagauaucuggccagaucgaggcaaagauuccacacaccguguccagcaaaaaucuuaaguugacagcuuucgccgguaucccgucguacucuuccaccucaauacuggcggccagugaagacgggagauuuauuuucagccccggacuauucccuaaccucaaccaguccgucugcgauaauaacgcacugccacuuaucuggaggggccugaucgacuugacgggcuauuacgaggcugugcaucccuguaauguuuucugcgugcucucugggccuggagccagcugugaggcuuucucagaagguggcauuuuuaacaucacuucaccaaugugccuggucuccaaacaaaaucgguuccgcgccgcagaacagcagauuagcuuugugugucaacgaguagauauggacauaaucguuuauugcaacgggcagaagaaaacaauuuuaaccagaacucuggugaucggacaguguaucuacacaauuaccucucucuucucacuucugcccggcgucgcccacaguauagcuaucgaguugugcgugccggguuuucaugggugggcgacggcagcccuacugauuaccuucuguuuuggcuggguccucaucccugcuugcacacuggccauucuucugguguugaaguucuuugcaaauauccuccacacuagcaaccaggagaauagguucaaggccauacugcggaaaaucaaggaagaguuugagaaaaccaagggauccaugguuugugaaauuugcaaauacgaaugcgagacauuaaaggagcugaaggcucacaaccuaucuugugugcaaggcgaaugccccuauuguuucacucauugcgagccaaccgaaacagccauccaggcacacuacaaaguaugucaggcgacccaucguuuccgcgaggaucucaagaaaacugucacgccucagaauauugggcccggaugcuauagaacacugaaccuuuuuagguacaagucgcgguguuauaucuugaccauguggacucugcuccugauaauugagagcauccuuugggcugccuccgcagccgaaauuccacuggugcccuuguggaccgacaaugcucacgguguuggcucagugccuaugcauacagaccucgagcuggauuucaguuuaccaucuagcuccaaauacaccuauaagcgacaccugacuaacccggucaaugaccaacagucagugagccuacacaucgaaauagagucucaggggaucggagccgauguacaucaccucggccauugguacgacgcacgccugaaccuuaagacauccuuucacugcuacggugcuuguacgaaauaucaguaccccuggcacaccgccaagugccauuucgaaaaagauuaugaguacgagaacaguugggcguguaauccuccagacugccccggggugggcacuggaugcacagccuguggcuuguaucuggaucaacucaagccuguugggaccgcuuuuaaaauuaucagcgucagauacucuaggaaggugugcgugcaguucggagaagaguaucuguguaagacaauugacaugaacgauugcuuugucacucggcacgcaaaaaucuguauaauugguaccguuuccaaguucucacagggcgacacguuacuguuucuugggccaauggaaggaggcgguaucaucuucaaacauuggugcaccaguacaugucacuuuggggaucccggcgacgugaugggaccgaaggacaaaccuuucauuugcccagaguuucccggccaguuccgcaagaaauguaauuucgccacuaccccugugugcgaauacgaugggaacaucauuagcggauacaagaagguauuggcuacaauagacucguuucaauccuucaauacuucuaacauccauuuuaccgaugagagaauugaguggagggaccccgauggcaugcuccgugaccacaucaauauugucaucagcaaagauauagacuucgaaaaccugggucagaauccauguaagguggggcuacaggccgcaaacaucgagggagcguggggcucagguguuggcuuuacgcugacaugccaagugagucucaccgaaugcccuacuuuccugacauccauuaaagccugugauauggcuaucugcuauggggccgagucugucacccuuagccggggacagaauacugugaagauuaccggcaaagggggacacuccggcaguagcuuuaaguguugccaugguaaggaauguaguucuacaggguugcaggcauccgcuccccaccuggacaaaguuaacggaaucagcgauuuagagaaugagaagguguacgacgauggcgccccagaaugcgguguaacguguugguucaaaaagucgggcgagugggucauggggauaauuaacggaaauuggguggugcucaucguccugugcguucuucuguuguuuucacucauccugcuaucuauucuguguccggugcgaaaacauaagaagaguuga

SEQ ID NO: 10201 - RNA, 3402 nt, Artificial Sequence
  derived and/or modified CDS sequence (opt3) from SEOV(HBQ17)__KM233655.1__GP
auguggagccuccuguucguggccgcucuuaucggccagggguuugcacuggagaacgccuucgacaugagaauuaggugcccccacuccguccauuuuggagaaaccucuguuucagguuacacagaguugccuccauuaagucugcaagaagcggagcagcuagugccggaaagcuccuguaauauggauaaccaccagucucucucgacuauaaauaagcugacgaaaguaaucuggcggaagaaagcuaaccaggagucagccaaucaaaacagcuucgagguggucgaaagugcacuuaagauuaaaggccugugcauguugaagcaucgcaugguggaggaauccuaucgaaaucguagaucuguuaucuguuacgaccucgccugcaacagcaccuuuuguaagcccacaguguauaugauugucccuauccacgcuugcaauaugaugaaauccugucugauagggcugggaccauacaggauccaggugguauaugagcggacuuacugcaccacaggcauucucaccgaggguaaguguuucguucccgauaaagcaguggucucagccuuaaagcgcgggauguaugcuaucgccaguauugaaacuaucugcuuuuucauacaucagaaaggaaacacauacaagauugugaccgcgaucacgagcgcaaugggcucuaaguguaauaacacugacaccaaagugcagggcuacuauauuugcaucaucgggggaaauuccgccccugucuacgcuccagccggugaggauuuuagagcaauggaaguuuucucaggcauuauaacaagcccccacggggaggaccacgaucugccuggagaagagaucgcuacuuaucaaauuaguggccagaucgaggccaagauaccacauaccgugucuuccaaaaaccuuaaguugacagcguuugccgguauuccgagcuacucgucuaccuccauccuggcagcuucagaagacgggagguucaucuuuagucccggacuauucccuaaucucaaccagagcguaugcgauaacaaugcccugccacuuauuuggcggggccugaucgacuugacgggcuauuacgaggcugugcaccccuguaacgucuucugcgugcucuccgggccuggagccucuugugaagcauuuagcgaggguggcauuuucaauauaacuucaccaaugugccugguuaguaaacagaaccgcuuucgagccgcugaacaacagaucuccuucgugugucagagagucgauauggacauuaucguguauugcaaugggcaaaagaaaacaaucuuaaccaagacucugguaauuggacaguguauauacacaaucaccagccucuuuucucuucugcccggcguugcgcauucaauugcaaucgaguugugcgugccggguuuccacgggugggccacggcugcccuacugauuaccuuuuguuucggcuggguccucaucccugcaugcacacuggccauacuucugguguugaaguuuuucgcuaacauccuccacaccaguaaucaggagaacagguuuaaagccauucugcggaagaucaaagaagaguucgaaaagacuaaaggaagcauggucugugagauuugcaaguacgaaugcgagacauuaaaggagcugaaagcacauaaucuauccugugugcagggcgaaugccccuauuguuuuacucacugcgagccaaccgaaacagcgauccaagcucauuacaagguuugucaggccacccaccguuuccgcgaggaucucaaaaagacugugacgccucagaacauagggcccggaugcuauagaacacugaaucuuuucagguacaaaucucgguguuauauuuugaccauguggacucugcuccugaucauugagucgauccuuugggcagccagcgcugccgaaauaccacugguacccuuguggaccgacaacgcacauggugucggcuccgugccuaugcacacagaccucgagcuggauuuuucauuaccaaguucuagcaaguacaccuauaagcgacaccugacuaauccgguuaacgaccagcaauccgugucacuacauaucgaaauugagagccaggggaucggagcugauguccaccaucucggccacugguacgacgcccgccugaaucuuaaaacaucuuuccacugcuacggugcguguacgaaguaucaguaccccuggcauaccgccaaaugccacuuugaaaaggauuaugaguacgagaacuccugggcuuguaacccuccagacugccccggggugggcacuggaugcacagcauguggcuuguaucuggaucagcucaaaccuguagggaccgccuucaagauuaucagugugagauacagcaggaagguuugcguccaauuuggagaagaguaucuguguaaaacaauagacaugaaugauugcuucgugacucggcaugcuaagauuuguaucaucgguaccgugucuaaauuuucccagggcgacacguuacuguuccuugggccaauggaaggaggcgguauuaucuuuaagcacuggugcaccucaacaugucauuucggggaucccggcgacgucaugggaccgaaagacaagccuuuuauuugcccagaguuccccggccaguuucgcaaaaaguguaacuucgccacuaccccuguuugcgaauacgaugggaauauaaucaguggauacaagaaaguguuggcaacaauugacagcuuccagucguuuaacacuuccaauauccacuucaccgaugagagaauugaguggagggaccccgauggcaugcuccgugaccacaucaacauagugaucucuaaggauauugacuuugaaaaucuggcggagaacccauguaaaguaggucuacaagccgcuaauaucgaaggggccuggggaagcggcgucgguuucacgcugacaugccaggugucacucaccgagugcccuacuuuucugacaaguauuaaggcaugugauauggcuaucugcuauggcgccgaauccguuacccuuucucgggggcagaacacugugaaaauaaccggaaagggcgggcauagcggauccucauucaaguguugccacggcaaagaguguagcaguacagguuugcaagcaucugcuccccaucuggacaaggucaaugggauuuccgaguuagaaaacgagaaaguguacgaugacggagccccagaaugcggcguuacguguugguuuaagaaaagcggugagugggugaugggcaucaucaaugggaacuggguaguccucauugugcugugcgugcuucuguuguucucgcucauacugcuaucaauccuguguccgguccgaaagcacaagaaaucuuga

SEQ ID NO: 10202 - RNA, 3402 nt, Artificial Sequence
  derived and/or modified CDS sequence (opt3) from SEOV(HBQ20)__KM233656.1__GP
auguggagccuccuguuccuugccgcucuggugggccagggguuugcauugaagaacgucuucgacaugagaauccaaugcccccacuccguuaauuuuggagagaccucugugucagguuacacagaauuaccuccacugagucuacaggaggccgaacagcucguaccggagagcuccuguaacauggauaaucaucagucucugucgacuauuaacaaacuuacgaaggugauauggaggaaaaaggcgaaucaagaaucagcuaaccagaauagcuucgaggucguggagagugaaguuuccuuuaaaggccugugcauguugaagcaccggaugguggaggaaucuuaucgcaaccgacguagcgucaucuguuacgaccucgccugcaauuccaccuucuguaagcccacaguguauaugauuguaccuauccaugcaugcaacaugaugaaaucaugucugauugggcugggaccauacagaauccagguuguguaugagaggacuuacugcaccacaggcauacucaccgaggguaaguguuuuguccccgauaaagccguggugagugcuuuaaagcgggggauguaugcaaucgccagcauugaaacuaucugcuucuuuauucaccagaaaggaaauacauacaagaucgucaccguuauaacgucugcuaugggcuccaaguguaacaauacugacaccaaagugcaaggcuacuauauuugcaucauugggggaaacucagccccuguauacgcgccagccggugaggauuuccgcgcaauggaaguguuuagcggcaucaucacaaguccccauggggaggaccacgaucugccuggagaagagauugcuacuuaucagauaucuggccagaucgaggccaagauuccacacaccgucuccagcaaaaaucuuaaguugacagcauucgcugguaucccgucguacucuuccaccucaauacuggccgcgagugaagacgggagauuuauuuucagccccggacuauucccuaaccucaaccaguccgugugcgauaauaacgcccugccacuuaucuggaggggccugaucgacuugacgggcuauuacgaggcaguucaucccuguaauguguuuugcguccucucugggccuggagcuagcugugaagccuucucagaggguggcauuuuuaacaucacuucaccaaugugccugguguccaaacaaaaucgguuccgcgcugccgaacagcagauuagcuuuguaugucaacgaguugauauggacauaaucguguauugcaacgggcagaagaaaacaauuuuaaccaagacucuggucaucggacaguguaucuacacaauuaccucucucuucucacuucugcccggcguggcacacaguauagccaucgaguugugcgucccggguuuucaugggugggcuacggcggcacuacugauuaccuucuguuuuggcugggugcucaucccugccugcacacuggcuauucuucugguuuugaaguucuuugccaauauccuccacacuagcaaccaggagaauagauucaaagcaauacugaggaagaucaaagaagaguuugaaaagaccaaaggauccauggugugugagauuugcaaguacgaaugcgagacauuaaaggagcugaaagcccacaaccuaucuuguguacaaggcgaaugccccuauuguuucacucauugcgagccaaccgaaacagcuauccaggcccacuacaaggucugucaggcaacccaucgguuccgugaggaucucaaaaagacugugacgccucagaauauugggcccggaugcuaucgcacacugaaccuuuuuagauacaaaucgagguguuauaucuugaccauguggacucugcuccugauaauugagagcauccuuugggcggcuuccgccgcagaaauuccacugguucccuuguggaccgacaaugcccacggugugggcucagucccuaugcauacagaccucgagcuggauuucaguuuaccaucuagcuccaaguacaccuauaagcggcaccugacuaacccggugaaugaccaacagucaguaagccuacacaucgaaauagagucucaggggaucggagcugaugugcaucaccucggccauugguacgacgcccgacugaaccuuaaaacauccuuucacugcuacggugcauguacgaaguaucaguaccccuggcacaccgcuaaaugccauuucgaaaaggauuaugaguacgagaacaguugggccuguaauccuccagacugccccgggguuggcacuggaugcacagcguguggcuuguaucuggaucaacucaaaccugucgggaccgccuuuaagauuaucagcgugcgcuacucuagaaaggugugcguccaguucggagaagaguaucuguguaaaacaauugacaugaacgauugcuuuguuacuaggcacgcuaagaucuguauaauugguaccguguccaaauucucacagggcgacacguuacuguuucuugggccaauggaaggaggcgguaucaucuucaagcauuggugcaccaguacaugucacuuuggggaucccggcgacgugaugggaccgaaagacaagccuuucauuugcccagaguuucccggccaguuccggaaaaaguguaauuucgcaacuaccccuguaugcgaauacgaugggaacaucauuagcggauacaagaaagucuuggccacaauagacucguuucaauccuucaauacuucuaacauccauuuuaccgaugagcgcauugaguggagagaccccgauggcaugcucagggaccacaucaauauugugaucagcaaggauacggacuucgaaaaccuggcugagaauccauguaaaguuggucuacaggccgcaaacauagaaggggcguggggaucaggcguggguuuuacacugaccugccaggucagucucacugagugcccuacauuccugaccuccaucaaggccugugauauggcuauuugcuauggcgccgaaucugugacucuuagccgugggcaaaauaccguuaaaaucacaggaaagggcgggcacuccggaaguagcuuuaaguguugccauggcaaagaguguaguucuacggguuugcaggcauccgcuccccaccuggacaaggugaacgggauuagcgaguuagaaaaugagaaaguauacgaugacggagccccagaaugcggcgucaccuguugguucaagaaaucgggugagugggugaugggcaucauaaacgggaauugggugguccucauuguucugugcgugcuucuguuguuuucacucauccugcuaucuauccuguguccgguacggaagcauaagaaaaguuga

SEQ ID NO: 10203 - RNA, 3402 nt, Artificial Sequence
  derived and/or modified CDS sequence (opt3) from SEOV(HBQ43)__KM233657.1__GP
auguggagccuccuguuccuugccgcucuggugggccagggggucgcauugaagaacguuuuugacaugagaauccaaugcccccacuccgugaauuucggagagaccucuguaucagguuacacagaauuaccuccacugagucuacaggaggccgaacagcucgugccggagagcuccuguaacauggauaaucaucagucucugucgacuauuaacaaacuuacgaaggucauauggaggaaaaaggcgaaucaagaaucagcuaaccagaauagcuuugaggugguugagagugaaguguccuucaaaggccugugcauguugaagcaccggauggucgaggaaucuuaucgcaaccgacguagcgugaucuguuacgaccucgccugcaauuccaccuuuuguaagcccacaguauauaugauuguuccuauccaugcaugcaacaugaugaaaucaugucugauugggcugggaccauacagaauccagguggucuaugagaggacuuacugcaccacaggcauacucaccgaggguaaguguuucgugcccgauaaagccguggucagugcuuuaaagcgggggauguaugcaaucgccagcauugaaacuaucugcuuuuucauucaccagaaaggaaauacauacaagaucguuaccgcuauaacgucugccaugggcuccaaguguaacaauacugacaccaaagugcaaggcuacuauauuugcaucauugggggaaacucagcgccuguauacgcaccagccggugaggauuuucgcgcuauggaaguguucagcggcaucaucacaaguccccauggggaggaccacgaucugccuggagaagagauugccacuuaucagauaucuggccagaucgaggcaaagauuccacacaccgucuccagcaaaaaucuuaaguugacagcuuuugccgguaucccgucguacucuuccaccucaauacuggcggccagugaagacgggagauucauuuuuagccccggacuauucccuaaccucaaccaguccgugugcgauaauaacgcacugccacuuaucuggaggggccugaucgacuugacgggcuauuacgaggcuguucaucccuguaauguguucugcguccucucugggccuggagccagcugugaagccuuuucagaggguggcauuuucaacaucacuucaccaaugugccugguguccaaacaaaaucgguuucgcgccgcagaacagcagauuagcuucguaugucaacgaguugauauggacauaaucguguauugcaacgggcagaagaaaacaauuuuaaccaagacucuggucaucggacaguguaucuacacaauuaccucucucuuuucacuucugcccggcguggcccacaguauagcuaucgaguugugcgucccggguuuccaugggugggcgacggcagcccuacugauuaccuuuuguuucggcugggugcucaucccugcuugcacacuggccauucuucugguuuugaaguuuuucgcaaauauccuccacacuagcaaccaggagaauagauuuaaagccauacugaggaagaucaaagaagaguucgaaaagaccaaaggauccauggugugugagauuugcaaguacgaaugcgagacauuaaaggagcugaaagcucacaaccuaucuuguguacaaggcgaaugccccuauuguuuuacucauugcgagccaaccgaaacagccauccaggcacacuacaaggucugucaggcgacccaucgguuccgugaggaucucaaaaagacugugacgccucagaauauugggcccggaugcuaucgcacacugaaccuuuucagauacaaaucgagguguuauaucuugaccauguggacucugcuccugauaauugagagcauccuuugggcugccuccgcagccgaaauuccacugguucccuuguggaccgacaaugcucacggugugggcucagucccuaugcauacagaccucgagcuggauuuuaguuuaccaucuagcuccaaguacaccuauaagcggcaccugacuaacccggugaaugaccaacagucaguaagccuacacaucgaaauagagucucaggggaucggagccgaugugcaucaccucggccauugguacgacgcacgacugaaccuuaaaacauccuuccacugcuacggugcuuguacgaaguaucaguaccccuggcacaccgccaaaugccauuuugaaaaggauuaugaguacgagaacaguugggcguguaauccuccagacugccccgggguuggcacuggaugcacagccuguggcuuguaucuggaucaacucaaaccugucgggaccgcuuucaagauuaucagcgugcgcuacucuagaaaggugugcguccaguuuggagaagaguaucuguguaaaacaauugacaugaacgauugcuucguuacuaggcacgcaaagaucuguauaauugguaccguguccaaauuuucacagggcgacacguuacuguuccuugggccaauggaaggaggcgguaucaucuuuaagcauuggugcaccaguacaugucacuucggggaucccggcgacgugaugggaccgaaagacaagccuuuuauuugcccagaguuccccggccaguuucggaaaaaguguaauuucgccacuaccccuguaugcgaauacgaugggaacaucauuagcggauacaagaaagucuuggcuacaauagacucguuccaauccuuuaauacuucuaacauccauuucaccgaugagcgcauugaguggagagaccccgauggcaugcucagggaccacaucaauauugugaucagcaaggauauagacuuugaaaaccuggccgagaauccauguaaaguuggucuacaggcagcgaacaucgaaggggccuggggaucaggcguggguuucacgcugacaugccaggucagucucaccgagugcccuacuuuucugacauccauuaaggcuugugauauggccaucugcuauggcgcagaaucugugacccuuagccgugggcaaaauacuguuaaaauuaccggaaagggcgggcacuccggaaguagcuucaaguguugccauggcaaagaguguaguucuacagguuugcaggcuuccgcuccccaccuggacaaggugaacggguuuagcgaguuagaaaaugagaaaguauacgaugacggagcaccagaaugcggcgucacguguugguucaagaaaucgggugagugggugaugggcaucauaaacgggaauugggugguccucauuguucugugcauccuucuguuguuuucacucauccugcuaucuauucuguguccggugcggaagcauaagaaaaguuga

SEQ ID NO: 10204 - RNA, 3402 nt, Artificial Sequence
  derived and/or modified CDS sequence (opt3) from SEOV(HBQ5)__KM233653.1__GP
auguggagccugcucuuucuugccgcucuggugggccagggguuugcauugaagaacgucuucgacaugagaauccaaugcccccacuccguuaauuuuggagagaccucugugucagguuacacagaauuaccuccacugagucuacaggaggccgaacagcucguaccggagagcuccuguaacauggauaaucaucagucucugucgacuauuaacaaacuuacgaaggugauauggaggaaaaaggcgaaucaagaaucagcuaaccagaauagcuucgaggucguggagagugaaguuuccuuuaaaggccugugcauguugaagcaccggaugguggaggaaucuuaucgcaaccgacguagcgucaucuguuacgaccucgccugcaauuccaccuucuguaagcccacaguguauaugauuguaccuauccaugcaugcaacaugaugaaaucaugucugauugggcugggaccauacagaauccagguuguguaugagaggacuuacugcaccacaggcauacucaccgaggguaaguguuuuguccccgauaaagccguggugagugcuuuaaagcgggggauguaugcaaucgccagcauugaaacuaucugcuucuuuauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuccgcgcuauggaaguauuuagcggcaucaucacaaguccccauggggaggaccacgaucugccuggagaagagauugccacuuaucagauaucuggccagaucgaggcaaagauuccacacaccguguccagcaaaaaucuuaaguugacagcuuucgccgguaucccgucguacucuuccaccucaauacuggcggccagugaagacgggagauuuauuuucagccccggacuauucccuaaccucaaccaguccgucugcgauaauaacgcacugccacuuaucuggaggggccugaucgacuugacgggcuauuacgaggcugugcaucccuguaauguuuucugcgugcucucugggccuggagccagcugugaagccuucucagaggguggcauuuuuaacaucacuucaccaaugugccuggucuccaaacaaaaucgguuccgcgccgcagaacagcagauuagcuuugugugucaacgaguagauauggacauaaucguuuauugcaacgggcagaagaaaacaauuuuaaccaagacucuggugaucggacaguguaucuacacaauuaccucucucuucucacuucugcccggcgucgcccacaguauagcuaucgaguugugcgugccggguuuucaugggugggcgacggcagcccuacugauuaccuucuguuuuggcuggguccucaucccugcuugcacacuggccauucuucugguguugaaguucuuugcaaauauccuccacacuagcaaccaggagaauagauucaaagccauacugaggaagaucaaagaagaguuugaaaagaccaaaggauccaugguuugugagauuugcaaguacgaaugcgagacauuaaaggagcugaaagcucacaaccuaucuugugugcaaggcgaaugccccuauuguuucacucauugcgagccaaccgaaacagccauccaggcacacuacaagguaugucaggcgacccaucgguuccgugaggaucucaaaaagacugucacgccucagaauauugggcccggaugcuaucgcacacugaaccuuuuuagauacaaaucgagguguuauaucuugaccauguggacucugcuccugauaauugagagcauccuuugggcugccuccgcagccgaaauuccacuggugcccuuguggaccgacaaugcucacgguguuggcucagugccuaugcauacagaccucgagcuggauuucaguuuaccaucuagcuccaaguacaccuauaagcggcaccugacuaacccggucaaugaccaacagucagugagccuacacaucgaaauagagucucaggggaucggagccgauguacaucaccucggccauugguacgacgcacgacugaaccuuaaaacauccuuucacugcuacggugcuuguacgaaguaucaguaccccuggcacaccgccaaaugccauuucgaaaaggauuaugaguacgagaacaguugggcguguaauccuccagacugccccggggugggcacuggaugcacagccuguggcuuguaucuggaucaacucaaaccuguugggaccgcuuuuaagauuaucagcguccgcuacucuagaaaggugugcgugcaguucggagaagaguaucuguguaaaacaauugacaugaacgauugcuuugucacuaggcacgcaaagaucuguauaauugguaccguuuccaaauucucacagggcgacacguuacuguuucuugggccaauggaaggaggcgguaucaucuucaagcauuggugcaccaguacaugucacuuuggggaucccggcgacgugaugggaccgaaagacaagccuuucauuugcccagaguuucccggccaguuccggaaaaaguguaauuucgccacuaccccugugugcgaauacgaugggaacaucauuagcggauacaagaaaguauuggcuacaauagacucguuucaauccuucaauacuucuaacauccauuuuaccgaugagcgcauugaguggagagaccccgauggcaugcucagggaccacaucaauauugucaucagcaaggauauagacuucgaaaaccuggccgagaauccauguaaagugggucuacaggcagcgaacaucgaaggggccuggggaucaggcguugguuuuacgcugacaugccaggugagucucaccgagugcccuacuuuccugacauccauuaaggcuugugauauggccaucugcuauggcgcagaaucugucacccuuagccgugggcaaaauacugugaaaauuaccggaaagggcgggcacuccggaaguagcuuuaaguguugccauggcaaagaguguaguucuacagguuugcaggcuuccgcuccccaccuggacaagguuaacgggaucagcgaguuagaaaaugagaaaguguacgaugacggagcaccagaaugcggcguaacguguugguucaagaaaucgggugagugggucaugggcauaauuaacgggaauuggguggugcucaucguccugugcguucuucuguuguuuucacucauccugcuaucuauucuguguccggugcggaagcauaagaaaaguuga

SEQ ID NO: 10205 - RNA, 3402 nt, Artificial Sequence
  derived and/or modified CDS sequence (opt3) from SEOV(HBT14)__KM233658.1__GP
auguggagccugcucuuucuugccgcucuggugggccagggguuugcauugaagaacgucuucgacaugagaauccaaugcccccacuccguuaauuuuggagagaccucugugucagguuacacaggcuuaccuccacugagucuacaggaagccgagcagcucguaccggaaagcuccuguaacauggauaaucaucagucucugucgauuauaaacaaacuuacuaaggugaucuggaggaaaaaggcgaaucaagagucagcuaaccagaauagcuucgaagucguggagagugagguuuccuuuaaagggcugugcauguugaagcaccggaugguggaagagucuuaucgcaaccgacguagcgucauuuguuacgaccucgccugcaauuccacguucuguaagcccaccguguauaugaucguaccuauucaugcaugcaacaugaugaaaucaugucugaucggacugggcccauacagaauacagguuguguaugaaaggacauacugcacuaccgguauccucacagaggggaaguguuuuguccccgauaaagccguggugagugcuuuaaagcggggaauguaugcaauugccagcaucgagaccauuugcuucuuuauccaccagaaaggcaauacuuacaagauagucacagcuauuaccucugccaugggcuccaaguguaacaauacggacacuaaaguucaaggguacuauaucugcauuaucggagguaacucagcgccuguguacgcaccagccggcgaagauuuccgcgcuauggagguauuuagcgggaucauuaccaguccccauggagaagaccacgaucugccuggcgaggaaauagccacauaucagaucucuggucagauugaggcaaagaucccacacacuguguccagcaaaaaucuuaaguugaccgcuuucgccgggauaccgucguacucuuccacaucaauucuggcggccagugaggacggaagauuuaucuucagccccggccuauucccuaaccucaaccaguccgucugcgauaauaacgcacugccacuuaucuggaggggccugauugacuugaccggguauuacgaagcugugcaucccuguaauguuuucugcgugcucucuggaccuggugccagcugugaggcuuucucagaaggcgggaucuuuaacauuacgaguccaaugugccuggucuccaaacaaaaucgguuccgcgccgcagagcagcagauaucauuugugugucaacgaguagauauggacaucauuguuuauugcaacggacagaagaaaacuaucuuaacaaagacccuggugaucggccaguguauuuacacuauaacaucucucuucucacuucugcccggugucgcccacaguaucgcuauugaauugugcgugccgggguuucauggcugggcgaccgcagcccuacugaucacguucuguuuuggauggguccucauuccugcuugcacccuggccauccuucugguguugaaguucuuugcaaauauacuccacacaagcaaccaggagaauagauucaaagccauccugaggaagauuaaagaggaauuugagaagacuaaaggcuccaugguuugugaaaucugcaaguacgagugcgaaaccuuaaaggagcugaaagcucacaaccuaucuugugugcaaggggagugccccuauuguuucacacauugcgaaccaacugagaccgccauucaggcacacuacaagguaugucaggcgacacaucgguuccgugaagaucucaaaaagaccgucacuccucagaauaucggacccgguugcuaucgcacgcugaaccuuuuuagauacaaaucgagguguuauauauugacaauguggacccugcuccugauuaucgagagcauucuuugggcugccuccgcagccgagaucccacuggugcccuuguggacugacaaugcucacggcguugggucagugccuaugcauaccgaccucgaacuggauuucaguuuaccaucuagcuccaaguacacauauaagcggcaccugaccaacccggucaaugaccaacagucagugagccuacacauagagaucgaaucucagggaauuggcgccgauguacaucaccucggucauugguacgacgcacgacugaaccuuaaaacuuccuuucacugcuacggggcuuguacaaaguaucaguaccccuggcacacggccaaaugccauuucgagaaggauuaugaauacgagaacaguugggcguguaauccuccagacugccccggcgugggaaccggcugcacugccuguggguuguaucuggaucaacucaaaccuguuggaacagcuuuuaagaucauuagcguccgcuacucuagaaaggugugcgugcaguucggugaggaauaucuguguaaaaccaucgacaugaacgauugcuuugucacaaggcacgcaaagauauguauuaucggcacuguuuccaaauucucacagggggacaccuuacuguuucuuggaccaauggagggcggugggaucauuuucaagcauuggugcacgaguaccugucacuuuggcgaucccggagacgugaugggcccgaaagacaagccuuucaucugcccagaauuucccgggcaguuccggaaaaaguguaauuucgccacaacuccugugugcgaguacgauggaaacauuauaagcggcuacaagaaaguauuggcuaccaucgacucguuucaauccuucaauacaucuaacauucauuuuacugaugaacgcaucgaguggagagaccccgaugguaugcucagggaccacauuaauaucgucauaagcaaggauaucgacuucgagaaccuggccgaaaauccauguaaaguggggcuacaggcagcgaacauugagggagccuggggcucagguguuggcuuuacccugacgugccaggugagucucacagaaugcccuaccuuccugacuuccaucaaggcuugugauauggccauuugcuauggggcagagucugucacacuuagccguggacaaaauaccgugaaaaucacuggcaaagggggacacuccggcagcagcuuuaaguguugccaugguaaggaauguaguucuaccggguugcaggcuuccgcaccccaccuggacaagguuaacggaauaagcgaguuagagaaugaaaaaguguacgaugacggcgccccagagugcgguguaacauguugguucaagaaaucgggcgaaugggucauggggauuaucaacggaaauuggguggugcucaucguccugugcguucuucuguuguuuucacucauucugcuaucuauacuguguccggugcggaagcauaagaaaaguuga

SEQ ID NO: 10206 - RNA, 3402 nt, Artificial Sequence
  derived and/or modified CDS sequence (opt3) from SEOV(HBT-3)__KM233661.1__GP
auguggagccuacucuuccuugccgcucuggugggccagggguuugcauugaagaacgucuucgacaugagaauccaaugcccccacuccguuaauuuuggagagaccucugugucagguuacacagaauuaccuccacugagucuacaggaggccgaacagcucguaccggagagcuccuguaacauggauaaucaucagucucugucgacuauuaacaaacuuacgaaggugauauggaggaaaaaggcgaaucaagaaucagcuaaccagaauagcuucgaggucguggagagugaaguuuccuuuaaaggccugugcauguugaagcaccggaugguggaggaaucuuaucgcaaccgacguagcgucaucuguuacgaccuccccugcaauuccaccuucuguaagccuacaguguauaugauuguaccaauccaugccugcaacaugaugaaaucaugucugauugggcugggacccuacagaauccagguuguguaugagaggacuuacugcaccacaggcauacucaccgaggguaaguguuuugucccugauaaagcaguggugagugccuuaaagcgggggauguaugcuaucgcaagcauugaaacuaucugcuucuuuauucaccagaaaggaaauacauacaagaucgucaccgccauaacgucugcuaugggcuccaaguguaacaauacugacaccaaaguucaaggcuacuauauuugcaucauugggggaaacucagccccaguguacgcgcccgccggugaggauuuccgcgcaauggaaguauuuagcggcaucaucacaaguccucauggggaggaccacgaucugccaggagaagagauugcuacuuaucagauaucuggccagaucgaggccaagauuccgcacaccguguccagcaaaaaucuuaaguugacagcauucgcugguauccccucguacucuuccaccucaauacuggccgcgagugaagacgggagauuuauuuucagcccuggacuauucccaaaccucaaccaguccgucugcgauaauaacgcccugccccuuaucuggaggggccugaucgacuugacgggcuauuacgaggcagugcauccuuguaauguguuuugcguucucucugggccaggagcuagcugugaagccuucucagaggguggcauuuuuaacaucacuucacccaugugccuggucuccaaacaaaaucgguuccgcgcugccgaacagcagauuagcuuugugugucaacgaguagauauggacauaaucguuuauugcaacgggcagaagaaaacaauuuuaaccaagacucuggugaucggacaguguaucuacacaauuaccucucucuucucacuucugccgggcgucgcacacaguauagccaucgaguugugcgugccugguuuucaugggugggcuacggcggcacuacugauuaccuucuguuuuggcuggguccucauccccgccugcacacuggcuauucuucugguguugaaguucuuugccaauauccuccacacuagcaaccaggagaauagauucaaagcaauacugaggaagaucaaagaagaguuugaaaagaccaaaggauccaugguuugugagauuugcaaguacgaaugcgagacauucaaggaguuaaaagcccacaaccugucuugugugcaaggcgaaugcccauauuguuucacucauugcgagccuaccgaaacagcuauccaggcccacuacaagguaugucaggcaacccaucgguuucgugaggaucugaaaaagacugucacgccccagaauauugggccaggaugcuaucgcacacucaaccuguucagauacaaaucgagguguuauauccuuaccauguggacuuugcugcucauaauugagagcauccugugggcggcuuccgccgcagaaauuccccuugugccucuguggaccgacaaugcccacgguguuggcucagugccaaugcauacagacuuggagcucgauuuuagucugccgucuagcuccaaguacaccuauaagcggcacuuaacuaaccccgucaaugaccaacagucagugagccugcacaucgaaauagagucucaggggaucggagcugauguacaucaccuaggccauugguacgacgcccgacucaaccugaaaacauccuuccacugcuacggugcauguacgaaguaucaguacccuuggcacaccgcuaaaugccauuuugaaaaggauuaugaguacgagaacaguugggccuguaauccacccgacugcccuggggugggcacuggaugcacagcguguggccuuuauuuggaucaacugaaaccaguugggaccgccuucaagauuaucagcguccgcuacucuagaaaggugugcgugcaguuuggagaagaguaucucuguaaaacaauugacaugaacgauugcuucgucacuaggcacgcuaagaucuguauaauugguaccguuuccaaauuuucacagggcgacacgcuguuauuccuggggcccauggaaggaggcgguaucaucuuuaagcauuggugcaccaguacaugucacuucggggauccgggcgacgugaugggaccuaaagacaagccauuuauuugccccgaguucccuggccaguuccggaaaaaguguaauuuugcaacuacccccgugugcgaauacgaugggaacaucauuagcggauacaagaaaguacuugccacaauagacucguuccaauccuuuaauacuucuaacauccauuucaccgaugagcgcauugaguggagagacccagauggcauguugagggaccacaucaauauugucaucagcaaggauauagacuuugaaaaccucgcugagaauccuuguaaagugggucugcaggccgcaaacaucgaaggggcguggggaucaggcguugguuucacgcuaacaugccaggugagucugaccgagugccccacuuuucucacauccauuaaggccugugauauggcuaucugcuauggcgccgaaucugucacccugagccgugggcaaaauacugugaaaauuaccggaaagggcgggcacuccggaaguagcuucaaguguugccauggcaaagaguguaguucuacaggucuucaggcauccgcuccacacuuggacaagguuaacgggaucagcgagcuggaaaaugagaaaguguacgaugacggagccccggaaugcggcguaacguguugguuuaagaaaucgggugagugggucaugggcauaauuaacgggaauugggugguguuaaucguccucugcguucugcuucuguucucauugauccuccugucuauucuauguccugugcggaagcauaagaaaaguuga

SEQ ID NO: 10207 - RNA, 3402 nt, Artificial Sequence
  derived and/or modified CDS sequence (opt3) from SEOV(HBT49)__KM233659.1__GP
auguggagccugcucuuucuugccgcucuggugggccagggguuugcauugaagaacgucuucgacaugagaauccaaugcccccacuccguuaauuuuggagagaccucugugucagguuacacagaauuaccuccacugagucuacaggaggccgaacagcucguaccggagagcuccuguaacauggauaaucaucagucucugucgacuauuaacaaacuuacgaaggugauauggaggaaaaaggcgaaucaagaaucagcuaaccagaauagcuucgaggucguggagagugaaguuuccuuuaaaggccugugcauguugaagcaccggaugguggaggaaucuuaucgcaaccgacguagcgucaucuguuacgaccucgccugcaauuccaccuucuguaagcccacaguguauaugauuguaccuauccaugcaugcaacaugaugaaaucaugucugauugggcugggaccauacagaauccagguuguguaugagaggacuuacugcaccacaggcauacucaccgaggguaaguguuuuguccccgauaaagccguggugagugcuuuaaagcgggggauguaugcaaucgccagcauugaaacuaucugcuucuuuauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuccgcgcuauggaaguauuuagcggcaucaucacaaguccccauggggaggaccacgaucugccuggagaagagauugccacuuaucagauaucuggccagaucgaggcaaagauuccacacaccguguccagcaaaaaucuuaaguugacagcuuucgccgguaucccgucguacucuuccaccucaauacuggcggccagugaagacgggagauuuauuuucagccccggacuauucccuaaccucaaccaguccgucugcgauaauaacgcacugccacuuaucuggaggggccugaucgacuugacgggcuauuacgaggcugugcaucccuguaauguuuucugcgugcucucugggccuggagccagcugugaagccuucucagaggguggcauuuuuaacaucacuucaccaaugugccuggucuccaaacaaaaucgguuccgcgccgcagaacagcagauuagcuuugugugucaacgaguagauauggacauaaucguuuauugcaacgggcagaagaaaacaauuuuaaccaagacucuggugaucggacaguguaucuacacaauuaccucucucuucucacuucugcccggcgucgcccacaguauagcuaucgaguugugcgugccggguuuucaugggugggcgacggcagcccuacugauuaccuucuguuuuggcuggguccucaucccugcuugcacacuggccauucuucugguguugaaguucuuugcaaauauccuccacacuagcaaccaggagaauagauucaaagccauacugaggaagaucaaagaagaguuugaaaagaccaaaggauccaugguuugugagauuugcaaguacgaaugcgagacauuaaaggagcugaaagcucacaaccuaucuugugugcaaggcgaaugccccuauuguuucacucauugcgagccaaccgaaacagccauccaggcacacuacaagguaugucaggcgacccaucgguuccgugaggaucucaaaaagacugucacgccucagaauauugggcccggaugcuaucgcacacugaaccuuuuuagauacaaaucgagguguuauaucuugaccauguggacucugcuccugauaauugagagcauccuuugggcugccuccgcagccgaaauuccacuggugcccuuguggaccgacaaugcucacgguguuggcucagugccuaugcauacagaccucgagcuggauuucaguuuaccaucuagcuccaaguacaccuauaagcggcaccugacuaacccggucaaugaccaacagucagugagccuacacaucgaaauagagucucaggggaucggagccgauguauaccaucucggccacugguacgacgcacgacugaaccuuaaaacauccuuucauugcuauggugcuuguacgaaguaccaguaucccuggcacaccgccaaaugccacuucgaaaaggauuacgaguaugagaacaguugggcguguaauccuccagacugccccggggugggcacuggaugcacagccuguggcuuguaccuggaucaacucaaaccuguugggaccgcuuuuaagauuaucagcguccgcuauucuagaaaggugugcgugcaguucggagaagaguaccuguguaaaacaauugacaugaacgauugcuuugucacuaggcaugcaaagaucuguauaauugguaccguuuccaaauucucacagggcgacacguuacuguuucuugggccaauggaaggaggcgguaucaucuucaagcacuggugcaccaguacaugucauuuuggggaucccggcgacgugaugggaccgaaagacaagccuuucauuugcccagaguuucccggccaguuccggaaaaaguguaauuucgccacuaccccugugugcgaauacgaugggaacaucauuagcggauauaagaaaguauuggcuacaauagacucguuucaauccuucaauacuucuaacauccacuuuaccgaugagcgcauugaguggagagaccccgauggcaugcucagggaccauaucaauauugucaucagcaaggauauagacuucgaaaaccuggccgagaauccauguaaagugggucuacaggcagcgaacaucgaaggggccuggggaucaggcguugguuuuacgcugacaugccaggugagucucaccgagugcccuacuuuccugacauccauuaaggcuugugauauggccaucugcuacggcgcagaaucugucacccuuagccgugggcaaaauacugugaaaauuaccggaaagggcgggcacuccggaaguagcuuuaaguguugccacggcaaagaguguaguucuacagguuugcaggcuuccgcuccccaucuggacaagguuaacgggaucagcgaguuagaaaaugagaaaguguaugaugacggagcaccagaaugcggcguaacguguugguucaagaaaucgggugagugggucaugggcauaauuaacgggaauuggguggugcucaucguccugugcguucuucuguuguuuucacucauccugcuaucuauucuguguccggugcggaagcacaagaaaaguuga

SEQ ID NO: 10208 - RNA, 3402 nt, Artificial Sequence
  derived and/or modified CDS sequence (opt3) from SEOV(HBT50)__KM233660.1__GP
auguggagccugcucuuucuugccgcucuggugggccagggguuugcauugaagaacgucuucgacaugagaauccaaugcccccacuccguuaauuuuggagagaccucugugucagguuacacagaauuaccuccacugagucuacaggaggccgaacagcucguaccggagagcuccuguaacauggauaaucaucagucucugucgacuauuaacaaacuuacgaaggugauauggaggaaaaaggcgaaucaagaaucagcuaaccagaauagcuucgaggucguggagagugaaguuuccuuuaaaggccugugcauguugaagcaccggaugguggaggaaucuuaucgcaaccgacguagcgucaucuguuacgaccucgccugcaauuccaccuucuguaagcccacaguguauaugauuguaccuauccaugcaugcaacaugaugaaaucaugucugauugggcugggaccauacagaauccagguuguguaugagaggacuuacugcaccacaggcauacucaccgaggguaaguguuuuguccccgauaaagccguggugagugcuuuaaagcgggggauguaugcaaucgccagcauugaaacuaucugcuucuuuauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuccgcgcuauggaaguauuuagcggcaucaucacaaguccccauggggaggaccacgaucugccuggagaagagauugccacuuaucagauaucuggccagaucgaggcaaagauuccacacaccguguccagcaaaaaucuuaaguugacagcuuucgccgguaucccgucguacucuuccaccucaauacuggcggccagugaagacgggagauuuauuuucagccccggacuauucccuaaccucaaccaguccgucugcgauaauaacgcacugccacuuaucuggaggggccugaucgacuugacgggcuauuacgaggcugugcaucccuguaauguuuucugcgugcucucugggccuggagccagcugugaagccuucucagaggguggcauuuuuaacaucacuucaccaaugugccuggucuccaaacaaaaucgguuccgcgccgcagaacagcagauuagcuuugugugucaacgaguagauauggacauaaucguuuauugcaacgggcagaagaaaacaauuuuaaccaagacucuggugaucggacaguguaucuacacaauuaccucucucuucucacuucugcccggcgucgcccacaguauagcuaucgaguugugcgugccggguuuucaugggugggcgacggcagcccuacugauuaccuucuguuuuggcuggguccucaucccugcuugcacacuggccauucuucugguguugaaguucuuugcaaauauccuccacacuagcaaccaggagaauagauucaaagccauacugaggaagaucaaagaagaguuugaaaagaccaaaggauccaugguuugugagauuugcaaguacgaaugcgagacauuaaaggagcugaaagcucacaaccuaucuugugugcaaggcgaaugccccuauuguuucacucauugcgagccaaccgaaacagccauccaggcacacuacaagguaugucaggcgacccaucgguuccgugaggaucucaaaaagacugucacgccucagaauauugggcccggaugcuaucgcacacugaaccuuuuuagauacaaaucgagguguuauaucuugaccauguggacucugcuccugauaauugagagcauccuuugggcugccuccgcagccgaaauuccacuggugcccuuguggaccgacaaugcucacgguguuggcucagugccuaugcauacagaccucgagcuggauuucaguuuaccaucuagcuccaaguacaccuauaagcggcaccugacuaacccggucaaugaccaacagucagugagccuacacaucgaaauagagucucaggggaucggagccgauguacaucaccucggccauugguacgacgcacgacugaaccuuaaaacauccuuucacugcuacggugcuuguacgaaguaucaguaccccuggcacaccgccaaaugccauuucgaaaaggauuaugaguacgagaacaguugggcguguaauccuccagacugccccggggugggcacuggaugcacagccuguggcuuguaucuggaucaacucaaaccuguugggaccgcuuuuaagauuaucagcguccgcuacucuagaaaggugugcgugcaguucggagaagaguaucuguguaaaacaauugacaugaacgauugcuuugucacuaggcacgcaaagaucuguauaauugguaccguuuccaaauucucacagggcgacacguuacuguuucuugggccaauggaaggaggcgguaucaucuuccggcauuggugcaccaguacaugucacuuuggggaucccggcgacgugaugggaccgaaggacaaaccuuucauuugcccagaguuucccggccaguuccgcaagaaauguaauuucgccacuaccccugugugcgaauacgaugggaacaucauuagcggauacaagaagguauuggcuacaauagacucguuucaauccuucaauacuucuaacauccauuuuaccgaugagagaauugaguggagggaccccgauggcaugcuccgugaccacaucaauauugucaucagcaaagauauagacuucgaaaaccuggccgagaauccauguaaggugggucuacaggcagcgaacaucgaaggggccuggggaucaggcguugguuuuacgcugacaugccaggugagucucaccgagugcccuacuuuccugacauccauuaaggcuugugauauggccaucugcuauggcgcagaaucugucacccuuagccgggggcaaaauacugugaaaauuaccggaaaaggcgggcacuccggaaguagcuuuaaguguugccauggcaaggaguguaguucuacagguuugcaggcuuccgcuccccaccuggacaaaguuaacgggaucagcgaguuagaaaaugagaagguguacgaugacggagcaccagaaugcggcguaacguguugguucaaaaagucgggugagugggucaugggcauaauuaacgggaauuggguggugcucaucguccugugcguucuucuguuguuuucacucauccugcuaucuauucuguguccggugcgaaaacauaagaagaguuga

SEQ ID NO: 10209 - RNA, 3402 nt, Artificial Sequence
  derived and/or modified CDS sequence (opt3) from SEOV(HuludaoRn101)__GU592923.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaagguggucuggaggaaaaaggcgaaucaagaaucagcuaaccagaauagcuuugaggugguugagagugaaguguccuucaaaggcuugugcaugcucaagcaccggauggucgaggaaucuuaucgcaaccgacguagcgugauauguuacgaccuggccugcaauuccaccuuuuguaagcccacaguauauaugaucguuccuauucaugcaugcaacaugaugaaaucaugucugaucgggcucggaccauacaggauucagguggucuaugagagaacuuacugcaccacaggcaucuuaaccgaggguaaguguuucgugcccgauaaagccguggucagugcucugaagcgggggauguaugcaauagccagcaucgaaacuauuugcuuuuucauccaccagaaaggaaauacauacaagauuguuaccgcuaucacgucugccaugggcuccaaguguaacaauacugacaccaaagugcaaggcuacuauauaugcauuaucgggggaaacucagcgccuguauacgcaccagccggugaggauuuucgcgcuauggaaguguucagcggcauuaucacaaguccccauggggaggaccacgaucuuccuggagaagagaucgccacuuaucagauuucuggccagauagaggcaaagaucccacacaccgucuccagcaaaaauuugaagcugauugcuuuugccgguaucccgucguacucuuccacaucaauacuagcggccagugaagacagcagauucauuuuuagccccggguuguucccuaaccugaaccagucugugugcgauaauaacgcacuuccacugaucuggaggggauugaucgaccucaccggcuauuacgagacgguucaucccuguaauguguucugcguccugagcggcccuggggcuucaugugaagccuuuagugagggagguauuuucaacaucacuuccccaaugugcuuagugagcaaacaaaaucgguuucgcgcugccgaacagcagauuucuuucauaugucaacgaguagauauggacaucauuguuuauugcaacggccagaagaaaacaauccugaccaagacucucgugaucgggcaguguauuuacacaauaaccucacuuuuuagucuguugcccggagucgcacacagcaucgccauugagcuaugcgugccgggcuuccaugguugggcuacggcggcacugcucaucaccuuuuguuucggguggguccugauuccugccugcacacuugcuauccuguuggugcucaaguuuuucgccaauauacugcacacuuccaaccaggagaauagauuuaaagcaaucuuaaggaagauuaaagaagaguucgaaaagaccaaaggcucuaugguuugugagaucugcaaguacgaaugcgagacacugaaggagcuaaaagcccacaaccucucgugugugcaaggagaaugccccuauuguuuuacucauugcgagccaaccgaaacagcuauucaggcccacuacaagguaugucaggcaacccaucgguuccgugaggaucugaaaaagacugucacgccucagaauaucggccccgggugcuaucgcacacuuaacuuguucagauacaaauccagguguuauauacugaccauguggacucuccugcuuauuaucgaguccauucugugggcggcuucagccgcagaaaucccauuggugccccucuggaccgacaaugcccacggaguugguaguauaccuaugcauacagaccuggaguuagauuuuucucugccaagcuccucaaaguacaccuauaagcggcaccuaacuaacccggugaaugaccaacagagcgucucucuccacaucgaaauugagucccagggcaucggggcugaugugcaucaccugggacauugguacgacgcccgacuuaacuugaaaacaaguuuccacugcuacggcgcauguacgaaguaucaguaccccuggcacaccgcuaaaugccauuuugaaaaggauuaugaguacgagaacagcugggccuguaauccuccagacugccccgguguagggacuggcugcacagcguguggacuguaucucgaucaacugaaaccugugggcaccgccuucaagauuaucucuguucgcuacuccagaaaggucugcgugcaguuuggggaagaguauuuauguaaaacaauagacaugaacgauugcuucgugacuaggcacgcuaagauuuguaucaucggaaccgucucaaaauuuagucagggugacacgcugcuuuucuugggcccaauggaagggggaggcauuaucuuuaagcauuggugcaccagcacaugucacuucggugaucccggggacguuaugggcccgaaagacaagccuuuuauuugcccagaguuccccggacaguuucggaaaaaguguaauuucgcaacuaccccuauaugcgaauacgauggcaacaucauuucgggguacaagaaagugcucgccacaaucgacuccuuccaaucuuuuaauacuagcaacauucauuucaccgaugagcgcaucgaguggagagaccccgauggaaugcugagggaccacauaaaugugguaaucucaaaggauauugacuuugaaaaccuagcugagaauccauguaaagucggccugcaggccgcaaacaucgaaggugcgugggggaguggagugggcuucacgcucacaugccagguuucccugaccgagugcccuacuuuucuuacaucuauuaaggccugugauauggcuaucugcuauggugccgaaagcgugaccuugucccguggccaaaauacuguccggauaaccgggaaaggaggccacucagggagcaguuucaaguguugccauggaaaggaguguucuuccacaggccugcaggcaagcgcuccccacuuagacaaagugaacgguauuucggagcucgaaaaugagaagguuuacgaugacggggccccagaaugcggagugacguguugguuuaaaaagucaggcgaguggguaauggguaucaucaacggcaauugggucgugcugauugugcuuugcguccugcuccucuucucucugauacuacugaguauccucuguccgguucgaaaacauaagaaguccuga

SEQ ID NO: 10210 - RNA, 3402 nt, Artificial Sequence
  derived and/or modified CDS sequence (opt3) from SEOV(Humber)__JX879768.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucguggagagugaaguuuccuucaaaggcuugugcaugcucaagcaccggaugguggaggaaucuuaucgcaaccgacguagcgucaucuguuacgaccuggccugcaauuccaccuuuuguaagcccacaguguauaugauuguaccuauccaugcaugcaacaugaugaaaucaugucugauugggcucggaccauacagaauccagguuguguaugagaggacuuacugcaccacaggcauauuaaccgaggguaaguguuucguccccgauaaagccguggugagugcucugaagcgggggauguaugcaaucgccagcauugaaacuaucugcuuuuucguccaccagaaaggaaauacauacaagauuguuaccgcuaucacgucugccaugggcuccaaguguaacaauacugacaccaaagugcaaggcuacuauauaugcauuaucgggggaaacucagcgccuguauacagcccagccggugaggauuuucgcgcaauggaaguguucaguggcauuaucacaucuccccauggggaggaccacgaucuuccuggagaagagaucgcuacuuaucagauuuccggccagauagaggccaagaucccacacaccgucagcucgaaaaauuugaagcugacagcauuugcugguauuccgucuuacuccucaaccaguauccuagccgcgagcgaagacgggagauucauauuuucccccggacucuucccuaaccugaaccagucugugugcgauaauaacgcccuuccacugauuuggaggggcuugaucgaccucacgggcuauuacgaggcaguucaucccuguaauguguucugcguccugagcgggccuggagcuucaugugaagccuuuagugaggguggcaucuucaacauuacuuccccaaugugcuuagugagcaaacaaaaucgguuucgcgcugccgaacagcagaucucuuucauuugucaacgaguagauauggacauaaucguuuauugcaacgggcagaagaaaacaauucugaccaagacucucgugaucggacaguguaucuacacaauuaccucacuuuuuagucuguugcccggcgucgcacacagcauagccaucgagcuaugcgugccggguuuccaugggugggcuacggcggcacugcucauuaccuuuuguuucggcuggguccugaucccugccugcacacuugcugugcuguugguucucaaguuuuucgccaauauucugcacacuuccaaccaggagaauagauuuaaagcaaucuuaaggaagauaaaagaagaguucgaaaagaccaaaggaucuauggugugugagaucugcaaguacgaaugcgagacacugaaggagcuaaaagcccacaaccucucguguauucaaggcgaaugccccuauuguuuuacucauugcgagccaaccgaaacagcuauccaggcccacuacaagguaugucaggcaacccaucgguuccgugaggaucugaaaaagacugucacgccucccaauauugggccaggaugcuaucgcacacuuaacuuguucagauacaaauccagguguuauauccugaccauguggacucuccugcuuauaauugagagcauccugugggcggcuucagccgcagaaauucccuuggugccucucuggaccgacaaugcccacgguguuggcagugugccaaugcauacagaccuggaguuagauuuuucucugccgagcuccucaaaguacaccuauaagcggcaccuaacuaaccccgucaaugaccagcaaagcgugucucuccacaucgaaauagagucccaggggaucggagcugauguacaucaccugggccauugguacgacgcccgacuuaacuugaaaacaaguuuccacugcuacggugcauguacgaaguaucaguacccuuggcacaccgcuaaaugccauuuugaaaaggauuaugaguacgagaacagcugggccuguaauccacccgacugcccuggggugggcacuggaugcacagcguguggccuguaucucgaucagcugaaaccaguugggaccgccuucaagauuaucucuguccgcuacuccagaaaggugugcgugcaauuuggagaagaguauuuauguaaaacaauugacaugaacgauugcuucgucacuaggcacgcuaagaucuguauaauugguaccguuucaaaauuuagucagggcgacacgcugcuuuucuuggggcccauggaaggaggcgguaucaucuuuaagcauuggugcaccagcacaugucacuucggggauccgggcgacgugaugggaccuaaagacaagccauuuauuugccccgaguucccuggccaguuucggaaaaaguguaauuucgcaacuacccccgugugcgaauacgaugggaacaucauuucgggauacaagaaaguacucgccacaauagacuccuuccagucuuuuaauacuagcaacauccauuucaccgaugagcgcauugaguggagagacccagauggcaugcugagggaccacaucaauauuaucauaucaaaggauaucgacuuugaaaaccuagcugagaauccuuguaaagucggucugcaagccgcaaacauugaaggggcguggggaaguggcguggguuucacgcucacaugccagguuucccugaccgagugccccacuuuucuuacaucuaucaaggccugugauauggcuauuugcuauggcgccgaaagcgugaccuugucccgugggcagaauacugucaaaaucaccggaaagggcgggcacucaggaagcaguuucaaguguugccauggcaaagaguguucuuccaacggucugcaagcaagcgcuccacacuuagacaaggugaaugggauaucggagcucgaaaacgagaaaguuuacgaugacggagccccggaaugcggcgugacauguugguuuaagaaaucaggugaguggguaaugggcauuaucaaugggaacugggucgugcugaucgugcuuugcguccugcucuuguucucucugauucuacugaguauacucuguccuguucggaagcauaagaaauccuga

SEQ ID NO: 10211 - RNA, 3402 nt, Artificial Sequence
  derived and/or modified CDS sequence (opt3) from SEOV(Humber)__KM948597.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucguggagagugaaguuuccuucaaaggcuugugcaugcucaagcaccggaugguggaggaaucuuaucgcaaccgacguagcgucaucuguuacgaccuggccugcaauuccaccuuuuguaagcccacaguguauaugauuguaccuauccaugcaugcaacaugaugaaaucaugucugauugggcucggaccauacagaauccagguuguguaugagaggacuuacugcaccacaggcauauuaaccgaggguaaguguuucguccccgauaaagccguggugagugcucugaagcgggggauguaugcaaucgccagcauugaaacuaucugcuuuuucguccaccagaaaggaaauacauacaagauuguuaccgcuaucacgucugccaugggcuccaaguguaacaauacugacaccaaagugcaaggcuacuauauaugcauuaucgggggaaacucagcgccuguauacagcccagccggugaggauuuucgcgcaauggaaguguucaguggcauuaucacaucuccccauggggaggaccacgaucuuccuggagaagagaucgcuacuuaucagauuuccggccagauagaggccaagaucccacacaccgucagcucgaaaaauuugaagcugacagcauuugcugguauuccgucuuacuccucaaccaguauccuagccgcgagcgaagacgggagauucauauuuucccccggacucuucccuaaccugaaccagucugugugcgauaauaacgcccuuccacugauuuggaggggcuugaucgaccucacgggcuauuacgaggcaguucaucccuguaauguguucugcguccugagcgggccuggagcuucaugugaagccuuuagugaggguggcaucuucaacauuacuuccccaaugugcuuagugagcaaacaaaaucgguuucgcgcugccgaacagcagaucucuuucauuugucaacgaguagauauggacauaaucguuuauugcaacgggcagaagaaaacaauucugaccaagacucucgugaucggacaguguaucuacacaauuaccucacuuuuuagucuguugcccggcgucgcacacagcauagccaucgagcuaugcgugccggguuuccaugggugggcuacggcggcacugcucauuaccuuuuguuucggcuggguccugaucccugccugcacacuugcugugcuguugguucucaaguuuuucgccaauauucugcacacuuccaaccaggagaauagauuuaaagcaaucuuaaggaagauaaaagaagaguucgaaaagaccaaaggaucuauggugugugagaucugcaaguacgaaugcgagacacugaaggagcuaaaagcccacaaccucucguguauucaaggcgaaugccccuauuguuuuacucauugcgagccaaccgaaacagcuauccaggcccacuacaagguaugucaggcaacccaucgguuccgugaggaucugaaaaagacugucacgccucccaauauugggccaggaugcuaucgcacacuuaacuuguucagauacaaaucaagguguuauauccugaccauguggacucuccugcuuauaauugaguccauccugugggcggcuucagccgcagaaauucccuuggugccucucuggaccgacaaugcccacgguguuggcagugugccaaugcauacagaccuggaguuagauuuuucucugccgagcuccucaaaguacaccuauaagcggcaccuaacuaaccccgucaaugaccagcaaagcgugucucuccacaucgaaauagagucccaggggaucggagcugauguacaucaccugggccauugguacgacgcccgacuuaacuugaaaacaaguuuccacugcuacggugcauguacgaaguaucaguacccuuggcacaccgcuaaaugccauuuugaaaaggauuaugaguacgagaacagcugggccuguaauccacccgacugcccuggggugggcacuggaugcacagcguguggccuguaucucgaucagcugaaaccaguugggaccgccuucaagauuaucucuguccgcuacuccagaaaggugugcgugcaauuuggagaagaguauuuauguaaaacaauugacaugaacgauugcuucgucacuaggcacgcuaagaucuguauaauugguaccguuucaaaauuuagucagggcgacacgcugcuuuucuuggggcccauggaaggaggcgguaucaucuuuaagcauuggugcaccagcacaugucacuucggggauccgggcgacgugaugggaccuaaagacaagccauuuauuugccccgaguucccuggccaguuucggaaaaaguguaauuucgcaacuacccccgugugcgaauacgaugggaacaucauuucgggauacaagaaaguacucgccacaauagacuccuuccagucuuuuaauacuagcaacauccauuucaccgaugagcgcauugaguggagagacccagauggcaugcugagggaccacaucaauauuaucauaucaaaggauaucgacuuugaaaaccuagcugagaauccuuguaaagucggucugcaagccgcaaacauugaaggggcguggggaaguggcguggguuucacgcucacaugccagguuucccugaccgagugccccacuuuucuuacaucuaucaaggccugugauauggcuauuugcuauggcgccgaaagcgugaccuugcugcgugggcagaauacugucaaaaucaccggaaagggcgggcacuccggaagcagcuucaaguguugccauggcaaagaguguaguucuaacgguuuacaagcauccgcuccacaccucgacaaggugaaugggauaagcgagcuggaaaacgagaaaguuuacgaugacggagccccggaaugcggcgugacauguugguuuaagaaaucgggugaguggguaaugggcauuaucaaugggaacugggucgugcuuaucgugcugugcgucuugcuccuguucucacuaauucugcucucuauacuguguccuguucggaagcauaagaaaaguuga

SEQ ID NO: 10212 - RNA, 3402 nt, Artificial Sequence
  derived and/or modified CDS sequence (opt3) from SEOV(K24-e7)__AF288652.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaagguggucuggaggaaaaaggcgaaucaagaaucagcuaaccagaauagcuuugaggugguugagagugaaguguccuucaaaggcuugugcaugcucaagcaccggauggucgaggaaucuuaucgcaaccgacguagcgugauauguuacgaccuggccugcaauuccaccuuuuguaagcccacaguauauaugaucguuccuauucaugcaugcaacaugaugaaaucaugucugaucgggcucggaccauacaggauucagguggucuaugagagaacuuacugcaccacaggcaucuuaaccgaggguaaguguuucgugcccgggaaagccguggucagugcucugaagcggggaauguaugcaauagccagcaucgaaacuauuugcuuuuucauccaccagaaaggcaauacauacaagauuguuaccgcuaucacgucugccaugggcuccaaguguaacaauacugauaccaaagugcaaggguacuauauaugcauuaucggagguaacucagcgccuguauacgcaccagccggcgaggacuuucgcgcuauggaaguguucagcgggauuaucacaaguccccauggagaggaucacgaccuuccuggcgaagagaucgccacuuaucagauuucuggucagauagaggcaaagaucccacacaccgucuccagcaaaaauuugaagcugauugcuuuugccgggaucccgucguacucuuccacaucaauacuagcggccagugaagauggaagauucauuuuuagccccggccucuucccuaaccugaaccaguccgugugcgacaauaacgcacuuccacugaucuggaggggcuugaucgaucucaccggguauuacgaggcuguucaucccuguaauguguuccggguccugucuggaccuggugccagcugcgaagccuuuucagagggcgggauuuucaacaucacgaguccaauguguuuaguguccaaacaaaaucgcuuucgagccgcagaacagcagauuagcuucauaugccaaagaguagacauggauaucauuguuuauuguaacggacagaagaaaacuauccugacaaagacccucgugaucggccagugcauuuacacuauaacaucuuuguuuucacuguugcccggugucgcccacaguaucgcuauugagcuaugugugccgggguuccauggcugggcgaccgcagcccugcucaucacguuuugcuucggauggguccugauuccugcuuguacccuugccauccuguuggugcucaaguuuuucgcaaauauacugcacacaagcaaccaggagaauagguuuaaagccaucuuacggaagauuaaagaagaguucgaaaagacuaaaggcuccaugguuugcgagaucuguaaguacgaaugcgagacccugaaggagcuaaaagcucacaaccucucuugcgugcaaggggaaugucccuauugcuuuacacauugugagccaacugaaaccgccauucaggcacacuacaagguaugccaggcgacacaucguuuccgcgaggaccugaaaaagaccgucacuccucagaauaucggacccgguuguuauagaacgcuuaacuuguucagguacaaaucgcggugcuauauacugacaauguggacccuccugcuuauuaucgagagcauucugugggcugccuccgcagccgaaaucccauuggugccccucuggacugauaaugcucacggcguugggucagugccuaugcauaccgaccuggaguuagacuuuagucugccaucuagcuccaaguacacauauaagcgacaccuaaccaacccggucaaugaucaacagucagugagccuccacauagaaaucgagucucagggaauuggcgccgacguacaucaccugggucauugguacgaugcacgccuuaacuugaaaacuuccuuccacuguuacggggcuugcacaaaguaucaguaccccuggcacacggccaaaugucauuuugaaaaggacuaugaguacgagaacaguugggcgugcaauccuccagauugucccggcgugggaaccggcugcacugccugcgggcuguaucucgaccaacugaaaccuguuggaacagcuuucaagaucauuagcgucagauacucuaggaagguguguaugcaguuuggugaagaguauuuaugcaaaaccaucgauaugaacgacuguuucgugacacggcacgcaaagauaugcauuaucggcacugucuccaaauuuucacagggggauacccugcuuuucuugggaccaauggaaggcggugggaucauuuuuaagcauugguguacgaguaccugccacuucggcgaccccggagauguuaugggcccgaaagacaagccuuuuaucuguccagaguuccccgggcaguuucgcaaaaagugcaauuucgccacaacuccuauuugugaauacgacggaaacauaaucagcggcuacaagaaagugcucgcuaccauugauucguuccaauccuuuaauacaucuaacauccauuucacugacgagagaauugaguggagggaucccgacgguaugcugcgugaucacaucaauauagugaucagcaaggacauugauuuugaaaaccuagccgagaauccaugcaaaguagggcugcaggcagcgaacaucgaaggagccuggggcucaggugucggcuucacccucacgugucaggugagucugacagagugcccuaccuuucuuacuuccauuaaggcuugcgacauggccaucuguuauggggcagaaucuguuacauugagccggggacaaaauaccgugcgaauaacuggcagagggggacacuccggcagcucauucaaaugcugucaugguaaggagugcaguucuaccgggcugcaggcuuccgcuccccacuuagauaaggucaacggaauuagcgagcucgaaaaugagaaaguguacgacgauggcgcaccagaaugugguguuacaugcugguuuaagaaaucgggcgagugggugauggggaucaucaacggaaauuggguaguccugauugugcuuugugugcugcuucucuucucacugauacuacugucuauccucugcccggucaggaagcauaaaaagaguuga

SEQ ID NO: 10213 - RNA, 3402 nt, Artificial Sequence
  derived and/or modified CDS sequence (opt3) from SEOV(K24-v2)__AF288654.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaagguggucuggaggaaaaaggcgaaucaagaaucagcuaaccagaauagcuuugaggugguugagagugaaguguccuucaaaggcuugugcaugcucaagcaccggauggucgaggaaucuuaucgcaaccgacguagcgugauauguuacgaccuggccugcaauuccaccuuuuguaagcccacaguauauaugaucguuccuauucaugcaugcaacaugaugaaaucaugucugaucgggcucggaccauacaggauucagguggucuaugagagaacuuacugcaccacaggcaucuuaaccgaggguaaguguuucgugcccgauacugccguggucagugcucugaaacgggggauguaugcaauagccagcaucgaaacaauuugcuuuuucauccaccagaagggaaauaccuacaaaauuguuacggcuaucacuucugccaugggcuccaaguguaacaauaccgacacaaaggugcaaggcuacuauauaugcauuaucgggggaaacucagcgccuguauacgcaccagccggugaggauuuucgcgcuauggaaguguucagcggcauuaucacuucaccccauggggacgaucacgaccuuccuggagaggaaaucgccccauaucagauuucuggccagauagaggcaaaaaucccgcacaccgucuccagcaagaauuugaaacugauugcuuuugccgguauccccucguacucuuccacaucaauacuagcggccagugaggaugggagauucauuuuuagcccuggacucuucccaaaccugaaccaguccgugugcgacaauaacgcacuuccccugaucuggaggggcuugaucgaucucaccggcuauuacgaagcuguucauccuuguaauguguucugcguccugucugggccaggagccagcugugaggcuuuuucagaagguggcauuuucaacaucacgagucccaugugcuuaguguccaagcaaaaucgguuucgcgccgcagagcagcagauuagcuucauaugucaacgaguagacauggauaucauuguuuauugcaacgaccagaaaaagacuauccugacaaaaacccucgugaucgggcaguguauuuacacuauaacaucuuuguuuucacuguugccgggagucgcccacaguaucgcuauugaacuaugcgugccuggcuuccaugguugggcgaccgcagcccugcucaucacguuuuguuucggguggguccugauucccgcuugcacccuugccauccuguuggugcucaaguuuuucgcaaauauacugcacacaagcaaccaggagaauagauuuaaggccaucuuaaggaaaauuaaggaggaauuugagaaaacuaagggcuccaugguuugugaaaucugcaaauacgagugcgaaacccugaaggagcuaaaggcucacaaccucucuugugugcaaggagagugcccauauuguuucacacauugcgaaccuacugagaccgccauucaggcacacuacaaaguaugucaggcgacacaucgguuccgugaagaccugaagaaaaccgucacuccccagaauaucggcccagggugcuaucgcacgcuuaacuuguucagauacaagucgagguguuauauacugacaauguggacccuccugcuuauuaucgagagcauucugugggcugccuccgcagccgagauccccuuggugccucucuggacugauaaugcucacggaguugguucagugccaaugcauaccgaccuggaauuagauuuuagucugccgucuagcuccaaauacacauauaagcggcaccuaaccaaccccgucaaugaccaacagucagugagccuccacauagagaucgaaucucagggcauuggggccgauguacaucaccugggacauugguacggcgcacgacuuaacuugaagacuuccuuccacugcuacggugcuuguacaaaauaucaguacccuuggcacacggccaagugccauuuugagaaagacuaugaauacgagaacaguugggcguguaauccacccgauugcccuggggugggcaccggaugcacugccuguggccuguaucucgaccaacugaagccaguugggacagcuuucaaaaucauuagcguccgcuacucuagaaaggugugcaugcaguuuggagaggaauauuuauguaagaccaucgauaugaacgacugcuucgugacaaggcacgcaaaaauauguauuaucgguacugucuccaaguuuucacagggcgauacccugcuuuucuuggggcccauggagggaggcgguaucauuuuuaaacauuggugcacgaguaccugucacuucggggacccgggcgacguuaugggaccuaaggauaaaccauuuaucugccccgaguucccuggccaguuucggaagaaauguaauuucgccacaacucccauuugcgaauacgacgggaacauaaucagcggauacaagaaggugcucgcuaccauugauucguuccaauccuuuaauacaucuaacauccauuucacugacgaacgcauugaguggagagauccagacggcaugcugagggaucacaucaauauagugaucagcaaagacauugauuuugagaaccuagccgaaaauccuuguaagguaggucugcaggcagcgaacaucgagggggccuggggaucaggcgucgguuucacccucacgugccaggugagucugacagaaugccccaccuuucuuacuuccauuaaggcuugugacauggccaucugcuauggcgcagagucuguuacauugagccgugggcaaaauaccgugcggauaacuggaaaaggcgggcacuccggaaguagcuucaaauguugccauggcaaggaauguaguucuaccggucugcaggcuuccgccccacacuuagauaaggucaacgggauuagcgagcucgagaaugaaaaaguguacgacgauggagcaccggagugcggcguuacauguugguuuaagaaaucgggugaaugggugaugggcaucaucaacgggaauuggguaguccugauugugcuuugcgugcugcuucucuucucacugauacuacugucuauccucuguccuguccgaaagcauaaaaagaguuga

SEQ ID NO: 10214 - RNA, 3402 nt, Artificial Sequence
  derived and/or modified CDS sequence (opt3) from SEOV(KI-83-262)__D17592.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucguggagagugaaguuuccuucaaaggcuugugcaugcucaagcaccggaugguggaggaaucuuaucgcaaccgacguagcgucaucuguuacgaccuggccugcaauuccaccuuuuguaagcccacaguguauaugauuguaccuauccaugcaugcaacaugaugaaaucaugucugauugggcucggaccauacagaauccagguuguguaugagaggacuuacugcaccacaggcauauuaaccgaggguaaguguuucguccccgauaaagccguggugagugcucugaagcgggggauguaugcaaucgccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuucgcgcuauggaaguauucagcggcaucaucacaaguccccauggggaggaccacgaucuuccuggagaagagauugccacuuaucagauaucuggccagaucgaggcaaagauuccacacaccguguccagcaaaaauuugaagcugacagcuuuugccgguaucccgucguacucuuccaccucaauacuagcggccagugaagacgggagauucauuuuuagccccggacucuucccuaaccugaaccaguccgucugcgauaauaacgcacuuccacugaucuggaggggcuugaucgaccucacgggcuauuacgaggcugugcaucccuguaauguuuucugcgugcugucugggccuggagccagcugugaagccuuuucagaggguggcauuuucaacaucacuagcccaaugugcuuagucuccaaacaaaaucgguuucgcgccgcagaacagcagauuagcuucgugugucaacgaguagauauggacauaaucguuuauugcaacgggcagaagaaaacaauucugaccaagacucucgugaucggacaguguaucuacacaauuaccucuuuguuuucacuguugcccggcgucgcccacaguauagcuaucgagcuaugcgugccggguuuccaugggugggcgacggcagcccugcucauuaccuuuuguuucggcuggguccugaucccugcuugcacacuugccauucuguuggugcucaaguuuuucgcaaauauccugcacacuagcaaccaggagaauagauuuaaagccauauuaaggaagaucaaagaagaguucgaaaagaccaaaggauccaugguuugugagauuugcaaguacgaaugcgagacacugaaggagcuaaaagcucacaaccucucuugugugcaaggcgaaugccccuauuguuuuacucauugcgagccaaccgaaacagccauccaggcacacuacaagguaugucaggcgacccaucgguuccgugaggaucugaaaaagacugucacgccucagaauauugggcccggaugcuaucgcacacuuucguuguucagauacaaaaguagguguuauauccugaccauguggacucuccugcuuauaauugaguccauccugugggcugccucagcagccgaaauuccauuggugccccucuggaccgacaacgcucacgguguuggcagugugccuaugcauacagaccuggaguuagauuuuucucugccaagcuccucaaaguacaccuauaagcggcaccuaacuaauccggucaacgaccaacagagcgugucucuccacaucgaaauagagucccaggggaucggagccgauguacaucaccugggccauugguacgacgcacgacuuaauuugaaaacaaguuuccacugcuacggugcuuguacgaaguaucaguaccccuggcacaccgccaaaugccauuuugaaaaggauuaugaguacgagaacagcugggcguguaacccuccagacugccccggggugggcacuggaugcacagccuguggccuguaucucgaucaacugaaaccuguugggaccgcuuucaagauuaucucuguccgcuacuccagaaaggugugcgugcaguuuggagaagaguauuuauguaaaacaauugacaugaaugauugcuucgucacuaggcacgcaaagaucuguauaauugguaccguuucaaaauuuagucagggcgacacgcugcuuuucuuggggccaauggaaggaggcgguaucaucuuuaagcauuggugcaccagcacaugucacuucggggaucccggcgacgugaugggaccgaaagacaagccuuuuauuugcccagaguuccccggccaguuucggaaaaaguguaacuucgccacuaccccugugugcgaauacgaugggaauaucauuucgggauacaagaaaguacucgcuacaauagacuccuuccaaucuuuuaacacuagcaauauccauuucaccgaugagcgcauugaguggagagaccccgauggcaugcugagggaccacaucaacauugucaucucaaaggauauagacuuugaaaaucuagccgagaacccauguaaagugggucugcaggcagcgaauaucgaaggggccuggggaaguggcguugguuucacgcucacaugccaggugucccugaccgagugcccuacuuuucuuacaucuauuaaggcuugugauauggccaucugcuauggcgcagaaagcgucaccuugucccgugggcaaaacacugugaaaauuaccggaaagggcgggcacucaggaagcaguuucaaguguugccauggcaaagaguguucuuccacaggucugcaggcuagcgcuccccacuuagacaagguuaaugggaucucggagcucgaaaacgagaaaguguacgaugacggagcaccagaaugcggcauaacguguugguuuaagaaaucaggugaguggguaaugggcauuaucaaugggaacugggucgugcugaucgugcuuugcguccugcuucucuucucucugauucuacugaguauacucuguccgguucggaagcauaagaaauccuga

SEQ ID NO: 10215 - RNA, 3402 nt, Artificial Sequence
  derived and/or modified CDS sequence (opt3) from SEOV(KI-85-1)__D17593.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucguggagagugaaguuuccuucaaaggcuugugcaugcucaagcaccggaugguggaggaaucuuaucgcaaccgacguagcgucaucuguuacgaccuggccugcaauuccaccuuuuguaagcccacaguguauaugauuguaccuauccaugcaugcaacaugaugaaaucaugucugauugggcucggaccauacagaauccagguuguguaugagaggacuuacugcaccacaggcauauuaaccgaggguaaguguuucguccccgauaaagccguggugagugcucugaagcgggggauguaugcaaucgccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuucgcgcuauggaaguauucagcggcaucaucacaaguccccauggggaggaccacgaucuuccuggagaagagauugccacuuaucagauaucuggccagaucgaggcaaagauuccacacaccguguccagcaaaaauuugaagcugacagcuuuugccgguaucccgucguacucuuccaccucaauacuagcggccagugaagacgggagauucauuuuuagccccggacucuucccuaaccugaaccaguccgucugcgauaauaacgcacuuccacugaucuggaggggcuugaucgaccucacgggcuauuacgaggcugugcaucccuguaauguuuucugcgugcugucugggccuggagccagcugugaggcuuuuucagaagguggcauuuucaacaucacuucaccaaugugcuuagucuccaaacaaaaucgguuucgcgccgcagaacagcagauuagcuucgugugucaacgaguagauauggacauaaucguuuauugcaacgggcagaagaaaacaauucugaccaagacucucgugaucggacaguguaucuacacaauuaccucuuuguuuucacuguugcccggcgucgcccacaguauagcuaucgagcuaugcgugccggguuuccaugggugggcgacggcagcccugcucauuaccuuuuguuucggcuggguccugaucccugcuugcacacuugccauucuguuggugcucaaguuuuucgcaaauauccugcacacuagcaaccaggagaauagauuuaaagccauauuaaggaagaucaaagaagaguucgaaaagaccaaaggauccaugguuugugagauuugcaaguacgaaugcgagacacugaaggagcuaaaagcucacaaccucucuugugugcaaggcgaaugccccuauuguuuuacucauugcgagccaaccgaaacagccauccaggcacacuacaagguaugucaggcgacccaucgguuccgugaggaucugaaaaagacugucacgccucagaauauugggcccggaugcuaucgcacacuuaacuuguucagauacaaaucgagguguuauauccugaccauguggacucuccugcuuauaauugagagcauccugugggcugccuccgcagccgaaauuccauuggugccccucuggaccgacaaugcucacgguguuggcucagugccuaugcauacagaccuggaguuagauuuuagucugccaucuagcuccaaguacaccuauaagcggcaccuaacuaacccggucaaugaccaacagucagugagccuccacaucgaaauagagucucaggggaucggagccgauguacaucaccugggccauugguacgacgcacgacuuaacuugaaaacauccuuccacugcuacggugcuugugccaaguaucaguaccccuggcacacggcgaaaugccauuuugaaaaggauuaugaguacgagaacaguugggccuguaauccuccagacugccccggggugggcaccggaugcacugcuuguggccuguaucucgaucaacugaaaccuguugggacagcauucaagauuaucagcguccgcuacucuagaaaggugugcgugcaguuuggagaagaguauuuauguaaaaccauugacaugaacgauugcuucgucacaaggcacgccaagaucuguauaauugguacuguuuccaaauuuucacagggcgacacccugcuuuucuuggggccaauggaaggaggcgguaucaucuuuaagcauuggugcacgaguaccugucacuucggggaucccggcgacgugaugggaccgaaagacaagccuuuuauuugcccagaguuccccggccaguuucggaaaaaguguaauuucgcuacaacuccugugugcgaauacgaugggaacaucauuagcggauacaagaaaguacucgccaccauagacucguuccaauccuuuaauacaucuaacauccauuucacugaugagcgcauugaguggagagaccccgauggcaugcugagggaccacaucaauauugucaucagcaaggauauagacuuugaaaaccuagcagagaauccauguaaagugggucugcaggcggccaacaucgaaggggcuuggggaucaggcguugguuucacccucacgugccaggugagucugacagagugcccuaccuuucuuacuuccauuaaggccugugauauggcaaucugcuauggcgcugaaucugucacauugagccgugggcaaaauaccgugaaaauuacuggaaagggcgggcacuccggaaguagcuucaaguguugccauggcaaagaguguaguucuaccggucugcaggccuccgcaccccacuuagacaagguuaacgggaucagcgagcucgaaaaugagaaaguguacgaugacggagccccagaaugcggcauaacauguugguuuaagaaaucgggugaguggguaaugggcauuaucaacgggaauugggucgugcugaucgugcuuugcguccugcuucucuucucauuuauucugcuaucuauacuguguccgguucggaagcauaagaaaaguuga

SEQ ID NO: 10216 - RNA, 3402 nt, Artificial Sequence
  derived and/or modified CDS sequence (opt3) from SEOV(KI-88-15)__D17594.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugagaucgucgagagugaaguguccuucaaaggcuugugcaugcucaagcaccggaugguugaggaaucuuaucgcaaccgacguagcgugauuuguuacgaccuggccugcaauuccaccuuuuguaagcccacagucuauaugaucgugccuauucaugcaugcaacaugaugaaaucaugucugaucgggcucggaccauacagaauacagguaguuuaugagaggacuuacugcaccacaggcaucuuaaccgaggguaaguguuucgugcccgauaaagccgucgugagugcucugaagcgggggauguaugcaauugccagcaucgaaacuauuugcuuuuucauccaccagaaaggaaauacauacaagauagugaccgcuauuacgucugccaugggcuccaaguguaacaauacugacaccaaaguccaaggcuacuauaucugcauuaucgggggaaacucagcgccuguuuacgcaccagccggugaggauuuucgcgcuauggaaguguucagcggcaucauuacaaguccccauggggaggaccacgaucuuccuggagaagagauagccacuuaucagaucucuggccagauugaggcaaagaucccacacaccguauccagcaaaaauuugaagcugacagcuuuugccgguauaccgucguacucuuccaccucaauucuagcggccagugaagacgggagauucaucuuuagccccggacucuucccuaaccugaaccaguccgugugcgauaauaacgcacuuccacugaucuggaggggcuugauugaccucacgggcuauuacgaggcuguccaucccuguaauguguucugcguucugucugggccuggagccagcugugaagccuuuucagaggguggcaucuucaacauuacuucaccaaugugcuuaguguccaaacaaaaucgguuucgcgccgcagaacagcagaucagcuucgucugucaacgaguggauauggacauaauuguauauugcaacgggcagaagaaaacaauccugaccaagacucucguuaucggacaguguauuuacacaauaaccucuuuguuuucacuguugcccggcguggcccacaguaucgcuauugagcuaugcgucccggguuuccaugggugggcgacggcagcccugcucaucaccuuuuguuucggcugggugcugauuccugcuugcacacuugccauccuguugguccucaaguuuuucgcaaauauacugcacacuagcaaccaggagaauagauuuaaagccaucuuaaggaagauuaaagaagaguucgaaaagaccaaaggauccauggugugugagaucugcaaguacgaaugcgagacacugaaggagcuaaaagcucacaaccucucuuguguucaaggcgaaugccccuauuguuuuacucauugcgagccaaccgaaacagccauucaggcacacuacaaggugugucaggcgacccaucgguuccgugaggaucugaaaaagacuguaacgccucagaauaucgggcccggaugcuaucgcacacuuaacuuguucagauacaaaucgagguguuauauacugaccauguggacucuccugcuuauuaucgagagcauucugugggcugccuccgcagccgaaaucccauuggucccccucuggaccgacaaugcucacggugugggcucaguuccuaugcauacagaccuggaguuagauuuuagucugccaucuagcuccaaguacaccuauaagcggcaccuaacuaacccggugaaugaccaacagucagucagccuccacauagaaaucgagucucaggggauuggagccgaugugcaucaccugggccauugguacgacgcacgacuuaacuugaaaacauccuuccacugcuacggugcuuguacgaaguaucaguaccccuggcacaccgccaaaugccauuuugaaaaggauuaugaguacgagaacaguugggcguguaauccuccagacugccccgggguaggcacuggaugcacagccuguggccuguaucucgaucaacugaaaccuguggggaccgcuuucaagaucauuagcguucgcuacucuagaaaggucugcgugcaguuuggagaagaguauuuauguaaaacaaucgacaugaacgauugcuucgugacuaggcacgcaaagauauguauuaucgguaccgucuccaaauuuucacagggcgacacgcugcuuuucuuggggccaauggaaggaggcgguaucauuuuuaagcauuggugcaccaguacaugucacuucggggaucccggcgacguuaugggaccgaaagacaagccuuuuaucugcccagaguuccccggccaguuucggaaaaaguguaauuucgccacuaccccugugugcgaauacgaugggaacauuauaagcggauacaagaaagugcucgcuacaaucgacucguuccaauccuuuaauacuucuaacauucauuucaccgaugagcgcaucgaguggagagaccccgauggcaugcugagggaccacauuaauaucguaauaagcaaggauaucgacuuugaaaaccuagccgagaauccauguaaagucggucugcaggcagcgaacauugaaggggccuggggaucaggcguggguuucacgcucacaugccagguuagucugaccgagugcccuacuuuucuuacauccaucaaggcuugugauauggccauuugcuauggcgcagaaucugugaccuugagccgugggcaaaauacugucaaaaucaccggaaagggcgggcacuccggaaguagcuucaaguguugccauggcaaagaguguaguucuacaggucugcaggcuuccgcuccccacuuagacaaggugaacgggauaagcgagcucaaaaaugaaaagguuuacgaugacggagcaccagagugcggcauuacguguugguuuaaaaagucgggugaaugggugaugggcaucaucaacgggaauuggguaguccugauugugcuuugcgugcugcuucucuucucauuuauacugcuaucuauccuguguccgguccggaagcauaaaaagaguuga

SEQ ID NO: 10217 - RNA, 3402 nt, Artificial Sequence
  derived and/or modified CDS sequence (opt3) from SEOV(LongwanRn581)__GU592930.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucguggagagugaaguuuccuucaaaggcuugugcaugcucaagcaccggaugguggaggaaucuuaucgcaaccgacguagcgucaucuguuacgaccuggccugcaauuccaccuuuuguaagcccacaguguauaugauuguaccuauccaugcaugcaacaugaugaaaucaugucugauugggcucggaccauacagaauccagguuguguaugagaggacuuacugcaccacaggcauauuaaccgaggguaaguguuucguccccgauaaagccguggugagugcucugaagcgggggauguaugcaaucgccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuucgcgcuauggaaguauucagcggcaucaucacaaguccccauggggaggaccacgaucuuccuggagaagagauugccacuuaucagauaucuggccagaucgaggcaaagauuccacacaccguguccagcaaaaauuugaagcugacagcuuuugccgguaucccgucguacucuuccaccucaauacuagcggccagugaagacgggagauucauuuuuagccccggacucuucccuaaccugaaccaguccgucugcgauaauaacgcacuuccacugaucuggaggggcuugaucgaccucacgggcuauuacgaggcugugcaucccuguaauguuuucugcgugcugucugggccuggagccagcugugaagccuuuucagaggguggcauuuucaacaucacuucaccaaugugcuuagucuccaaacaaaaucgguuucgcgccgcagaacagcagauuagcuucgugugucaacgaguagauauggacauaaucguuuauugcaacgggcagaagaaaacaauucugaccaagacucucgugaucggacaguguaucuacacaauuaccucuuuguuuucacuguugcccggcgucgcccacaguauagcuaucgagcuaugcgugccggguuuccaugggugggcgacggcagcccugcucauuaccuuuuguuucggcuggguccugaucccugcuugcacacuugccauucuguuggugcucaaguuuuucgcaaauauccugcacacuagcaaccaggagaauagauuuaaagccauauuaaggaagaucaaagaagaguucgaaaagaccaaaggauccaugguuugugagauuugcaaguacgaaugcgagacacugaaggagcuaaaagcucacaaccucucuugugugcaaggcgaaugccccuauuguuuuacucauugcgagccaaccgaaacagccauccaggcacacuacaagguaugucaggcgacccaucgguuccgugaggaucugaaaaagacugucacgccucagaauauugggcccggaugcuaucgcacacuuaacuuguucagauacaaaucgagguguuauauccugaccauguggacucuccugcuuauaauugagagcauccugugggcugccuccgcagccgaaauuccauuggugccccucuggaccgacaaugcucacgguguuggcucagugccuaugcauacagaccuggaguuagauuuuagucugccaucuagcuccaaguacaccuauaagcggcaccuaacuaacccggucaaugaccaacagucagugagccuccacaucgaaauagagucucaggggaucggagccgauguacaucaccugggccauugguacgacgcacgacuuaacuugaaaacauccuuccacugcuacggugcuuguacgaaguaucaguaccccuggcacaccgccaaaugccauuuugaaaaggauuaugaguacgagaacaguugggcguguaauccuccagacugccccggggugggcacuggaugcacagccuguggccuguaucucgaucaacugaaaccuguugggaccgcuuucaagauuaucagcguccgcuacucuagaaaggugugcgugcaguuuggagaagaguauuuauguaaaacaauugacaugaacgauugcuucgucacuaggcacgcaaagaucuguauaauugguaccguuuccaaauuuucacagggcgacacgcugcuuuucuuggggccaauggaaggaggcgguaucaucuuuaagcauuggugcaccaguacaugucacuucggggaucccggcgacgugaugggaccgaaagacaagccuuuuauuugcccagaguuccccggccaguuucggaaaaaguguaauuucgccacuaccccugugugcgaauacgaugggaacaucauuagcggauacaagaaaguacucgcuacaauagacucguuccaauccuuuaauacuucuaacauccauuucaccgaugagcgcauugaguggagagaccccgauggcaugcugagggaccacaucaauauugucaucagcaaggauauagacuuugaaaaccuagccgagaauccauguaaagugggucugcaggcagcgaacaucgaaggggccuggggaucaggcguugguuucacgcucacaugccaggugagucugaccgagugcccuacuuuucuuacauccauuaaggcuugugauauggccaucugcuauggcgcagaaucugucaccuugagccgugggcaaaauacugugaaaauuaccggaaagggcgggcacuccggaaguagcuucaaguguugccauggcaaagaguguaguucuacaggucugcaggcuaacgcuccccacuuagacaagguuaaugggaucuccgagcucgaaaacgagaaaguguacgaugacggagcaccagaaugcggcguaacguguugguuuaagaaaagcggugagugggucaugggcauaauuaaugggaacuggguggugcugaucguccuuugcguucugcuucucuucucgcugauccuacugucaauucucuguccggugcggaagcauaagaaaucuuga

SEQ ID NO: 10218 - RNA, 3402 nt, Artificial Sequence
  derived and/or modified CDS sequence (opt3) from SEOV(RuianRn180)__GU592931.1__GP
auguggagccugcucaucguggccgcucuugucggccagggguucgcacugaagaacguuuuugacaugagaauacaaugcccccacuccgugaauuucggagagaccucuguaucagguuacacagaauugccuccauuaagucugcaggaggccgaacagcuagugccggagagcuccuguaacauggauaaucaucagucucucucgacuauaaacaaacugacgaaggucaucuggaggaaaaaggcgaaucaagaaucagcuaaccagaauagcuuugaggugguugagagugaaguguccuucaaaggccuuugcaugcugaagcaccggauggucgaggaaucuuaucgcaaccgacguagcgugauuuguuacgacuuggccugcaauuccaccuuuuguaagcccacaguauauaugaucguuccuauucaugcaugcaacaugaugaaaucaugucucaucgggcugggaccauacagaauacagguggucuaugagaggacuuacugcaccacaggcauccugaccgaggguaaguguuucgugcccgauaaagccguggucagugcucucaagcgggggauguaugcaauugccagcaucgaaacuauuugcuuuuucauccaccagaaaggaaauacauacaagauaguuaccgcuauuacgucugccaugggcuccaaguguaacaauacugacaccaaagugcaaggcuacuauaucugcauuaucgggggaaacucagcgccuguauacgcaccagccggugaggauuuucgcgcuauggaaguguucagcggcaucauuacaaguccccauggggaggaccacgauuuaccuggagaagagauagccacuuaucagaucucuggccagauugaggcaaagaucccacacaccgucuccagcaaaaaucugaaacuuacagcuuuugccgguauaccgucguacucuuccaccucaauuuuggcggccagugaagacgggagauucaucuuuagccccggacuguucccuaaccuaaaccaguccgugugcgauaauaacgcacucccacugaucuggaggggccuuauugaccugacgggcuauuacgaggcuguucaucccuguaauguguucugcgucuugucugggccuggagccagcugugaagccuuuucagaggguggcaucuucaacauuacuucaccaaugugccucguguccaaacaaaaucgguuucgcgccgcagaacagcagauuagcuucaucugucaacgaguagauauggacauuaucguuuauugcaacgggcagaagaaaacaauccugaccaagacuuuagugauuggacaguguauauacacaaucaccucucuguuuucacuccuucccggcgucgcccacaguauugcuaucgagcugugcgugccggguuuccaugggugggcgacggcagccuugcuaauuaccuuuuguuucggcuggguccugaucccugcuugcacacucgccauacugcuugugcugaaguuuuucgcaaauaucuugcacacuagcaaccaggagaauagauuuaaagccauucucaggaagaucaaagaagaguucgaaaagaccaaaggauccaugguuugugagauuugcaaguacgaaugcgagacacugaaggaguuaaaagcucacaaccugucuugugugcaaggcgaaugccccuauuguuuuacucauugcgagccaaccgaaacagccauccaggcacacuacaagguaugucaggcgacccaucgguuccgugaggaucuaaagaagacugucacgccucagaauauagggcccggaugcuaucgcacacucaaccuguucagauacaaaucgagguguuauauucuuaccauguggacuuugcugcucaucauugagagcauccugugggcugccuccgcagccgaaauaccacuugugccccuguggaccgacaaugcucacgguguuggcucagugccuaugcauacagacuuggagcucgauuuuagucugccaucuagcuccaaguacaccuauaagcggcacuuaacuaacccggucaaugaccaacagucagugagccugcacaucgaaauugagucucaggggaucggagccgauguacaucaccuaggccauugguacgacgcacgacucaaccugaaaacauccuuccacugcuacggugcuuguacgaaguaucaguaccccuggcacaccgccaaaugccauuuugaaaaggauuaugaguacgagaacaguugggcguguaauccuccagacugccccggggugggcacuggaugcacagccuguggccuuuauuuggaucaacugaaaccuguugggaccgcuuucaagauuaucagcguccgcuacucuagaaaggugugcgugcaguuuggagaagaguaucucuguaaaacaauagacaugaacgauugcuucgucacuaggcacgcaaagauuuguaucaucgguaccguuuccaaauuuucacagggcgacacgcuguuauuccuggggccaauggaaggaggcgguauuaucuuuaagcauuggugcaccaguacaugucacuucggggaucccggcgacgugaugggaccgaaagacaagccuuuuauuugcccagaguuccccggccaguuucggaaaaaguguaauuucgccacuaccccugugugcgaauacgaugggaacauaaucagcggauacaagaaaguacuugcuacaauugacucguuccaauccuuuaauacuucuaacauccauuucaccgaugagcgcauugaguggagagaccccgauggcauguugagggaccacaucaauauagucaucagcaaggauauugacuuugaaaaccucgccgagaauccauguaaagugggucugcaggcagcgaacaucgaaggggccuggggaucaggcguugguuucacgcuaacaugccaggugagucugaccgagugcccuacuuuucucacauccauuaaggcuugugauauggccaucugcuauggcgcagaaucugucacccugagccgugggcaaaauacugugaaaauaaccggaaagggcgggcacuccggaaguagcuucaaguguugccauggcaaagaguguaguucuacaggucuucaggcuuccgcuccccacuuggacaagguuaacgggauuagcgagcuggaaaaugagaaaguguacgaugacggagcaccagaaugcggcguaacguguugguuuaagaaaucgggugagugggucaugggcaucaucaacgggaauugggugguguuaauuguccucugcguucugcuucuguucucauugauacuccugucuauccuauguccggugcggaagcauaagaaaaguuga

SEQ ID NO: 10219 - RNA, 3402 nt, Artificial Sequence
  derived and/or modified CDS sequence (opt3) from SEOV(ShuangyangRn470)__GU592925.1__GP
auguggagccugcucuuucuugccgcucuggugggccagggguuugcauugaagaacgucuucgacaugagaauccaaugcccccacuccguuaauuuuggagagaccucugugucagguuacacagaauuaccuccacugagucuacaggagagcgaacagcucguaccggaguccucuuguaacauggauaaucaucagucgcugucaacuauuaacaaacuuacgaaggugauauggaggaaaaaggccaaucaagaaagcgcgaaccagaauaguuucgaggucguggaguccgaaguuucuuuuaaaggccugugcauguugaagcaccggaugguggaggaaagcuaucgcaaccgacguuccgucaucuguuacgaccucgcuugcaauucaaccuucuguaagcccacaguguauaugauuguaccuauccaugccugcaacaugaugaaaaguugucugauugggcugggaccauacagaauccagguuguguaugagaggacuuacugcaccacaggcauacucaccgaggguaaguguuuuguccccgauaaagcaguggugagcgccuuaaagcgggggauguaugcuaucgcaucuauugaaacuaucugcuucuuuauucaccagaaaggaaauacauacaagaucgucaccgccauaacguccgcuaugggcucaaaguguaacaauacugacaccaaaguucaaggcuacuauauuugcaucauugggggaaacagcgccccuguguacgcgccagccggugaggauuuccgcgcaauggaaguauuuaguggcaucaucacaucuccccauggggaggaccacgaucugccuggagaagagauugcuacuuaucagauauccggccagaucgaggccaagauuccacacaccgugagcucgaaaaaucuuaaguugacagcauucgcugguaucccgucuuacuccucaaccaguauacuggccgcgagcgaagacgggagauuuauuuucucccccggacuauucccuaaccucaaccagucugucugcaauaacaaugcccugccacuuaucuggaggggccugaucgauuugacgggcuauuacgaggcagugcaucccuguaacguuuucugcgugcucagcgggccuggagcuucaugugaagccuucagugaggguggcauuuuuaauaucacuuccccaaugugccuggucagcaaacaaaaccgguuccgcgcugccgaacagcagauuucuuuugugugucaacgaguagacauggauauaaucguuuauugcaaugggcagaagaaaacaauuuuaaccaagacucuggugaucggacaguguaucuacacaauuaccucacucuucagucuucugcccggcgucgcacacagcauagccaucgaguugugcgugccggguuuucaugggugggcuacggcggcacuacugauuaccuucuguuuuggcuggguccucaucccugccugcacacuggcuauucuucugguguugaaguucuuugccaacauccuccacacuuccaaucaggagaacagauucaaagcaauacugaggaagaucaaagaagaguuugaaaagaccaaaggaucuaugguuugugagauuugcaaguacgaaugcgagacauuaaaggagcugaaagcccacaaucuaucgugugugcaaggcgaaugccccuauuguuucacucauugcgagccaaccgaaacagcuauccaggcccacuacaagguaugucaggcaacccaucgguuccgugaggaccucaaaaagacugucacgccucagaacauugggcccggaugcuaucgcacacugaaucuuuuuagauacaaauccagguguuauaucuugaccauguggacucugcuccugauaguggagagcauucuuugggcggcuucagccgcagaaaucccacugguucccuuguggaccgauaacgcccacggugugggcagugucccuaugcauacagaccucgagcuggacuucucuuuaccaagcuccucaaaguacaccuauaagcggcaccugacuaauccggugaacgaucaacagagcguaucucuacacauugaaaucgagucccaggggauaggagcugacgugcaucaccucggccauugguacgaugcccgacugaaccuuaaaacaaguuuucacugcuacggugcauguacgaaguaucaguaccccuggcacaccgcuaaaugccauuucgaaaaggacuaugaguacgagaauagcugggccuguaacccuccagauugccccgggguuggcacuggaugcacagcguguggcuuguaucuggaccaacucaaaccugucgggaccgccuuuaagaucauuucugugcgcuacuccagaaaggugugcguccaguucggagaagaguaucuguguaaaacaaucgauaugaaugacugcuuuguuacuaggcacgcuaagauuuguaucauagguaccgugucaaaauucagucagggcgauacguuacuguuucuugggccaauggaaggaggcgguauuaucuucaagcauuggugcaccagcacaugucacuuuggggaccccggcgaugugaugggaccgaaagacaagccuuucaucugcccagaguuucccggccaguuccggaaaacuuguaacuucgcaaccacaccuguaugcgaauacgacgggaauauuaucucgggauacaagaaggucuuggccacuauugauuccuuucaaucuuucaacaccagcaauauacauuuuacggacgagcgcaucgaguggagagaucccgacggcaugcucagggaucacauuaacaucgugauuucaaaagacaucgauuucgaaaaucuggcugagaacccauguaagguuggucuacaggccgcaaauauagaaggggcguggggaaguggcguggguuuuacacugaccugccaggucucccucacugagugcccuacauuccugaccucuaucaaagccugugacauggcuauuugcuauggcgccgaaagcgugacucuuucccgugggcaaaacaccguuaagaucacaggaaaaggcgggcacucaggaagcaguuuuaaguguugccauggcaaggaguguucuuccacggguuugcaggcaagcgcuccccaccuggauaaagugaaugggauuucggaguuagaaaacgagaagguauacgacgauggagccccagaaugcggcgucaccuguugguucaaaaagucaggugagugggugaugggcaucauaaaugggaacugggugguccucauuguucugugcgugcuucuguuguuuucucucauccugcuaaguauccuguguccgguacggaaacauaagaaguccuga

SEQ ID NO: 10220 - RNA, 3402 nt, Artificial Sequence
  derived and/or modified CDS sequence (opt3) from SEOV(WuhanMm13)__JQ665886.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucaucgagagugaaguguccuucaaaggcuugugcaugcucaagcaccggaugguugaggaaucuuaucgcaaccgacguagcgugauuuguuacgaccuggccugcaauuccaccuuuuguaagcccacagucuauaugaucgugccuauucaugcaugcaacaugaugaaaucaugucugaucgggcucggaccauacagaauacagguaguuuaugagaggacuuacugcaccacaggcaucuuaaccgaggguaaguguuucgugcccgauaaagccgucgugagugcucugaagcgggggauguaugcaguggccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuucgcgcuauggaaguauucagcggcaucaucacaaguccccauggggaggaccacgaucuuccuggagaagagauugccacuuaucagauaucuggccagaucgaggcaaagauuccacacaccguguccagcaaaaauuugaagcugacagcuuuugccgguaucccgucguacucuuccaccucaauacuagcggccagugaagacgggagauucauuuuuagccccggacucuucccuaaccugaaccaguccgucugcgauaauaacgcacuuccacugaucuggaggggcuugaucgaccucacgggcuauuacgaggcugugcaucccuguaauguuuucugcgugcugucugggccuggagccagcugugaagccuuuucagaggguggcauuuucaacaucacuucaccaaugugcuuagucuccaaacaaaaucgguuucgcgccgcagaacagcagauuagcuucgugugucaacgaguagauauggacauaaucguuuauugcaacgggcagaagaaaacaauucugaccaagacucucgugaucggacaguguaucuacacaauuaccucucuguuuucacuuuugcccggcgucgcccacaguauagcuaucgagcuaugcgugccggguuuccaugggugggcgacggcagcccugcucaccacauuuuguuucggcuggguccugauuccugcuugcacucuugccauccuguuggugcucaaguuuuucgcaaauauucugcacaccagcaaccaggagaauagauuuaaagccaucuuaaggaagauaaaagaagaguucgaaaagacaaaaggauccaugguuugugagaucugcaaguacgaaugcgagacucugaaggagcuaaaagcucacaaccucucuugugugcaaggcgaaugccccuauuguuuuacccauugcgagccaacagaaaccgccauucaggcacacuacaagguaugucaggcgacucaucgguuccgugaggaucugaaaaagacggucacaccucagaauaucgggcccggaugcuaucgcacccuuaacuuguucagauacaaaucgagguguuauauucugacuauguggaccauccuccugauaauugagagcauccuuugggcugccuccgcagccgaaauuccacuggugcccuuguggacagacaaugcucacgguguuggcucagugccuaugcauaccgaccucgagcuggauuuuaguuuaccaucuagcuccaaguacacuuauaagcggcaccugacaaacccggucaaugaccaacagucagugagccuacacaucgaaauagagucucaggggaucggagccgauguacaucaccucggccauugguacgacgcacgacugaaccuuaaaacguccuuccacugcuacggugcuuguaccaaguaucaguaccccuggcacacugccaaaugccauuuugaaaaggauuaugaguacgagaacaguugggcguguaauccuccagacugccccggggugggcacaggaugcaccgccuguggcuuguaucuggaucaacucaaaccuguugggacagcuuucaagauuaucagcguccgcuacucuagaaaggugugcgugcaguuuggagaagaguaucuguguaaaacuauugacaugaacgauugcuucgucaccaggcacgcaaagaucuguauaauugguacgguuuccaaauuuucacagggcgacaccuuacuguuccuugggccaauggaaggaggcgguaucaucuuuaagcauuggugcacaaguacuugucacuucggggaucccggcgacgugaugggaccgaaagacaagccuuuuauuugcccagaguuccccggccaguuucggaaaaaguguaauuucgccaccacaccugugugcgaauacgaugggaacaucauuagcggauacaagaaaguauuggcuacuauagacucguuccaauccuuuaauaccucuaacauccauuucacggaugagcgcauugaguggagagaccccgauggcaugcucagggaccacaucaauauugucaucagcaaggauauagacuuugaaaaccuggccgagaauccauguaaagugggucuacaggcagcgaacaucgaaggggccuggggaucaggcguugguuucacacugaccugccaggugagucucacugagugcccuacauuucugaccuccauuaaggcuugugauauggccaucugcuauggcgcagaaucugucacucuuagccgugggcaaaauaccgugaaaauuacaggaaagggcgggcacuccggaaguagcuucaaguguugccauggcaaagaguguaguucuacggguuugcaggcuuccgcuccccaccuggacaagguuaacgggaucagcgaguuagaaaaugagaaaguguacgaugacggagcaccagaaugcggcauaaccuguugguuuaagaaaucgggugaguggguaaugggcauuaucaacgggaauugggucgugcucaucgcccugugcgugcuucuguuguucucacucauucugcuaucuauacuguguccgguccggaagcauaagaaaaguuga

SEQ ID NO: 10221 - RNA, 3402 nt, Artificial Sequence
  derived and/or modified CDS sequence (opt3) from SEOV(WuhanMm24)__JQ665887.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucauggagagugaaguguccuucaaaggcuugugcaugcucaagcaccggaugguugaggaaucuuaucgcaaccgacguagcgugaucuguuacgaccuggccugcaauuccaccuuuuguaagcccacagucuauaugauugugccuauccaugcaugcaacaugaugaaaucaugucugauugggcucggaccauacagaauccagguaguuuaugagaggacuuacugcaccacaggcauauuaaccgaggguaaguguuucgugcccgauaaagccgucgugagugcucugaagcgggggauguaugcaaucgccagcauugaaacuaucugcuuuuucauucaccagaaaggaaauacauacaagaucgugaccgcuauaacgucugccaugggcuccaaguguaacaauacugacaccaaaguccaaggcuacuauauuugcaucauugggggaaacucagcgccuguuuacgcaccagccggugaggauuuucgcgcuauggaaguguucagcggcaucaucacaaguccccauggggaggaccacgaucuuccuggagaagagauugccacuuaucagauaucuggccagaucgaggcaaagauuccacacaccguauccagcaaaaauuugaagcugacagcuuuugccgguaucccgucguacucuuccaccucaauacuagcggccagugaagacgggagauucauuuuuagccccggacucuucccuaaccugaaccaguccgugugcgauaauaacgcacuuccacugaucuggaggggcuugaucgaccucacgggcuauuacgaggcuguccaucccuguaauguguucugcguucugucugggccuggagccagcugugaagccuuuucagaggguggcauuuucaacaucacuucaccaaugugcuuaguguccaaacaaaaucgguuucgcgccgcagaacagcagauuagcuucgucugucaacgaguggauauggacauaaucguauauugcaacgggcagaagaaaacaauucugaccaagacucucguuaucggacaguguaucuacacaauuaccucucuuuuuagucuguugcccggcguggcccacaguauagcuaucgagcuaugcgucccggguuuccaugggugggcgacggcagcccugcucauuaccuuuuguuucggcugggugcugaucccugcuugcacacuugccauucuguugguccucaaguuuuucgcaaauauccugcacacuagcaaccaggagaauagauuuaaagccauauuaaggaagaucaaagaagaguucgaaaagaccaaaggauccauggugugugagauuugcaaguacgaaugcgagacacugaaggagcuaaaagcucacaaccucucuuguguucaaggcgaaugccccuauuguuuuacucauugcgagccaaccgaaacagccauccaggcacacuacaaggugugucaggcgacccaucgguuccgugaggaucugaaaaagacuguaacgccucagaauauugggcccggaugcuaucgcacacuuaacuuguucagauacaaaucgagguguuauauccugaccauguggacucuccugcuuauaauugagagcauccugugggcugccuccgcagccgaaauuccauuggucccccucuggaccgacaaugcucacggugugggcucaguuccuaugcauacagaccuggaguuagauuuuagucugccaucuagcucccgguacaccuauaagcgacaccuaacuaacccggugaaugaccaacagucagucagccuccacaucgaaauagagucucaggggaucggagccgaugugcaucaccugggccauugguacgacgcacgccuuaacuugaagacauccuuccacugcuacggugcuuguacgaaauaucaguaccccuggcacaccgccaagugccauuuugaaaaagauuaugaguacgagaacaguugggcguguaauccuccagacugccccgggguaggcacuggaugcacagccuguggccuguaucucgaucaacugaagccuguggggaccgcuuucaaaauuaucagcguuagauacucuaggaaggucugcgugcaguuuggagaagaguauuuauguaagacaauugacaugaacgauugcuucgugacucggcacgcaaaaaucuguauaauugguaccgucuccaaguuuucacagggcgacacgcugcuuuucuuggggccaauggaaggaggcgguaucaucuuuaaacauuggugcaccaguacaugucacuucggggaucccggcgacguuaugggaccgaaggacaaaccuuuuauuugcccagaguuccccggccaguuucgcaagaaauguaauuucgccacuagcccugugugcgaauacgaugggaacaucauuucgggauacaagaaggugcucgcuaccauagacuccuuccaaucuuuuaauacaagcaacauccauuucacugaugagagaauugaguggagggaccccgauggcaugcugcgugaccacaucaauauuguaaucucaaaagauauagacuuugaaaaccuagccgagaauccauguaaggucggucugcaggcagcgaacaucgaaggggccuggggaaguggcguggguuucacccucacgugccagguuucccugacagagugcccuaccuuucuuacuucuauuaaggcuugugauauggccaucugcuauggcgcagaaagcgugacauugucccgggggcaaaauaccgucaaaauuacuggaaaaggcgggcacucaggaagcaguuucaaguguugccauggcaaggaguguucucugaccgguuuacaggcuuccgcuccccaccucgacaaagugaacgggaucagcgagcuggaaaaugagaagguuuacgaugacggagcaccagaaugcggcauaacauguugguuuaaaaagucgggugagugggugaugggcauuaucaacgggaauuggguaguccuuaucgcccugugcguguugcuccuguucucacuaauucugcucucuauacuguguccggugcgaaaacauaagaagaguuga

SEQ ID NO: 10222 - RNA, 3402 nt, Artificial Sequence
  derived and/or modified CDS sequence (opt3) from SEOV(WuhanRf02)__JQ665888.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucaucgagagugaaguguccuucaaaggcuugugcaugcucaagcaccggaugguugaggaaucuuaucgcaaccgacguagcgugauuuguuacgaccuggccugcaauuccaccuuuuguaagcccacagucuauaugaucgugccuauucaugcaugcaacaugaugaaaucaugucugaucgggcucggaccauacagaauacagguaguuuaugagaggacuuacugcaccacaggcaucuuaaccgaggguaaguguuucgugcccgauaaagccgucgugagugcucugaagcgggggauguaugcaguggccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuucgcgcuauggaaguauucagcggcaucaucacaaguccccauggggaggaccacgaucuuccuggagaagagauugccacuuaucagauaucuggccagaucgaggcaaagauuccacacaccguguccagcaaaaauuugaagcugacagcuuuugccgguaucccgucguacucuuccaccucaauacuagcggccagugaagacgggagauucauuuuuagccccggacucuucccuaaccugaaccaguccgucugcgauaauaacgcacuuccacugaucuggaggggcuugaucgaccucacgggcuauuacgaggcugugcaucccuguaauguuuucugcgugcugucugggccuggagccagcugugaggcuuuuucagaagguggcauuuucaacaucacaaguccaaugugcuuagucuccaaacaaaaucgguuucgcgccgcagaacagcgaauuagcuucgugugucagagaguagauauggacauaaucguuuauugcaacgggcaaaagaaaacuauucugaccaagacucucgugaucggacaguguaucuacacaauuaccucuuuguuuucacuguugcccggcgucgcccacaguauagcuaucgagcuaugcgugccggguuuccaugggugggcgacggcagcccugcucaccacauuuuguuucggcuggguccugauuccugcuugcacucuugccauccuguuggugcucaaguuuuucgcaaauauucugcacaccagcaaccaggagaauagguuuaaagccaucuuacggaagauaaaagaagaguucgaaaagacaaaaggauccguugugugugagaucugcaaguacgaaugcgagacucugaaggagcuaaaagcucacaaccucucuuguguacagggcgaaugccccuauuguuuuacccauugcgagccaacagaaaccgccauucaagcacacuacaaggucugucaggcgacucaucguuuccgcgaggaucugaaaaagacggugacaccucagaauaucgggcccggaugcuauagaacccuuaacuuguucagguacaauucgcggccagacggucugacuauguggacccuccugcuuauuaucgagagcauacugugggcugccuccgcagccgaaauucccuugguuccucucugggcugacaacgcccacggcguggggucagucccaaugcauacagaucuggaguuagacuuuagucugccgucuagcuccaaauauaccuacaagcgacaccuaacuaaucccgugaacgaucagcaaucaguaagccuccacaucgaaauugagucucagggaaucggcgcagacgugcaucaccugggucauugguaugaugcucgccuuaacuugaagacauccuuccacuguuacggggccugcacgaaauaccaguauccuuggcacaccgcgaagugucauuuugaaaaagacuacgaguaugagaauaguugggccugcaacccacccgauuguccuggcguuggaacuggcugcacagcuugcgggcuguaccucgaccagcugaagccagucggaaccgcauucaaaauaaucagcgugagauauucuaggaagguguguguccaauuuggugaagaguacuuaugcaagacaauugauaugaaugacuguuucguuacucggcacgccaaaaucugcauuaucggcaccgugcccaaguuuucccagggggauacgcugcuuuucuugggaccgauggaaggcggugggauaauuuuuaaacauugguguaccucaacaugccacuucggcgacccuggagacgugaugggcccaaaggauaaacccuuuauccgcccugaguuccccgggcaguuuagaaagaaauguaacuucgcuacuaccccaguaugcggauaugacggcaauaucauuagugguuacaagaagguccucgccacaaucgauagcuuccagucguuuaacacuuccaauauucauuucaccgacgaaaggauagaguggcgugauccugacgggaugcugcgggaucacaucaacauugugaucucuaaagacauugauuuugagaaucuagcagaaaaccccuguaagguuggacugcaagcggccaauaucgagggcgcuugggguagcggcgugggguucacgcucacaugccaggucucacugaccgaauguccaacuuuucuuacaaguauaaaagccugcgacauggcaaucugcuacggagcugaguccgugaccuugucucgaggccagaacacuguuaagauuaccgggaaaggaggccacagcgguuccucauucaaguguugccaugggaaggaauguagcaguacaggacugcaagccucugcaccgcacuuagauaaagugaauggcaucuccgagcucgagaacgaaaagguauaugacgauggugccccugagugcggcauuacguguugguuuaaaaagagcggggaaugggucaugggaaucauaaauggcaacuggguggugcugauugcucuuugcguccugcuucucuucucgcugauccuacugucaauccucugucccguuagaaaacauaagaagucuuga

SEQ ID NO: 10223 - RNA, 3402 nt, Artificial Sequence
  derived and/or modified CDS sequence (opt3) from SEOV(WuhanRf07)__JQ665889.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucaucgagagugaaguguccuucaaaggcuugugcaugcucaagcaccggaugguugaggaaucuuaucgcaaccgacguagcgugauuuguuacgaccuggccugcaauuccaccuuuuguaagcccacagucuauaugaucgugccuauucaugcaugcaacaugaugaaaucaugucugaucgggcucggaccauacagaauacagguaguuuaugagaggacuuacugcaccacaggcaucuuaaccgaggguaaguguuucgugcccgauaaagccgucgugagugcucugaagcgggggauguaugcaguggccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuucgcgcuauggaaguauucagcggcaucaucacaaguccccauggggaggaccacgaucuuccuggagaagagauugccacuuaucagauaucuggccagaucgaggcaaagauuccacacaccguguccagcaaaaauuugaagcugacagcuuuugccgguaucccgucguacucuuccaccucaauacuagcggccagugaagacgggagauucauuuuuagccccggacucuucccuaaccugaaccaguccgucugcgauaauaacgcacuuccacugaucuggaggggcuugaucgaccucacgggcuauuacgaggcugugcaucccuguaauguuuucugcgugcugucugggccuggagccagcugugaggcuuuuucagaagguggcauuuucaacaucacuucaccaaugugcuuagucuccaaacaaaaucgguuucgcgccgcagaacagcagauuagcuucgugugucaacgaguagauauggacauaaucguuuauugcaacgggcagaagaaaacaauucugaccaagacucucgugaucggacaguguaucuacacaauuaccucucuguuuucacuuuugcccggcgucgcccacaguauagcuaucgagcuaugcgugccggguuuccaugggugggcgacggcagcccugcucaccacauuuuguuucggcuggguccugauuccugcuugcacucuugccauccuguuggugcucaaguuuuucgcaaauauucugcacaccagcaaccaggagaauagauuuaaagccaucuuaaggaagauaaaagaagaguucgaaaagacaaaaggauccaugguuugugagaucugcaaguacgaaugcgagacucugaaggagcuaaaagcucacaaccucucuugugugcaaggcgaaugccccuauuguuuuacccauugcgagccaacagaaaccgccauucaggcacacuacaagguaugucaggcgacucaucgguuccgugaggaucugaaaaagacggucacaccucagaauaucgggcccggaugcuaucgcacccuuaacuuguucagauacaaaucgaggccauauauucugacuauguggaccauccuccugauaauugagagcauccuuugggcugccuccgcagccgaaauuccccuggugccuuuguggacagacaaugcucacgguguuggcucagugccaaugcauaccgaccucgagcuggauuuuaguuuaccgucuagcuccaaguacacuuauaagcggcaccugacaaaccccgucaaugaccaacagucagugagccuacacaucgaaauagagucucaggggaucggagccgauguacaucaccucggccauugguacgacgcacgacugaaccuuaaaacguccuuccacuguuacggugcuugcaccaaguaucaguacccuuggcacacugccaaaugucauuuugaaaaggauuaugaguacgagaacaguugggcgugcaauccacccgacuguccuggggugggcacaggaugcaccgccugcggcuuguaucuggaucaacucaaaccaguugggacagcuuucaagauuaucagcguccgcuacucuagaaaggugugugugcaguuuggagaagaguaucugugcaaaacuauugacaugaacgauuguuucgucaccaggcacgcaaagaucugcauaauugguacgguuuccaaauuuucacagggcgacaccuuacuguuccuugggcccauggaaggaggcgguaucaucuuuaagcauugguguacaaguacuugccacuucggggauccgggcgacgugaugggaccuaaagacaagccauuuauuugucccgaguucccuggccaguuucggaaaaagugcaauuucgccaccacacccgugugugaauacgaugggaacaucauuagcggauacaagaaaguauuggcuacuauagacucguuccaauccuuuaauaccucuaacauccauuucacggaugagcgcauugaguggagagacccagauggcaugcucagggaccacaucaauauugucaucagcaaggauauagacuuugaaaaccuggccgagaauccuugcaaagugggucuacaggcagcgaacaucgaaggggccuggggaucaggcguugguuucacacugaccugucaggugagucucacugagugccccacauuucugaccuccauuaaggcuugcgauauggccaucuguuauggcgcagaaucugucacucuuagccgugggcaaaauaccgugaaaauuacaggaaagggcgggcacuccggaaguagcuucaagugcugucauggcaaagagugcaguucuacggguuugcaggcuuccgccccacaccuggacaagguuaacgggaucagcgaguuagaaaaugagaaaguguacgaugacggagcaccggaauguggcauaaccugcugguuuaagaaaucgggugaguggguaaugggcauuaucaacgggaauugggucgugcucaucgcccugugugugcuucuguuguucucacucauucugcuaucuauacugugcccuguccggaagcauaagaaaaguuga

SEQ ID NO: 10224 - RNA, 3402 nt, Artificial Sequence
  derived and/or modified CDS sequence (opt3) from SEOV(WuhanRf18)__JQ665893.1__GP
auguggagccugcuccuucuggccgcuuuggugggccaaggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucaucgagagugaaguguccuucaaaggcuugugcaugcucaagcaccggaugguugaggaaucuuaucgcaaccgacguagcgugauuuguuacgaccuggccugcaauuccaccuuuuguaagcccacagucuauaugaucgugccuauucaugcaugcaacaugaugaaaucaugucugaucgggcucggaccauacagaauacagguaguuuaugagaggacuuacugcaccacaggcaucuuaaccgaggguaaguguuucgugcccgauaaagccgucgugagugcucugaagcgggggauguaugcaguggccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuucgcgcuauggaaguauucagcggcaucaucacaaguccccauggggaggaccacgaucuuccuggagaagagauugccacuuaucagauaucuggccagaucgaggcaaagauuccacacaccguguccagcaaaaauuugaagcugacagcuuuugccgguaucccgucguacucuuccaccucaauacuagcggccagugaagacgggagauucauuuuuagccccggacucuucccuaaccugaaccaguccgucugcgauaauaacgcacuuccacugaucuggaggggcuugaucgaccucacgggcuauuacgaggcugugcaucccuguaauguuuucugcgugcugucugggccuggagccagcugugaagccuuuucagaggguggcauuuucaacaucacuucaccaaugugcuuagucuccaaacaaaaucgguuucgcgccgcagaacagcgaauuagcuucgugugucagagaguagauauggacauaaucguuuauugcaacgggcaaaagaaaacaauucugaccaagacucucgugaucggacaguguaucuacacaauuaccucucuguuuucacuuuugcccggcgucgcccacaguauagcuaucgagcuaugcgugccggguuuccaugggugggcgacggcagcccugcucaccacauuuuguuucggcuggguccugauuccugcuugcacucuugccauccuguuggugcucaaguuuuucgcaaauauucugcacaccagcaaccaggagaauagguuuaaagccaucuuacggaagauaaaagaagaguucgaaaagacaaaaggauccaugguuugugagaucugcaaguacgaaugcgagacucugaaggagcuaaaagcucacaaccucucuugugugcagggcgaaugccccuauuguuuuacccauugcgagccaacagaaaccgccauucaagcacacuacaagguaugucaggcgacucaucguuuccgcgaggaucugaaaaagacggucacaccucagaauaucgggcccggaugcuauagaacccuuaacuuguucagguacaaaucgcgguguuauauucugacuauguggaccauccuccugauaauugagagcauccuuugggcugccuccgcagccgaaauuccacuggugcccuuguggacagacaaugcucacgguguuggcucagugccuaugcauaccgaccucgagcuggauuuuaguuuaccaucuagcuccaaguacacuuauaagcgacaccugacaaacccggucaaugaccagcaaucagugagccuacacaucgaaauagagucucaggggaucggagccgauguacaucaccucggccauugguacgacgcacgccugaaccuuaaaacguccuuccacugcuacggugcuuguaccaaguaucaguaccccuggcacacugccaaaugccauuuugaaaaggauuaugaguacgagaacaguugggcguguaauccuccagacugccccggggugggcacaggaugcaccgccuguggcuuguaucuggaucagcucaaaccuguugggacagcuuucaagauuaucagcgucagauacucuaggaaggugugcgugcaauuuggagaagaguaucuguguaaaacuauugacaugaacgauugcuucgucacccggcacgcaaagaucuguauaauugguacgguuuccaaauuuucacagggcgacaccuuacuguuccuugggccaauggaaggaggcgguaucaucuuuaagcauuggugcacaaguacuugucacuucggggaucccggcgacgugaugggaccgaaagacaagccuuuuauuugcccagaguuccccggccaguuucgcaaaaaguguaauuucgccaccacaccugugugcgaauacgaugggaacaucauuagcggauacaagaaaguauuggcuacuauagacucguuccaguccuuuaauaccucuaacauccauuucacggaugagagaauugaguggagggaccccgauggcaugcuccgugaccacaucaauauugucaucagcaaggauauagacuuugaaaaccuggccgagaauccauguaaagugggucuacaagcagcgaacaucgaaggggccuggggaucaggcguugguuucacacugaccugccaggugagucucacugagugcccuacauuucugaccuccauuaaggcuugugauauggccaucugcuauggcgcagaaucugucacucuuagccgggggcagaauaccgugaaaauuacaggaaagggcgggcacuccggaaguagcuucaaguguugccauggcaaagaguguaguucuacggguuugcaggcuuccgcuccccaccuggacaagguuaacgggaucagcgaguuagaaaaugagaaaguguacgaugacggagcaccagaaugcggcauaaccuguugguuuaagaaaucgggugaguggguaaugggcauuaucaacgggaauugggucgugcucaucgcccugugcgugcuucuguuguucucacucauucugcuaucuauacuguguccgguccgaaagcauaagaaaaguuga

SEQ ID NO: 10225 - RNA, 3402 nt, Artificial Sequence
  derived and/or modified CDS sequence (opt3) from SEOV(WuhanRn10)__JQ665896.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucaucgagagugaaguguccuucaaaggcuugugcaugcucaagcaccggaugguugaggaaucuuaucgcaaccgacguagcgugauuuguuacgaccuggccugcaauuccaccuuuuguaagcccacagucuauaugaucgugccuauucaugcaugcaacaugaugaaaucaugucugaucgggcucggaccauacagaauacagguaguuuaugagaggacuuacugcaccacaggcaucuuaaccgaggguaaguguuucgugcccgauaaagccgucgugagugcucugaagcgggggauguaugcaguggccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuucgcgcuauggaaguauucagcggcaucaucacaaguccccauggggaggaccacgaucuuccuggagaagagauugccacuuaucagauaucuggccagaucgaggcaaagauuccacacaccguguccagcaaaaauuugaagcugacagcuuuugccgguaucccgucguacucuuccaccucaauacuagcggccagugaagacgggagauucauuuuuagccccggacucuucccuaaccugaaccaguccgucugcgauaauaacgcacuuccacugaucuggaggggcuugaucgaccucacgggcuauuacgaggcugugcaucccuguaauguuuucugcgugcugucugggccuggagccagcugugaagccuuuucagaggguggcauuuucaacaucacuucaccaaugugcuuagucuccaaacaaaaucgguuucgcgccgcagaacagcagauuagcuucgugugucaacgaguagauauggacauaaucguuuauugcaacgggcagaagaaaacaauucugaccaagacucucgugaucggacaguguaucuacacaauuaccucucuguuuucacuuuugcccggcgucgcccacaguauagcuaucgagcuaugcgugccggguuuccaugggugggcgacggcagcccugcucaccacauuuuguuucggcuggguccugauuccugcuugcacucuugccauccuguuggugcucaaguuuuucgcaaauauucugcacaccagcaaccaggagaauagauuuaaagccaucuuaaggaagauaaaagaagaguucgaaaagaacaaaggauccguugugugugagaucugcaaguacgaaugcgagacacugaaggagcuaaaagcucacaaucucucuuguguacaaggcgaaugccccuauuguuuuacucauugcgagccaaccgaaacagccauucaggcacacuacaaggucugucaggcgacccaucgguuccgugaggaucugaaaaagacugugacgccucagaacaucgggcccggaugcuaucgcacacuuaauuuguucagauacaaaucgagguguuauauucugaccauguggacuauccuccugauaauugagagcauccuuugggcugccuccgcagccgaaauuccacugguucccuuguggaccgacaacgcucacggugugggcucagucccuaugcauacagaccucgagcuggauuuuaguuuaccaucuagcuccaaguacaccuauaagcggcaccugacuaauccggugaacgaccaacagucaguaagccuacacaucgaaauagagucucaggggaucggagccgaugugcaucaccucggccauugguacgacgcacgacugaaccuuaaaacauccuuccacugcuacggugcuuguacgaaguaucaguaccccuggcacaccgccaaaugccauuuugaaaaggauuaugaguacgagaauaguugggcguguaacccuccagacugccccgggguuggcacuggaugcacagccuguggcuuguaucuggaucaacucaaaccugucgggaccgcuuucaagauuaucagcgugcgcuacucuagaaaggugugcguccaguuuggagaagaguaucuguguaaaacaauugacaugaaugauugcuucguuacuaggcacgcaaagaucuguauaauugguaccguguccaaauuuucacagggcgacacguuacuguuccuugggccaauggaaggaggcgguaucaucuuuaagcauuggugcaccaguacaugucacuucggggaucccggcgacgugaugggaccgaaagacaagccuuuuauuugcccagaguuccccggccaguuucggaaaaaguguaacuucgccacuaccccuguaugcgaauacgaugggaauaucauuagcggauacaagaaagucuuggcuacaauagacucguuccaauccuuuaacacuucuaauauccauuucaccgaugagcgcauugaguggagagaccccgauggcaugcucagggaccacaucaacauugugaucagcaaggauauagacuuugaaaaucuggccgagaacccauguaaaguuggucuacaggcagcgaauaucgaaggggccuggggaucaggcguggguuucacgcugacaugccaggucagucucaccgagugcccuacuuuucugacauccauuaaggcuugugauauggccaucugcuauggcgcagaaucugugacccuuagccgugggcaaaacacuguuaaaauuaccggaaagggcgggcacuccggaaguagcuucaaguguugccauggcaaagaguguaguucuacagguuugcaggcuuccgcuccccaccuggacaaggugaaugggaucagcgaguuagaaaacgagaaaguauacgaugacggagcaccagaaugcggcauaacguguugguuuaagaaaucgggugagugggucaugggcauuaucaaugggaacuggguggugcucaucgcccugugcguccuucuguuguucucacucauucugcuaucuauacuguguccgguucggaagcauaagaaaaguuga

SEQ ID NO: 10226 - RNA, 3402 nt, Artificial Sequence
  derived and/or modified CDS sequence (opt3) from SEOV(WuhanRn25)__JQ665897.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucaucgagagugaaguguccuucaaaggcuugugcaugcucaagcaccggaugguugaggaaucuuaucgcaaccgacguagcgugauuuguuacgaccuggccugcaauuccaccuuuuguaagcccacagucuauaugaucgugccuauucaugcaugcaacaugaugaaaucaugucugaucgggcucggaccauacagaauacagguaguuuaugagaggacuuacugcaccacaggcaucuuaaccgaggguaaguguuucgugcccgauaaagccgucgugagugcucugaagcgggggauguaugcaguggccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuucgcgcuauggaaguauucagcggcaucaucacaaguccccauggggaggaccacgaucuuccuggagaagagauugccacuuaucagauaucuggccagaucgaggcaaagauuccacacaccguguccagcaaaaauuugaagcugacagcuuuugccgguaucccgucguacucuuccaccucaauacuagcggccagugaagacgggagauucauuuuuagccccggacucuucccuaaccugaaccaguccgucugcgauaauaacgcacuuccacugaucuggaggggcuugaucgaccucacgggcuauuacgaggcugugcaucccuguaauguuuucugcgugcugucugggccuggagccagcugugaagccuuuucagaggguggcauuuucaacaucacuucaccaaugugcuuagucuccaaacaaaaucgguuucgcgccgcagaacagcagauuagcuucgugugucaacgaguagauauggacauaaucguuuauugcaacgggcagaagaaaacaauucugaccaagacucucgugaucggacaguguaucuacacaauuaccucucuguuuucacuuuugcccggcgucgcccacaguauagcuaucgagcuaugcgugccggguuuccaugggugggcgacggcagcccugcucaccacauuuuguuucggcuggguccugauuccugcuugcacucuugccauccuguuggugcucaaguuuuucgcaaauauucugcacaccagcaaccaggagaauagauuuaaagccaucuuaaggaagauaaaagaagaguucgaaaagaacaaaggauccaugguuugugagaucugcaaguacgaaugcgagacacugaaggagcuaaaagcucacaaucucucuugugugcaaggcgaaugccccuauuguuuuacucauugcgagccaaccgaaacagccauucaggcacacuacaagguaugucaggcgacccaucgguuccgugaggaucugaaaaagacugucacgccucagaacaucgggcccggaugcuaucgcacacuuaauuuguucagauacaaaucgagguguuauauucugaccauguggacuauccuccugauaauugagagcauccuuugggcugccuccgcagccgaaauuccacuggugcccuuguggaccgacaacgcucacgguguuggcucagugccuaugcauacagaccucgagcuggauuuuaguuuaccaucuagcuccaaguacaccuauaagcggcaccugacuaauccggucaacgaccaacagucagugagccuacacaucgaaauagagucucaggggaucggagccgauguacaucaccucggccauugguacgacgcacgacugaaccuuaaaacauccuuccacugcuacggugcuuguacgaaguaucaguaccccuggcacaccgccaaaugccauuuugaaaaggauuaugaguacgagaauaguugggcguguaacccuccagacugccccggggugggcacuggaugcacagccuguggcuuguaucuggaucaacucaaaccuguugggaccgcuuucaagauuaucagcguccgcuacucuagaaaggugugcgugcaguuuggagaagaguaucuguguaaaacaauugacaugaaugauugcuucgucacuaggcacgcaaagaucuguauaauugguaccguuuccaaauuuucacagggcgacacguuacuguuccuugggccaauggaaggaggcgguaucaucuuuaagcauuggugcaccaguacaugucacuucggggaucccggcgacgugaugggaccgaaagacaagccuuuuauuugcccagaguuccccggccaguuucggaaaaaguguaacuucgccacuaccccugugugcgaauacgaugggaauaucauuagcggauacaagaaaguauuggcuacaauagacucguuccaauccuuuaacacuucuaauauccauuucaccgaugagcgcauugaguggagagaccccgauggcaugcucagggaccacaucaacauugucaucagcaaggauauagacuuugaaaaucuggccgagaacccauguaaagugggucuacaggcagcgaauaucgaaggggccuggggaucaggcguugguuucacgcugacaugccaggugagucucaccgagugcccuacuuuucugacauccauuaaggcuugugauauggccaucugcuauggcgcagaaucugucacccuuagccgugggcaaaacacugugaaaauuaccggaaagggcgggcacuccggaaguagcuucaaguguugccauggcaaagaguguaguucuacagguuugcaggcuuccgcuccccaccuggacaagguuaaugggaucagcgaguuagaaaacgagaaaguguacgaugacggagcaccagaaugcggcauaacguguugguuuaagaaaucgggugaguggguaaugggcauuaucaaugggaacugggucgugcucaucgcccugugcgugcuucuguuguucucacucauucugcuaucuauacuguguccgguccggaagcauaagaaaaguuga

SEQ ID NO: 10227 - RNA, 3402 nt, Artificial Sequence
  derived and/or modified CDS sequence (opt3) from SEOV(XiaotangshanRn7)__GU592929.1__GP
auguggagccuccuguuccuugccgcucuggugggccagggguuugcauugaagaacgucuucgacaugagaauccaaugcccccacuccguuaauuuuggagagaccucugugucagguuacacagaauuaccuccacugagucuacaggaggccgaacagcucguaccggagagcuccuguaacauggauaaucaucagucucugucgacuauuaacaaacuuacgaaggugauauggaggcggaaagcgaaucaagaaucagcuaaccagaauagcuucgaggucguggagagugaaguuuccuuuaagggccugugcauguugaaacaccgcaugguggaggaaucuuaucgaaaccguagaagcgucaucuguuacgaccucgccugcaauuccaccuucuguaagcccacaguguauaugauuguaccuauccaugcaugcaacaugaugaagucaugucugauugggcugggaccauacaggauccagguuguguaugagcggacuuacugcaccacaggcauacucaccgaggguaaauguuuuguccccgauaaggccguggugagugcuuuaaaacgcgggauguaugcaaucgccagcauugaaacuaucugcuucuuuauucaccagaagggaaauacauacaaaaucgucaccgcuauaacgucugccaugggcuccaaguguaacaauacugacaccaagguucaaggcuacuauauuugcaucauugggggaaacucagcgccuguguacgcaccagccggugaggauuucagagcuauggaaguauuuagcggcaucaucacaaguccccauggggaggaccacgaucugccuggagaagagauugccacuuaucagauaucuggccagaucgaggcaaaaauuccacacaccguguccagcaagaaucuuaaauugacagcuuucgccgguaucccgucguacucuuccaccucaauacuggcggccagugaagacgggagguuuauuuucagccccggacuauucccuaaccucaaccaguccgucugcgauaauaacgcacugccacuuaucuggcggggccugaucgacuugacgggcuauuacgaggcugugcaucccuguaauguguuuugcguucucucugggccuggagccagcugugaagccuucucagaggguggcauuuuuaacaucacuucaccaaugugccuggucuccaagcaaaaucgcuuccgagccgcagaacagcagauuagcuuugugugucaaagaguagauauggacauaaucguuuauugcaacgggcagaaaaagacaauuuuaaccaaaacucuggugaucggacaguguaucuacacaauuaccucucucuucucacuucugcccggcgucgcccacaguauagcuaucgaguugugcgugccggguuuucaugggugggcgacggcagcccuacugauuaccuucuguuuuggcuggguccucaucccugcuugcacacuggccauucuucugguguugaaguucuuugcaaauauccuccacacuagcaaccaggagaauagguucaaggccauacugcggaaaaucaaggaagaguuugagaaaaccaagggauccaugguuugugaaauuugcaaauacgaaugcgagacauuaaaggagcugaaggcucacaaccuaucuugugugcaaggcgaaugccccuauuguuucacucauugcgagccaaccgaaacagccauccaggcacacuacaaaguaugucaggcgacccaucguuuccgcgaggaucucaagaaaacugucacgccucagaauauugggcccggaugcuauagaacacugaaccuuuuuagguacaagucgcgguguuauaucuugaccauguggacucugcuccugauaauugagagcauccuuugggcugccuccgcagccgaaauuccacuggugcccuuguggaccgacaaugcucacgguguuggcucagugccuaugcauacagaccucgagcuggauuucaguuuaccaucuagcuccaaauacaccuauaagcgacaccugacuaacccggucaaugaccaacagucagugagccuacacaucgaaauagagucucaggggaucggagccgauguacaucaccucggccauugguacgacgcacgccugaaccuuaagacauccuuucacugcuacggugcuuguacgaaauaucaguaccccuggcacaccgccaagugccauuucgaaaaagauuaugaguacgagaacaguugggcguguaauccuccagacugccccggggugggcacuggaugcacagccuguggcuuguaucuggaucaacucaagccuguugggaccgcuuuuaaaauuaucagcgucagauacucuaggaaggugugcgugcaguucggagaagaguaucuguguaagacaauugacaugaacgauugcuuugucacucggcacgcaaaaaucuguauaauugguaccguuuccaaguucucacagggcgacacguuacuguuucuugggccaauggaaggaggcgguaucaucuucaaacauuggugcaccaguacaugucacuuuggggaucccggcgacgugaugggaccgaaggacaaaccuuucauuugcccagaguuucccggccaguuccgcaagaaauguaauuucgccacuaccccugugugcgaauacgaugggaacaucauuagcggauacaagaagguauuggcuacaauagacucguuucaauccuucaauacuucuaacauccauuuuaccgaugagagaauugaguggagggaccccgauggcaugcuccgugaccacaucaauauugucaucagcaaagauauagacuucgaaaaccuggccgagaauccauguaaggugggucuacaggcagcgaacaucgaaggggccuggggaucaggcguugguuuuacgcugacaugccaggugagucucaccgagugcccuacuuuccugacauccauuaaggcuugugauauggccaucugcuauggcgcagaaucugucacccuuagccgggggcaaaauacugugaaaauuaccggaaaaggcgggcacuccggaaguagcuuuaaguguugccauggcaaggaguguaguucuacagguuugcaggcuuccgcuccccaccuggacaaaguuaacgggaucagcgaguuagaaaaugagaagguguacgaugacggagcaccagaaugcggcguaacguguugguucaaaaagucgggugagugggucaugggcauaauuaacgggaauuggguggugcucaucguccugugcguucuucuguuguuuucacucauccugcuaucuauucuguguccggugcgaaaacauaagaagaguuga

SEQ ID NO: 10228 - RNA, 3402 nt, Artificial Sequence
  derived and/or modified CDS sequence (opt3) from SEOV(YongjiaRf45)__GU592926.1__GP
auguggggccugcuccuucuggccgcuaugguggggcagggaagcgcauugaagaacgucuucgacaugaaaauccaaugcccccacuccguuaauuuuggugagaccucugugucaggcuacacagaauuaccuccacugccgcuacaggaggccgaacagcucguacccgagaguagcuguaacauggauaaucaucagucccugucuacuauuaacaaguugacgaaagugauauggagaaagaaagcgaaucaagaaucggcuucacagaacagcuucgaggucguggagagugaaguuuccuuuaaggggcugugcauguugaagcacaggaugguggaggaaucuuaucggaaucgccgaagcgucaucuguuacgaccucgccugcaacaccacauucuguaaaccuacuguguauaugauuguaccaauccaugcaugcaauaugaugaaguccugucugauuggacugggccccuaccguauccagguuauauaugagagaaccuacugcucaacagguauccucaccgaggggaaauguuuugugcacgauaagacugucgugagugccuuaaaaaggggaauguaugcuauugcaagcaucgaaacagugugcuucuuuguccaucagaagggcaacaccuacaagauuguuacggccaucacuucugcuaugggcuccaaauguaauaacaccgacucaaaggugcaaggguacuauauaugcauuaucggagguaauagcgccccuguauacgcgccagcaggcgaggauuuccgggccauggaaguguuuagugggauuaucacaucuccccacggagaggaccacgaucugccuggcgaagaggucgcuacuuaucagaucuccggucagauugaggccaaaauaccacauaccgugagcucgaagaaccuuaaauugacagcauucgcugggaucccgucuuacuccucaaccagucugcuagccgcgagcgaagacggacgcuuuauuuucucccccggccucuuuccuaaucugaaccagucuguuugcgauaacaaugcccuuccacugaucuggagaggcuugauagaccucacgggguauuacgaggcagugcaccccuguaacgucuucugcgugcugagcggaccuggugcuucaugugaagccuucagugagggcgggauuuuuaauaucacuuccccaaugugcuuaguaagcaagcaaaacagguuccgggcugccgaacagcagaucucuuuuauuugucaacgcguugauauggacaucauuguguauugcaauggacagaaaaagacaauacugaccaagacucucgucaucggccaguguauuuacacaaucaccucacuuuucagucuguugcccgguguggcacauagcaucgccauugagcuaugcgucccgggguuucacggcugggcuacggcggcacugcucauaaccuucuguuuuggaugggugcugaucccugccugcacacuugcuguucuguuguuccucaaauuuuucgccaacauucugcacacuuccaaucaggagaaccgauuuaaggcaaucuuaagaaaaauuaaggaagaguucgaaaagaccaagggcucuauggugugugagaucugcaaguacgaaugcgagacacugaaagagcuaaaggcccauaaucucucguguguacaaggggaaugccccuauuguuuuacucacugcgagccaaccgaaacagcuauacaggcccauuacaaagucugucaggcaacccacagguuccgggaggaucugaagaaaacugugacgccucagaacaucggacccgguugcuaucguacacuuaauuuguuccgcuacaagagcagauguuauauucugaccauguggauccuccugcuuguuauugaguccauccugugggcggcuucagccgcagaaauaccauuggugccccucuggacugacaacgcccauggcgucgggagugugccuaugcacaccgaccuggaguuagauuuuucucugccaagcuccucaaaguacacauauaaaaggcaccuaaccaauccgguaaacgaccaacagagcgugucucuccauauugaaaucgagucccagggaauuggcgcugauguucaccaucugggucacugguacgacgcccggcuuaauuugaagaccaguuuccacugcuacggggcauguacaaaauaucaguaccccuggcauacggcuaagugcuauuuugaaaaagauuacgaguaugagaacagcugggccuguaacccuccagacugccccggcgucggaaucggcugcaccgcgugugggcuguaccucgaucaacugaagccugugggaacugccuucaagauaaucucugugcgauauucccgcaaagucugcguucaguuuggugaagaguacuuauguaagacaauugacaugaaugauugcuucgugaccagacacgcuaaaaucuguauuaucggcacagugucaaaguuuagucagggggacacucugcuuuucuugggaccaauggaaggcggugggauaauuuuuaaacauuggugcaccagcacgugucacuucggcgaucccggagacguaaugggcccgaaggacaaaccuuuuaucugcccagaguuccccgggcaguuuaggaagaaguguaacuucgcaaccacaccugucugcgaauacgauggaaauguguucucgggcuaucggaaauuucucgccacuaucgacuccuuccaaucuuuuaacaccagcaauguucauuucacagaugagcgcauugaguggagagaccccgaugguaugcugagggaccacaucaacauugugauaucaaaggauaucgacuuugaaaaucuagcugauaacccauguaaagucgggcugcaggccgcaaauauugagggagcguggggcaguggugugggcuucacucucacuugccagguuucccugacggaaugcccuacauuucuuaccucuaucaaggccugugacauggcuauuugcuacggggccgagagcgugacuuugucccguggacaaaacacaguaaaaaucaccggcaaagggggacacucaggcagcaguuucaaguguugccaugguaaagaauguucuuccaaugggcugcaggcaagcgcuccccacuuagauaaggucaacggaauaucggagcucgagaaugaaaaaguguaugacgauggcgccccagagugcgguaucacuuguugguuuaagaaaucaggcgaaugggugauggggauuaucaacggaaauuggauuguccugaucguucuuugcgugcugcuucucuucucucugauacuacugaguauucucuguccgguacggaagcauaagaaauccuga

SEQ ID NO: 10229 - RNA, 3402 nt, Artificial Sequence
  derived and/or modified CDS sequence (opt3) from SEOV(YongjiaRn14)__GU592927.1__GP
auguggggccugcuccuucuggccgcuaugguggggcagggaagcgcauugaagaacgucuucgacaugaaaauccaaugcccccacuccguuaauuuuggugagaccucugugucaggcuacacagaauuaccuccacugccgcuacaggaggccgaacagcucguacccgagaguagcuguaacauggauaaucaucagucccugucuacuauuaacaaguugacgaaagugauauggagaaagaaagcgaaucaagaaucggcuucacagaacagcuucgaggucguggagagugaaguuuccuuuaaggggcugugcauguugaagcacaggaugguggaggaaucuuaucggaaucgccgaagcgucaucuguuacgaccucgccugcaacaccacauucuguaaaccuacuguguauaugauuguaccaauccaugcaugcaauaugaugaaguccugucugauuggacugggccccuaccguauccagguuauauaugagagaaccuacugcacaaccgguauccucacugaggggaaauguuuugugccugauaaggccgucgugucagcuuuaaaaaggggaauguaugcaauugccaguaucgaaacagugugcuucuuuguccaccagaagggcaacaccuacaagauuguuacggcuaucacuagcgccaugggcucuaaauguaauaacaccgacuccaaggugcaaggguacuauauaugcauuaucggagguaauucagcgccaguauacgcacccgccggcgaggauuuccgggcuauggaaguguuuagcgggauuaucacaaguccucauggagaggaccacgaucugccaggcgaagaggucgccacuuaucagaucucuggucagauugaggcaaaaauaccgcacaccguguccagcaagaaccuuaaauugacagcuuucgccgggauccccucguacucuuccaccucacugcuagcggccagugaagacggacgcuuuauuuucagcccuggccucuuuccaaaucugaaccaguccguuugcgauaacaaugcacuuccccugaucuggagaggcuugauagaccucacgggguauuacgaggcugugcauccuuguaacgucuucugcgugcugucuggaccaggugccagcugugaggcuuucucagaaggcgggauuuuuaauaucacuucacccaugugcuuaguauccaagcaaaacagguuccgggccgcagaacagcagaucagcuuuauuugucaacgcguugauauggacaucauuguguauugcaauggacagaaaaagacaauacugaccaagacucucgucaucggccaguguauuuacacaaucaccucucuuuucucacuguugccggguguggcccacaguaucgcuauugagcuaugcgucccuggguuucauggcugggcgacggcagcccugcucauaaccuucuguuuuggaugggugcugauccccgcuugcacacuugccguucuguuguuccucaaauuuuucgcaaacauucugcacacuagcaaucaggagaaccgauuuaaggccaucuuaagaaaaauuaaggaagaguucgaaaagaccaagggcuccauggugugugagaucugcaaguacgaaugcgagacacugaaagagcuaaaggcucacaaucucucuuguguacaaggggaaugcccauauuguuuuacucauugcgagccuaccgaaacagccauacaggcacacuacaaagucugucaggcgacccauagguuccgggaggaucugaagaaaacugugacgccccagaacaucggaccagguugcuaucguacacuuaauuuguuccgcuacaagucgagauguuauauucugaccauguggauccuccugcuuguuauugagagcauccugugggcugccuccgcagccgaaauacccuuggugccucucuggacugacaacgcucacggcgucgggucagugccaaugcauaccgaccuggaguuagauuuuagucugccgucuagcuccaaguacacauauaaaaggcaccuaaccaaucccguaaacgaccaacagucagugagccuccacauugaaaucgagucucagggaauuggcgccgauguucaucaccugggucauugguacgacgcacggcuuaauuugaagacuuccuuccacugcuacggggcuuguacaaaauaucaguacccuuggcacacggccaagugccauuuugaaaaagauuaugaguacgagaacaguugggcguguaacccacccgacugcccuggcgucggaaccggcugcacugccugugggcuguaucucgaucaacugaagccagugggaacagcuuucaagaucauaagcgugcgauacucucgcaaagucugcguucaguuuggugaagaguauuuauguaagaccaucgacaugaaugauugcuucgugacaagacacgcaaaaauuuguaucauuggcacuguguccaaguuuucacagggggacacccugcuuuucuugggacccauggaaggcggugggaucauauuuaaacauuggugcacgaguaccugucacuucggcgauccgggagacguaaugggcccuaaggacaaaccauuuauuugccccgaguucccugggcaguuuaggaagaaguguaacuucgccacaacucccgucugcgaauacgauggaaaugugaucagcggcuaccggaaaguucucgcuaccaucgacucguuccaauccuuuaacacaucuaaugugcauuucacugaugagcgcauugaguggagagacccagaugguaugcugagggaccacaucaacauugucauaagcaaggauaucgacuuugaaaaucuagccgagaacccuuguaaaguggggcugcaggcagcgaauauugaaggagccuggggcucagguguuggcuucacccucacgugccaggugagucugacagagugccccaccuuucuuacuuccaucaaggcuugugauauggccauuugcuauggggcagaaucuguaacauugagccguggacaaaacaccgucaaaaucacuggcaaagggggacacuccggcaguagcuucaaguguugccaugguaaagaguguaguucuaaugggcugcaggcuuccgccccacacuuagacaaggugaacggaauaagcgagcucgaaaaugagaaaguguacgaugacggcgcaccggaaugcgguaucaccuguugguuuaagaaaucgggcgagugggucauggggauuaucaacggaaauuggauuguucugaucgugcuuugcguacugcuucucuucucacugauacuacugucuauucucuguccugugcggaagcauaagaaaaguuga

SEQ ID NO: 10230 - RNA, 3402 nt, Artificial Sequence
  derived and/or modified CDS sequence (opt3) from SEOV(ZT10)__DQ159911.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucguggagagugaaguuuccuucaaaggcuugugcaugcucaagcaccggaugguggaggaaucuuaucgcaaccgacguagcgucaucuguuacgaccuggccugcaauuccaccuuuuguaagcccacaguguauaugauuguaccuauccaugcaugcaacaugaugaaaucaugucugauugggcucggaccauacagaauccagguuguguaugagaggacuuacugcaccacaggcauauuaaccgaggguaaguguuucguccccgauaaagccguggugagugcucugaagcgggggauguaugcaaucgccagcauugaaacuaucugcuuuuucauucaccagaaaggaaauaaguacaagaucgucacagcuauaaccucugccaugggcuccaaauguaacaauacggacacuaagguucaaggcuacuauauuugcaucauugggggaaacucagcgccuguguacgcaccagccggugaggauuuucgcgcuauggaaguauucagcggcaucaucaccaguccccauggggaggaccacgaucuuccuggagaagagauugccacauaucagauaucuggccagaucgaggcaaaaauuccacacacuguguccagcaagaauuugaaacugaccgcuuuugccgguaucccgucguacucuuccacaucaauacuagcggccagugaagacgggagauucauuuuuagccccggacucuucccuaaccugaaccaguccgucugcgauaauaacgcacuuccacugaucuggaggggcuugaucgaccucaccggcuauuacgaggcugugcaucccuguaauguuuucugcgugcugucugggccuggagccagcugugaagccuuuucagaggguggcauuuucaacaucacgaguccaaugugcuuagucuccaagcaaauucgguuucgcgccgcagaacagcagaucagcuucauaugucaacgaguggauauggacauuaucguauauugcaaugggcagaaaaagacuauccugacaaagacccucguuauuggacaguguauauacacuaucacaucucuuuuuagucuguugcccggcguggcccacaguauugcuaucgagcuaugcgucccggguuuccaugggugggcgaccgcagcccugcucauuacguuuuguuucggcugggugcugaucccugcuugcacccuugccauacuguugguccucaaauuuuucgcaaacauccugcacacaagcaaucaggagaacagauuuaaggccauuuuaaggaaaaucaaggaagaguucgagaaaacuaagggauccauggugugugaaauuugcaaguacgaaugcgagacccugaaagagcuaaaggcucacaaucucucuuguguucaaggcgaaugccccuauuguuuuacacauugcgagccaacugaaaccgccauccaggcacacuacaaagugugucaggcgacacaucgguuccgugaggaucugaagaaaaccguaacuccucagaacauagggcccggaugcuaucgcacgcuuaauuuguucagauacaagucgagguguuauauucugacaauguggacccuccugcuuaucauugagagcauccugugggcugccuccgcagccgaaauaccauuggucccccucuggacugacaacgcucacggugugggcucaguuccuaugcauaccgaccuggaguuagauuuuagucugccaucuagcuccaaguacacauauaaacggcaccuaaccaauccggugaacgaccaacagucagucagccuccacaucgaaauugagucucaggggaucggagccgaugugcaucaccugggccauugcuacgacgcacgacuuaauuugaagacuuccuuccacuguuacggugcuugcacaaaauaucaguaccccuggcacacggccaagugucauuuugaaaaagauuaugaguacgagaacaguugggcgugcaacccuccagacugccccgggguaggcaccggauguacugccugcggccuguaucucgaucaacugaagccuguggggacagcuuucaagauuaucagcguucgcuacucuagaaaagucugugugcaguuuggagaagaguauuuaugcaagaccauagacaugaaugauuguuucgugacaaggcacgcaaaaauuugcaucaucgguacugucuccaaguuuucacagggcgacacccugcuuuucuuggggccaauggaaggaggcgguauuaucuuuaaacauugguguacgaguaccugccacuucggggaucccggcgacguuaugggaccgaaggacaaaccuuuuauuuguccagaguuccccggccaguuucggaagaagugcaacuucgccacaacuccugugugugaauacgaugggaauauaaucagcggauacaaaaaggugcucgcuaccauugacucguuccaauccuuuaacacaucuaauauccauuucacugaugagcgcauugaguggagagaccccgauggcaugcugagggaccacaucaacauaguaaucagcaaagauauugacuuugaaaaucuagccgagaacccaugcaaggucggucugcaggcagcgaauaucgaaggggccuggggacucggcguggguuucacccugacgugccagguuucacuuacagaguguccuaccuuuuugacuucaauuaaggcuugcgauauggccaucuguuauggcgcagaauccgugacacugucucgugggcaaaacaccgucaaaauaacuggaaagggcgggcacagcggauccucauucaaaugcugucauggcaaggagugcagcaguaccgguuuacaggcuucugcuccccaccucgacaaagugaaugggauuuccgagcuggaaaacgagaagguuuacgaugacggagcaccagaauguggcaucacaugcugguuuaaaaagagcggugagugggugaugggcaucauuaaugggaacuggguaguccuuauagugcuguguguguugcuccuguucucgcuaauccugcucucaauucugugcccgguccggaagcauaaaaagucuuga

SEQ ID NO: 10231 - RNA, 3402 nt, Artificial Sequence
  derived and/or modified CDS sequence (opt3) from SEOV(ZT71)__EF117248.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucguggagagugaaguuuccuucaaaggcuugugcaugcucaagcaccggaugguggaggaaucuuaucgcaaccgacguagcgucaucuguuacgaccuggccugcaauuccaccuuuuguaagcccacaguguauaugauuguaccuauccaugcaugcaacaugaugaaaucaugucugauugggcucggaccauacagaauccagguuguguaugagaggacuuacugcaccacaggcauauuagccgaggguaaguguuucguccccgauaaagcuguggugagugcacugaagcgggggauguaugccaucgcuagcauugaaaccaucugcuuuuucauucaccagaaaggaaauaaguacaagaucgucacugccauaacaucugcgaugggcuccaaauguaacaauaccgacacgaagguucaaggcuacuauauuugcaucauugggggaaacucagcaccuguguacgccccagcuggugaggauuuucgcgccauggaaguauucagcggcaucaucacuucaccccauggggaggaccacgaucuuccuggagaagagauugcaaccuaucagauaucuggccagaucgaggcuaaaauuccacacacaguguccagcaagaauuugaaacugacugccuuugcggguaucccgucguacucuuccaccucaauacuagccgcaagugaagacgggagauucauuuuuagccccggacucuucccuaaccugaaccaguccgucugcgauaauaacgcccuuccacugaucuggaggggcuugaucgaccucacaggcuauuacgaggcugugcaucccuguaauguuuucugcgugcugucugggccuggagcuagcugugaagccuuuucagaggguggcauuuucaacaucaccaguccaaugugcuuagucuccaagcaaaaucgguuucgcgcagccgaacagcagauuagcuucauaugucaacgaguggauauggacaucauuguauauugcaacgggcagaaaaagacgauccugacuaagacacucguuaucggacaguguauuuacaccauaacuucuuuguuuucacuguugcccggcguggcucacaguaucgcgauugagcuaugcgucccggguuuccaugggugggcaacagccgcucugcucaucaccuuuuguuucggcugggugcugauuccugccugcacgcuugcaauccuguugguccucaaauuuuucgccaauauacugcacaccagcaaccaggagaauagauuuaaggcuaucuuaaggaaaauuaaggaagaguucgaaaagacaaagggauccauggugugugagaucugcaaguacgaaugcgagacucugaaagagcuaaaggcccacaaccucucuuguguucaaggcgaaugccccuauuguuuuacccauugcgagccaacagaaacugcaauucaggcgcacuacaaagugugucaggcuacccaucgguuccgugaggaucugaagaaaacaguaaccccucagaauaucgggcccggaugcuaucgcacucuuaacuuguucagauacaagucgagguguuauauacugacgauguggacacuccugcuuauuaucgagagcauucugugggccgcauccgccgcugaaaucccauuggucccccucuggaccgacaaugcccacggugugggcucaguuccuaugcauacugaccuggaguuagauuuuagucugccaucuagcuccaaguacaccuauaaacggcaccuaacaaacccggugaaugaccaacagucagucagccuccacauagaaaucgagucucaggggauuggagcagaugugcaucaccugggccauugguacgacgcuggucuuaacuugaagaccuccuuccacugcuacggggccuguacuaaauaucaguaccccuggcacacagcgaagugccauuuugaaaaagauuaugaguacgagaacaguugggccuguaauccuccagacugccccggcguaggaacgggcugcaccgcuugugggcuguaucucgaucaacugaagccugugggaacugcauucaagaucauuagcguucgauacucucgcaaagucugcgugcaguuuggugaagaguauuuauguaagacaaucgacaugaacgauugcuucgugaccagacacgccaaaauauguauuaucggcacagucuccaaguuuucacagggggacacucugcuuuucuugggaccaauggaaggcggugggaucauuuuuaaacauuggugcaccaguacgugucacuucggcgaucccggagacguuaugggcccgaaggacaaaccuuuuaucugcccagaguuccccgggcaguuuaggaagaaguguaauuucgcuaccacaccugugugcgaauacgauggaaacauuauaagcggcuacaaaaaggugcucgccacuaucgacucguuccaauccuuuaauaccucuaacauucauuucacagaugagcggaucgaguggcgcgaccccgaugguaugcugagagaccacauuaauaucguaauaagcaaagauaucgacuuugaaacucuagcagagaacccauguaaggucgggcugcaggcggccaauauugaaggagcuuggggcucaggugugggcuucacccucacgugccagguuagucugacagagugcccuaccuuucuuacuuccaucaaagccugugauauggcaauuugcuauggggcugaaucugugacauugagcaggggacaaaacaccgucaagaucacuggcaaagggggacacuccggcaguagcuucaaauguugccaugguaaggaguguaguucuaccgggcugcaggccuccgcaccccacuuagacaaagugaauggaauaagcgagcucgaaaacgagaagguuuacgaugacggcgccccagaaugcgguauuacauguugguuuaaaaagucgggcgagugggugauggggaucaucaauggaaacuggguaguccugauugugcuuugcgugcugcuucucuucucacugauacuacugucuauccucuguccgguccguaagcauaaaaagaguuga

SEQ ID NO: 10232 - RNA, 3402 nt, Artificial Sequence
  derived and/or modified CDS sequence (opt3) from SEOV(DN2)__KX289953.1__GP
auguggagccugcuccuucuggccgcuuuggcaggccagggguucgccuuaaagaacguguuugacaugagaauccaaugcccccacuccgucaauuucggagagaccucuguuucagguuacacagaacugccuccacuaagucuccaggaggcggaacagcuggugccggagagcuccuguaacauggauaaucaucagucucuuucgacuauuaacaaacugacgaagguaauauggaggaaaaaggcuaaucaagaaucagccagccagaacaguuuugagguggucgaguccgaagugucuuucaaaggcuugugcaugcucaagcaccggaugguugaggaaagcuaucgcaaucgacguuccgugaucuguuacgaccuggcaugcaacucaaccuuuuguaagcccacagucuauaugauugugccuauccaugccugcaauaugaugaaaaguugucugauugggcucggaccauacagaauccagguaguuuaugagaggacuuacugcaccacaggcauauuaaccgaggguaaguguuucgugcccgauaaagcugucgugagcgcacugaagcgggggauguaugccaucgcuucuauugaaacuaucugcuuuuucauucaccagaaaggaaacacauacaagaucgugaccgccauaacguccgcgaugggcucaaaguguaauaacacugacaccaaaguccaaggcuacuauauuugcaucauugggggaaauagcgcaccuguuuacgccccagcuggugaggauuuucgcgccauggaaguguucaguggcaucaucacaucuccccauggggaggaccacgaucuuccuggagaagagauugcaacuuaucagauauccggccagaucgaggcuaagauuccacacaccguaagcucgaaaaacuugaagcugacagccuuugcggguaucccgucuuacuccucaaccaguauacuagccgcaagcgaagacgggagauucauuuuuagccccggacucuucccuaaucugaaccagucugugugcgauaacaaugcccuuccacugaucuggaggggcuugaucgaccucacgggcuauuacgaggcuguccaucccuguaacguguucugcguucugagcgggccuggagcuucaugugaagccuuuagugaggguggcauuuucaauaucacuuccccaaugugcuuagugagcaaacaaaaccgguuucgcgcagccgaacagcagauuucuuucgucugucaacgaauagauauggacaucauuguguauugcaaugggcagaagaaaacaauccugaccaagacucucguaaucggacaguguauuuacacaauaaccucacuuuuuagucuguugcccggcguugcucacagcaucgcgauugagcuaugcgugccggguuuccaugggugggcaacggccgcucugcucaucaccuuuuguuucggcuggguccugauuccugccugcacacuugcaauccuguuggugcucaaguuuuucgccaacauacugcacacuuccaaucaggagaacagauuuaaagcuaucuuaaggaagauuaaagaagaguucgaaaagaccaaaggaucuauggucugugagaucugcaaguacgaaugcgagacacugaaggagcuaaaagcccacaaucucucgugugugcaaggcgaaugccccuauuguuuuacucauugcgagccaaccgaaacagcaauucaggcgcacuacaagguuugucaggcuacccaucgguuccgugaggaucugaaaaagacugugacgccucagaacaucgggcccggaugcuaucgcacacuuaauuuguucagauacaaauccagguguuauauacugaccauguggacucuccugcuuauuaucgaguccauucugugggccgcaucagccgcugaaaucccauugauaccccucuggaccgacaacgcccacgguguaggcagugucccuaugcauacagaccuggaguuagauuuuucucugccaagcuccucaaaguacaccuauaagcggcaccuaacuaauccggugaacgaccaacagagcguuucucuccacaucgaaauugagucccaggggaucggagcagaugugcaucaccugggccauugguacgacgcucgacuuaauuugaaaacaaguuuccacugcuacggugccuguacgaaguaucaguaccccuggcacaccgcgaaaugccauuuugaaaaggauuaugaguacgagaacagcugggccuguaacccuccagacugccccggggucggcacuggaugcacagcuuguggccuguaucucgaucaacugcgcccuguggggaccgcauucaaaauuaucucuguaagauacuccaggaaggugugcguucaguuuggagaagaguauuuauguaagacaauagacaugaaugauugcuucgucacucggcacgccaaaauuuguaucaucgguaccgugucaaaguuuagucagggcgacacgcugcuuuucuuggggccaauggaaggaggcgguauuaucuuuaaacauuggugcaccagcacaugucacuucggggaucccggcgacgugaugggaccgaaggacaaaccuuuuauuugcccagaguuccccggccaguuucgcaagaaauguaacuucgcuacuaccccugucugcgaauacgaugggaauacaauaucgggauacaagaagguucucgccacuaucgacuccuuccaaucuuuuaacaccagcaauauucauuucacggaugagagaaucgaguggagggaccccgauggcaugcugcgugaccacauuaacaucgugauaucaaaagauaucgacuuugaaaaucuagcagagaacccauguaaggugggucugcaggcggccaauauugaaggggcuuggggaaguggcguagguuucacauugaccugccaggucucccugacugagugcccuacauuucuuaccucuaucaaagccugugauauggcaauuugcuauggcgcugaaagcgugacuuugucccgggggcaaaacaccguuaagaucacaggaaaaggcgggcacucaggaagcaguuucaaguguugccauggcaaggaguguucuuccacgggucugcaggccagcgcaccccacuuagacaaagugaaugggauaucggagcucgaaaacgagaaggucuacgaugacggagccccagaaugcggcauuaccuguugguuuaaaaagucaggugagugggugaugggcaucaucaaugggaacuggguugugcugauuguacuuugcguccugcuccucuucucucugauacuacugaguauccucuguccggugcgaaaacauaagaaguccuga

SEQ ID NO: 10233 - RNA, 3402 nt, Artificial Sequence
  derived and/or modified CDS sequence (opt3) from SEOV(IR162)__KX079475.1__GP
auguggagccugcuccuucuggccgcuuuggugggcagaggguucaccuuaaagaacgucuuugacaugaggauccaaugcccccacuccguuaauuucggagagacaucugugucagguuacacugaacugccuccacuaagucuccaagaggcagaacagcugguaccggagagcuccuguaacauggauaaucaucagucucuuucgacgauuaacaaacugaccaaggugauauggcggaaaaaggccaaucaggaaucagcgaaccaaaauagcuuugaggucguggagagugaaguuuccuucaaaggcuugugcaugcucaagcaccgcaugguggaggaaucuuaucgaaaccguagaagcgucaucuguuacgaccuggcuugcaauuccacauuuuguaagcccacuguguauaugauuguaccuauccaugccugcaacaugaugaaaucaugucugauugggcucggaccauacaggauccagguuguguaugagcggaccuacugcacaaccggcauauuaacugaggguaaguguuucguccccgauaaagcaguggugagugcccugaagcgcgggauguaugcuaucgcaagcauugaaacaaucugcuuuuucauucaccagaaaggaaauaccuacaagaucgucacggccauaacuucugcuaugggcuccaaguguaacaauaccgacacaaaaguucagggcuacuauauuugcaucauugggggaaacucagccccuguguacgcgccagccggugaggauuuuagagccauggaaguauucagcggcaucaucacuucaccccauggggaggaccacgaucuuccuggagaagagauugcuaccuaucaaauaucuggccagaucgaggccaagauuccacacacaguguccagcaaaaauuugaagcugaccgcauuugcugguaucccgucguacucuuccacgucaguccuaauagccagugaagacgggagguucauuuuuagccccggacucuucccuaaccugaaccaguccgugugcgauaauaacgcgcuuccacugaucuggcggggcuugaucgaccucacuggcuauuacgaggccguucaucccuguaauguguucugcguccugucugggccuggagcaagcugugaggcuuuuucagaagguggcauuuucaacaucacaaguccaaugugcuuaguguccaaacagaaucgcuuucgagccgcugaacaacagauuagcuucguaugucagagaguugauauggacauaaucguguauugcaacgggcaaaagaaaaccauucugacuaagacacucgucaucggacaguguaucuacaccauuacgucuuuguuuucacuguugcccggcguggcccacaguauagcaaucgagcuaugcgucccggguuuccaugggugggccaccgcugcgcugcucauuacauuuuguuucggcugggugcugaucccugcaugcacucuugccauucuguugguucucaaguuuuucgcuaauauccugcacaccagcaaccaggagaauagguuuaaagccauauuacggaagaucaaagaagaguucgaaaagacaaaaggauccauggugugugagauuugcaaguacgaaugcgagacucugaaggagcuaaaagcacacaaccucucuuguguacagggcgaaugccccuauuguuuuacccauugcgagccaacagaaaccgccauccaagcucacuacaaggucugucaggccacucaucguuuccgcgaggaucugaaaaagacggugacaccucagaauauugggcccggaugcuauagaacccuuaacuuguucagguacaaaucgcgguguuauauccugacuauguggacccuccugcuuauaauugagagcauccugugggcagcguccgcuacagaaauuccauugguuccccucuggaccgacaaugcccacggugugggcucagucccuaugcauacugaccuggaguuagauuuuagucugccaucuagcuccaaguacacauauaagcgacaccuaacgaacccggugaaugaccagcaaucaguaagccuccacaucgaaauagagucucaggggaucggagcagaugugcaucaccugggccauugguacgacgcccgccuuaacuugaaaaccuccuuccacugcuacggugcuuguacuaaguaucaguaccccuggcacacagccaaaugccauuuugaaaaggauuaugaguacgagaacaguugggcauguaauccuccagacugccccgggauuggcaccggaugcacagcuuguggccuguaucucgaucagcugaaaccuguugggacugccuucaagaucauuagcgucagauacucuaggaaggugugcgugcaauuuggagaagaguauuuauguaaaaccaucgacaugaacgauugcuucgucacgcggcacgcgaagauauguauuaucgguaccguuuccaaauuuucacagggcgacacacugcuuuucuuggggccaauggaaggaggcgguaucauuuuuaagcauuggugcaccaguacuugucacuucggggaucccggcgacgugaugggaccgaaagacaagccuuuuaucugcccagaguuccccggccaguuucgcaaaaaguguaauuucgccacaacuccugugugcgaauacgaugggaacauuauaagcggauacaagaaaguacucgcuaccaucgacucguuccaguccuuuaauacgucuaacauucauuucacagaugagagaaucgaguggagggaccccgauggcaugcugcgugaccacauuaauaucgucauaagcaaggauaucgacuuugaaaaccuagcagagaauccauguaaagugggucugcaagccgcuaacauugaaggggccuggggaucaggcguugguuucacccucacuugccaggugagucugacagagugcccuaccuuucuuacuuccaucaaggcaugugauauggcgauuugcuauggcgccgaaucugucaccuugagccgggggcagaauacagugaaaaucacgggaaagggcgggcacuccggaaguagcuucaaguguugccauggcaaagaguguaguucuaccggucugcaggcuuccgcaccccacuuagacaagguuaacgggauaagcgaucucgagaaugaaaaaguguacgacgauggagcaccagagugcggcauuacuuguugguuuaagaaaucgggugaauggguaaugggcaucaucaacgggaauugggucgugcugauugugcuuugcguccugcuucucuucucacugauacuacugucuauccucuguccgguucgaaagcauaagaaaaguuga

SEQ ID NO: 10234 - RNA, 3402 nt, Artificial Sequence
  derived and/or modified CDS sequence (opt3) from SEOV(Gou3)__AF145977.2__GP
auguggggccugcuccuucuggccgcuuugguggggcagggauuagcacugaagaacgucuucgacaugaaaauccaaugcccccacagcguuaauuuuggugagaccuccgugucuggcuacacagaacuaccuccacucccgcugcaggaggccgaacagcuuguacccgagucaaguuguaacauggauaaucaucagagccuguccacuauuaacaaguugacgaaagugauauggagaaagaaagcgaaucaagaaucugcuucgcagaacucauucgaggucguggagaaugaaguuagcuuuaaggggcucugcaugcugaagcacaggaugguggaggaaaguuaucggaaccgccgauccgucaucuguuacgaccuggccugcaauaccacauucuguaaaccuacuguguauaugauuguaccaauccaugcaugcaacaugaugaagucuugucucauuggauuaggccccuaccguauccagguuauauaugagagaaccuacugcacaaccgguauccugacugaggggaaauguuuugugccugauaaggccgucgugagcgcucuuaaaaggggaauguaugcaauugccuccaucgaaacaauuugcuucuuugugcacaagaagggcaauaccuacaaaaucgucucagcuauaacguuggccaugggcaguaaguguaacaauacugacagcaaaguucagggguacuauauuugcaucauuggagguaacucugcgccaguguacgcacccgccggcgaggauuuccgggcuauggaaguauuuuccgggaucaucaccucaccucauggagaggaccacgaucugccaggcgaagagauugccacauaucaaauaagcggucagaucgaggcaaagauuccgcacacugugaguucuaaaaaucuaaagcucaccgcuuucgccgggauccccuccuacagcucgacaucuauacuggcggccuccgaagacggacgcuuuauuuucucaccuggccuuuuuccaaaccugaaccagagugucugcgauaauaacgcauugccccucaucuggagaggccugaucgacuuaaccggguauuacgaggcuauucauccuuguaauguguucugcguucugagcggaccaggugccuccugugaggcuuucucugaaggcgggaucuuuaacauuacgagccccaugugccucgugucaaaacagaauagguuccgggccgcagaacaacagauaaguuuuaucugucagcgcgucgauauggacauugugguauauugcaacggacaaaagaagacuauccuuacaaaaacccugguuaucggccaguguauuuacacuauaacauccuuguucagccuacugccggguguggcccacucuaucgcuauugagcucugcgucccuggguuucauggcugggcgaccgcagcccugcuugugacguucuguuuuggauggguccugauccccgcuugcaccuuggccgugcuccuguucuuaaaguuuuucgcaaauauucugcacacaucaaaccaggagaaucgauuuaaagccauccuaagaaagauaaaagaagaguucgaaaagacuaagggcaguaugguuugugagaucugcaaauacgaaugcgagacccucaaggagcugaaagcucacaaccuuagcugugugcagggggaaugcccauauuguuuuacacauugcgagccuacugaaaccgccauucaagcacacuacaagguaugucaggcgacacauagguuccgggaggauuugaaaaagaccgucacuccccagaauaucggaccagguugcuaucguacgcugaaccucuuccgcuacaaguccagauguuauauucugacaauguggauccuucuguuggugauagagucuauucucugggcugccucggcagccgaaaucccccugguuccuuuauggaccgacaaugcucacggcguggggagcgucccaaugcauacugaccuggagcuagauuuuucccucccgucaaguucuaaauacaccuauaagaggcaccugacaaaccccgugaaugaccagcaaagcguaucccuucacauugaaaucgagucacagggaauaggcgccgaugugcaucacuugggucauugguacgacgcacggcugaaccucaaaaccagcuuccacugcuacggggcuuguacuaaguaucaguacccuuggcacacagccaaaugccauuuugaaaaggauuaugaguacgagaacucuugggcguguaauccacccgacugcccuggcguuggagccggcugcacggcuugugggcuguauuuagaucagcugaagccagucggaaccgcauucaaaaucauuuccgugcgauacagucgcaaggugugcguccaauuuggugaagaguaucuuuguaaaacuaucgacaugaacgauugcuucguuacaagacacgccaagauuuguaucauaggcaccgugagcaaauuuucucagggggacacacucuuguuccugggacccauggaaggcggugggauuaucuuuaagcauuggugcacuuccaccugucacuucggcgauccgggagacgugaugggcccuaaagacaagccauuuaucugccccgaguucccugggcaguuuaggaagaaauguaauuucgcuacgacccccguaugcgaauacgauggaaacgucauuucaggcuaccggaaggugcuagccacaaucgacaguuuccagagcuuuaauacuucgaacguucauuucaccgaugagcgcauugaguggaaagacccagaugguaugcugagagaccacauaaauaucgugauuuccaaggauaucgacuuugaaaaccucgcagagaauccuuguaaagucgggcugcaagcggccaacauugaaggagcuuggggcucuggugugggcuucacacuuacuugccagguuagcuugaccgagugccccacguuucugacaucaaucgaagccugugauauggcaauaugcuauggggcugagagugugaccuuauccaggggacagaauacuaucaagauuacaggcaaagggggacacucuggcagcuccuucaaguguugccaugguaaggaguguucagccaacgggcuccaagcaagcgccccacaccuggacaaaguaaauggaaucagugaacuugagaacgaaaaggucuacgaugacggcgcuccggagugcgguauuaccuguugguuuaaaaagucuggcgagugggugauggggaucauaaauggaaacugggugguccugauuguuuugugcgugcuccugcuauucucccugauccuccugagcauccuuuguccuguacguaagcauaaaaagucguga

SEQ ID NO: 10235 - RNA, 3402 nt, Artificial Sequence
  derived and/or modified CDS sequence (opt3) from SEOV(HB55)__AF035832.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaagguggucuggaggaaaaaggcgaaucaagaaucagcuaaccagaauagcuuugaggugguugagagugaaguguccuucaaaggcuugugcaugcucaagcaccggauggucgaggaaucuuaucgcaaccgacguagcgugauauguuacgaccuggccugcaauuccaccuuuuguaagcccacaguauauaugaucguuccuauucaugcaugcaacaugaugaaaucaugucugaucgggcucggaccauacaggauucagguggucuaugagagaacuuacugcaccacaggcaucuuaaccgaggguaaguguuucgugcccgauaaagccguggucggggcucugaagcggggaauguaugcaauagccaguaucgaaacuauuugcuuuuucauccaccagaaaggcaauaaguacaagauuguuacagcuaucaccagcgccaugggcucuaaauguaacaauacggacacuaaggugcaaggguacuauauaugcauuaucggagguaacuccgcgccuguauacgcaccagccggcgaggauuuucgcgcuauggaaguguucucagggauuaucaccagcccccauggagaggaccacgaucuuccuggcgaagagaucgccacauaucagauuaguggucagauagaggcaaaaaucccacacacugucucuuccaagaauuugaaacugauugcuuuugccgggaucccgagcuacucgucuaccuccauacuagcggccucagaagacggaagauucauuuuuagucccggccucuucccuaaccugaaccagagcgugugcgauaauaacgcacuuccacugaucuggaggggcuugaucgaccucacaggguauuacgaggcuguucaucccuguaauguguucugcguccuguccggaccuggugccucuugugaggcuuuuagcgaaggcgggauuuucaacaucaccucaccaaugugcuuagugaguaagcaaaaucgguuucgcgccgcagaacagcagauuuccuucauaugucaacgaguagauauggacaucauuguuuauugcaacggacagaaaaagacgauccugacuaagacacucgugaucggccaguguauuuacaccauaacuagccucuuuucucuguugcccggugucgcccacucaaucgcuauugagcuaugcgugccgggguuccauggcugggcgacagcagcccugcucaucaccuuuuguuucggauggguccugauuccugcuugcacgcuugccauccuguuggugcucaaauuuuucgcaaauauacugcacaccaguaaccaggagaauagauuuaaggccaucuuaaggaaaauuaaggaagaguucgagaaaacaaagggcagcaugguuugugaaaucugcaaguacgaaugcgagacucugaaagagcuaaaggcucacaaccucuccugugugcaaggggaaugccccuauuguuuuacccauugcgagccaacagaaacugccauucaggcacacuacaaaguaugucaggcgacccaucgguuccgugaggaucugaagaaaacagucaccccucagaauaucggacccgguugcuaucgcacucuuaacuuguucagauacaagucuagguguuauauacugacgauguggacacuccugcuuauuaucgagucgauucugugggcugccagcgcagccgaaaucccauuggugccccucuggaccgacaaugcucacggcguuggguccgugccuaugcauacugaccuggaguuagauuuuucacugccaaguucuagcaaguacaccuauaaacggcaccuaacaaacccggucaaugaccaacaguccgugucacuccacauagaaaucgagagccagggaauuggcgccgauguacaucaccugggucauugguacgacgcacgacuuaacuugaagaccucuuuccacugcuacggggcuuguacuaaauaucaguaccccuggcacacagccaagugccauuuugaaaaagauuaugaguacgagaacuccugggcguguaauccuccagacugccccggcgugggaacgggcugcaccgccugugggcuguaucucgaucaacugaagccuguuggaacugcuuucaagaucauuaguguccgcuacagcagaaaagcaugcgugcaguuuggugaagaguauuuauguaagacaaucgacaugaacgauugcuucgugaccggccacgccaaaauauguauuaucgggacagucucuaaguuuucccagggagacacucugcuuuucuugggcccaauggaaggugggggcaucauuuuuaaacauuggugcaccucaacgugucacuucggagaucccggcgacguuauggggccgaaggacaaaccuuuuaucugcccagaguuccccggacaguuuaggaagaaguguaauuucgcuaccacaccuauuugcgaauacgauggcaacauaaucagugguuacaaaaaggugcucgccacuauugacagcuuccaaucguuuaauaccuccaacauccauuucacagaugagcggauugaguggcgcgaccccgaugggaugcugagagaccacaucaauauagugaucucuaaagauauugacuuugaaaaccuagcagagaauccauguaagguaggacugcaggcggccaacaucgaaggcgcuugggguagcggcgucggguucacucuuaccugccaggugucacugacggagugcccuacauuucuuaccaguauuaaagccugugauauggcaaucugcuauggagcugaauccguuacuuugucuaggggccaaaauacagugcguauaaccgggaagggaggccacagcgguuccucauucaaguguugccaugggaaagaguguagcaguacuggacugcaggccucugcaccccacuuagacaaggucaacggcauuuccgagcucgaaaaugagaaaguguacgaugacggugccccagaaugcggcguuaccuguugguuuaagaaaagcggggagugggugaugggaaucaucaacggcaauuggguaguccugauugugcuuugcgugcugcucuuguucucgcugauacuacugucaauccucuguccgguccggaagcauaagaaaucuuga

SEQ ID NO: 10236 - RNA, 3402 nt, Artificial Sequence
  derived and/or modified CDS sequence (opt3) from SEOV(L99)__AF035833.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaagguggucuggaggaaaaaggcgaaucaagaauuggcuaaccaaaauucauuugaggugguugagagcgaagugaguuucaaaggccucugcaugcugaagcaccggauggucgaggaauccuaucgcaaccgacguucugugauauguuacgaccuggccugcaauagcaccuuuuguaagcccacaguauauaugaucguuccuauucaugcaugcaacaugaugaaauccugucucaucggguuaggaccauacaggauucagguggucuaugagagaacuuacugcaccacaggcauccugaccgaggguaaguguuucgugcccgauaaagccguggucucagcucuuaagcgggggauguaugcaauagccaguaucgaaacuauuugcuuuuucauccaccagaaaggaaauacauacaagauuguuaccgcuaucacgagcgccaugggcucuaaguguaacaauacugacaccaaagugcaaggcuacuauauaugcauuaucgggggaaacuccgcgccuguauacgcaccagccggugaggauuuucgcgcuauggaaguguucucaggcauuaucacaagcccccauggggaggaccacgauuugccuggagaagagaucgccacuuaucagauuaguggccagauagaggcaaagaucccacacaccgucucuuccaaaaaucugaagcuaauugcuuuugccgguaucccgagcuacucgucuacauccauacucgcggccucagaagacgggagauucauuuuuagucccggacuguucccuaaccuuaaccagagcgugugcgauaauaacgcacugccauugaucuggaggggccucaucgaccugaccggcuauuacgaggcuguucaucccuguaauguguucugcgucuuauccgggccuggagccucuugugaagccuuuagcgaggguggcauuuucaacaucacgucaccaaugugccuggugaguaaacaaaaucgguuucgcgccgcagaacagcagauuuccuucauaugucaacgaguagauauggacaucauuguuuauugcaacgggcagaagaaaacuauccucacaaagacccuugugaucggacaguguauuuacacuauaacaagccuguuuucuuugcuacccggcgucgcccacucaaucgcuauugagcugugcgugccggguuuccaugggugggcgaccgcagcccuccugaucacguuuuguuucggcuggguccuuauuccugcuugcacccuggccaucuugcucgugcugaaguuuuucgcaaauauauuacacacaaguaaccaggagaauagauuuaaagccauccugaggaagauuaaagaagaguucgaaaagacuaaaggaagcaugguuugugagaucugcaaguacgaaugcgagacccuaaaggagcucaaagcucacaaccuguccugugugcaaggcgaaugccccuauuguuuuacacauugcgagccaacugaaaccgccauucaggcacacuacaagguaugucaggcgacacaucgguuccgugaggaucuuaaaaagaccgucacuccuaaaaauaucgggcccggaugcuaucgcacguugaaccuguucagauacaagucuagguguuauauacucacaauguggacccugcuucugauuaucgagucgauuuugugggcugccagcgcagccgaaaucccacucgugccccuguggacugacaaugcucacgguguuggcuccgugccuaugcauaccgacuuagagcuggauuuuucacuaccaaguucuagcaaguacacauauaaacggcaccucaccaacccggucaaugaccagcaauccgugucacugcacauagaaaucgagagccaggggauuggagccgauguacaucaccuuggccauugguacgacgcacgauugaaccugaagacuucuuuccacugcuacggugcuuguacaaaauaucaguaccccuggcacacggccaagugccauuuugaaaaagauuaugaguacgagaacuccugggcguguaauccuccagacugccccggggugggcaccggaugcacugccuguggccucuaucuggaucaguuaaagccuguugggacagcuuucaagaucauuaguguccgcuacagcagaaaagugugcgugcaauuuggagaagaguaucuguguaagaccaucgacaugaacgauugcuucgucacaaggcacgcaaaaauauguauuaucgguacuguuucuaaguuuucccagggcgacacccuuuuguuccucgggccaauggaaggaggcgguaucauuuuuaaacauuggugcacgucaaccugucacuucggggaucccggcgacgugaugggaccgaaggacaaaccuuuuaguugcccagaguuccccggccaguuucggaagaaguguaauuucgccacaacuccuaucugcgaauacgaugggaacauuauaagcggauacaaaaaggugcuggcuaccaucgacucguuccaguccuuuaauacaucuaacauucauuucacugaugagcgcaucgaguggagagaccccgauggcaugcuaagggaccacauuaauaucguaauaagcaaagauaucgacuuugaaaaccuggccgagaauccauguaaggucggucuccaagcagcgaacauugaaggggccuggggaucaggcguggguuucacccugacgugccagguuagucuuacagagugcccuaccuuuuugacuuccaucaaggcuugugauauggccauuugcuauggcgcagaaucugugacacugagccgugggcagaauaccguccggaucacuggaaaaggcgggcacuccggaagcucauucaaguguugccauggcaaagaguguaguucuaccgguuuacaggcuuccgcuccccaccucgacaaggugaacgggauaagcgagcuggaaaaugagaaaguuuacgaugacggagcaccagaaugcggcgugacauguugguuuaagaaaucgggugaguggguaaugggcauuaucaacgggaauugggucgugcuuaucgugcugugcgucuugcuccuguucucacuaauucugcucucuauacuguguccgguucgaaagcauaagaaaaguuga

SEQ ID NO: 10237 - RNA, 3402 nt, Artificial Sequence
  derived and/or modified CDS sequence (opt3) from SEOV(Z37)__AF187081.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucguggagagugaaguuuccuucaaaggcuugugcaugcucaagcaccggaugguggaggaaucuuaucgcaaccgacguagcgucaucuguuacgaccuggccugcaauuccaccuuuuguaagcccacaguguauaugauuguaccuauccaugcaugcaacaugaugaaaucaugucugauugggcucggaccauacagaauccagguuguguaugagaggacuuacugcaccacaggcauauuaaccgaggguaaguguuucguccccgauaaagccguggugagugcucugaagcgggggauguaugcaaucgccagcauugaaacuaucugcuuuuucauucaccagaaaggaaauaaguacaagaucgucacagcuauaaccucugccaugggcuccaaauguaacaauacggacacuaagguucaaggcuacuauauuugcaucauugggggaaacucagcgccuguguacgcaccagccggugaggauuuucgcgcuauggaaguauucagcggcaucaucaccaguccccauggggaggaccacgaucuuccuggagaagagauugccacauaucagauaucuggccagaucgaggcaaaaauuccacacacuguguccagcaagaauuugaaacugaccgcuuuugccgguaucccgucguacucuuccacaucaauacuagcggccagugaagacgggagauucauuuuuagccccggacucuucccuaaccugaaccaguccgucugcgauaauaacgcacuuccacugaucuggaggggcuugaucgaccucaccggcuauuacgaggcugugcaucccuguaauguuuucugcgugcugucugggccuggagccagcugugaggcuuuuucagaagguggcauuuucaacaucacgaguccaaugugcuuagucuccaagcaaauucgguuucgcgccgcagaacagcagauaucauucaucugucaacgaguggauauggacauuaucguauauugcaaugggcagaaaaagacuauccugacaaagacccucguuauuggacaguguauauacacuaucacaucuuuguuuucacuguugcccggcguggcccacaguauugcuaucgagcuaugcgucccggguuuccaugggugggcgaccgcagcccugcucauuacguuuuguuucggcugggugcugaucccugcuugcacccuugccauacuguugguccucaaauuuuucgcaaacauccugcacacaagcaaucaggagaacagauuuaaggccauuuuaaggaaaaucaaggaagaguucgagaaaacuaagggauccauggugugugaaauuugcaaguacgaaugcgagacccugaaagagcuaaaggcucacaaucucucuuguguucaaggcgaaugccccuauuguuuuacacauugcgagccaacugaaaccgccauccaggcacacuacaaagugugucaggcgacacaucgguuccgugaggaucugaagaaaaccguaacuccucagaacauagggcccggaugcuaucgcacgcuuaauuuguucagauacaagucgagguguuauauucugacaauguggacccuccugcuuaucauugagagcauccugugggcugccuccgcagccgaaauaccauuggucccccucuggacugacaacgcucacggugugggcucaguuccuaugcauaccgaccuggaguuagauuuuagucugccaucuagcuccaaguacacauauaaacggcaccuaaccaauccggugaacgaccaacagucagucagccuccacaucgaaauugagucucaggggaucggagccgaugugcaucaccugggccauugguacgacgcacgacuuaauuugaagacuuccuuccacugcuacggugcuuguacaaaauaucaguaccccuggcacacggccaagugccauuuugaaaaagauuaugaguacgagaacaguugggcguguaacccuccagacugccccgggguaggcaccggaugcacugccuguggccuguaucucgaucaacugaagccuguggggacagcuuucaagauuaucagcguucgcuacucuagaaaagucugcgugcaguuuggagaagaguauuuauguaagaccauagacaugaaugauugcuucgugacaaggcacgcaaaaauuuguaucaucgguacugucuccaaguuuucacagggcgacacccugcuuuucuuggggccaauggaaggaggcgguauuaucuuuaaacauuggugcacgaguaccugucacuucggggaucccggcgacguuaugggaccgaaggacaaaccuuuuauuugcccagaguuccccggccaguuucggaagaaguguaacuucgccacaacuccugugugcgaauacgaugggaauauaaucagcggauacaaaaaggugcucgcuaccauugacucguuccaauccuuuaacacaucuaauauccauuucacugaugagcgcauugaguggagagaccccgauggcaugcugagggaccacaucaacauaguaaucagcaaagauauugacuuugaaaaucuagccgagaacccauguaaggucggucugcaggcagcgaauaucgaaggggccuggggaucaggcguggguuucacccucacgugccagguuagucugacagagugcccuaccuuucuuacuuccauuaaggcuugugauauggccaucugcuauggcgcagaaucugugacauugagccgugggcaaaacaccgucaaaauaacuggaaagggcgggcacuccggaagcagcuucaaauguugccauggcaaggaguguaguucuaccggucugcaggcuuccacaccccacuuagacaaagugaaugggauuagcgagcucgaaaacgagaagguuuacgaugacggagccccagaaugcggcaucacguguugguuuaaaaagucgggugagugggugaugggcaucauuaaugggaacuggguaguccugauagugcuuugcgugcugcuucucuucucacugauccuacugucuauucucuguccgguccggaagcauaaaaagaguuga

SEQ ID NO: 10238 - RNA, 3402 nt, Artificial Sequence
  derived and/or modified CDS sequence (opt3) from SEOV(Z37)__AF190119.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucguggagagugaaguuuccuucaaaggcuugugcaugcucaagcaccggaugguggaggaaucuuaucgcaaccgacguagcgucaucuguuacgaccuggccugcaauuccaccuuuuguaagcccacaguguauaugauuguaccuauccaugcaugcaacaugaugaaaucaugucugauugggcucggaccauacagaauccagguuguguaugagaggacuuacugcaccacaggcauauuaaccgaggguaaguguuucguccccgauaaagccguggugagugcucugaagcgggggauguaugcaaucgccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuucgcgcuauggaaguauucagcggcaucaucacaaguccccauggggaggaccacgaucuuccuggagaagagauugccacuuaucagauaucuggccagaucgaggcaaagauuccacacaccguguccagcaaaaauuugaagcugacagcuuuugccgguaucccgucguacucuuccaccucaauacuagcggccagugaagacgggagauucauuuuuagccccggacucuucccuaaccugaaccaguccgucugcgauaauaacgcacuuccacugaucuggaggggcuugaucgaccucacgggcuauuacgaggcugugcaucccuguaauguuuucugcgugcugucugggccuggagccagcugugaggcuuuuucagaagguggcauuuucaacaucacuucaccaaugugcuuagucuccaaacaaaaucgguuucgcgccgcagaacagcagauuagcuucauaugucaacgaguggauauggacaucauuguauauugcaacgggcagaagaaaacaauccugaccaagacucucguuaucggacaguguauuuacacaauaaccucucuuuuuagucuguugcccggcguggcccacaguaucgcuauugagcuaugcgucccggguuuccaugggugggcgacggcagcccugcucaucaccuuuuguuucggcugggugcugauuccugcuugcacacuugccauccuguugguccucaaguuuuucgcaaauauacugcacacuagcaaccaggagaauagauuuaaagccaucuuaaggaagauuaaagaagaguucgaaaagaccaaaggauccauggugugugagaucugcaaguacgaaugcgagacacugaaggagcuaaaagcucacaaccucucuuguguucaaggcgaaugccccuauuguuuuacucauugcgagccaaccgaaacagccauucaggcacacuacaaggugugucaggcgacccaucgguuccgugaggaucugaaaaagacuguaacgccucagaauaucgggcccggaugcuaucgcacacuuaacuuguucagauacaaaucgagguguuauauacugaccauguggacucuccugcuuauuaucgagagcauucugugggcugccuccgcagccgaaaucccauuggucccccucuggaccgacaaugcucacggugugggcucaguuccuaugcauacagaccuggaguuagauuuuagucugccaucuagcuccaaguacaccuauaagcggcaccuaacuaacccggugaaugaccaacagucagucagccuccacauagaaaucgagucucaggggauuggagccgaugugcaucaccugggccauugguacgacgcacgacuuaacuugaaaacauccuuccacugcuacggugcuuguacgaaguaucaguaccccuggcacaccgccaaaugccauuuugaaaaggauuaugaguacgagaacaguugggcguguaauccuccagacugccccgggguaggcacuggaugcacagccuguggccuguaucucgaucaacugaaaccuguggggaccgcuuucaagaucauuagcguucgcuacucuagaaaggucugcgugcaguuuggagaagaguauuuauguaaaacaaucgacaugaacgauugcuucgugacuaggcacgcaaagauauguauuaucgguaccgucuccaaauuuucacagggcgacacgcugcuuuucuuggggccaauggaaggaggcgguaucauuuuuaagcauuggugcaccaguacaugucacuucggggaucccggcgacguuaugggaccgaaagacaagccuuuuaucugcccagaguucgccggccaguuucggaaaaaguguaauuucgcuacuacccccgugugcgaauacgaugggaacauuauaagcggauacaagaaagugcucgagacaaucgacucguuccaauccuuuaauacuucuaacauucauuucaccgaugagcgcaucgaauggagagacccugauggcaugcugagggaccacauuaauaucguaauaagcaaggauaucgacuuugagaacauggccgaaaaucccuguaaagucggucuacaggcagcgaacauugagggggccuggggaucaggcguggguuucacgcugacaugccagguuagucucaccgaaugcccaacuucccugacaucuaucaaggcuugugauauggccauuugcuauggcgcagagagcgugacccuuucccgugggcaaaauacugucaaaaucaccggaaagggcgggcacucaggaagcaguuuuaagcggugucauggcaaagaguguucuuccacagguuugcaggcuagcgccccucaccuggacaaggugaacgggauaucggaauuagagaaugaaaaaguuuacgaugacggagcacccgagugcggcauuacgugcugguucaagaaaucaggugagugggugaugggcaucaucaacgggaauuggguaguccucauugugcugugugugcuucuguuguuuucucucauacugcuaaguauccugugcccaguccgaaagcauaagaaauccuga

SEQ ID NO: 10239 - RNA, 3402 nt, Artificial Sequence
  derived and/or modified CDS sequence (opt3) from SEOV__M34882.1__GP
auguggagccugcuccuucuggccgcuuuggugggccagggguucgcauuaaagaacgucuuugacaugagaauccaacugccccacuccguuaauuucggagagaccucugugucagguuacacagaauuuccuccacuaagucuccaggaggccgaacagcugguaccggagagcuccugcaacauggauaaucaucagucucuuucgacuauuaacaaacugacgaaggugauauggaggaaaaaggcgaaucaagaaucagcuaaccagaauagcuucgaggucguggagagugaaguuuccuuuaaaggcuuguguaugcucaagcaccggaugguggaggaaucuuaucgcaaccgacguagcgucaucugcuacgaccuggccuguaauuccaccuucugcaagcccacaguguauaugauuguaccuauccaugcauguaacaugaugaaaucaugccugauugggcucggaccauacagaauccagguuguguaugagaggacuuacuguaccacaggcauauuaaccgaggguaagugcuuuguccccgauaaagccguggugagugcucugaagcgggggauguaugcaaucgccagcauugaaacuaucuguuucuuuauucaccagaaaggaaauacauacaagaucgucaccgcuauaacgucugccaugggcuccaagugcaacaauacugacaccaaaguucaaggcuacuauauuuguaucauugggggaaacucagcgccuguguacgcaccagccggugaggauuuccgcgcuauggaaguauuuagcggcaucaucacaaguccccauggggaggaccacgaucuuccuggagaagagauugccacuuaucagauaucuggccagaucgaggcaaagauuccacacaccguguccagcaaaaauuugaagcugacagcuuucgccgguaucccgucguacucuuccaccucaauacuagcggccagugaagacgggagauuuauuuucagccccggacucuucccuaaccugaaccaguccgucugcgauaauaacgcacuuccacugaucuggaggggcuugaucgaccucacgggcuauuacgaggcugugcaucccugcaauguguuuuguguucugucugggccuggagccagcugcgaggcuuucucagaggguggcauuuuuaacaucacuucaccaauguguuuagucuccaaacaaaaucgguuccgcgccgcagaacagcagauuagcuuugugugccaacgaguagauauggacauaaucguuuauuguaacgggcagaagaaaacaauucugaccaagacucucgugaucggacagugcaucuacacaauuaccucucuuuucucacuguugcccggcgucgcccacaguauagcuaucgagcuaugugugccggguuuucaugggugggcgacggcagcccugcucauuaccuucugcuuuggcuggguccugaucccugcuuguacacuugccauucuguuggugcucaaguucuuugcaaauauccugcacacuagcaaccaggagaauagauucaaagccauauuaaggaagaucaaagaagaguuugaaaagaccaaaggauccaugguuugcgagauuuguaaguacgaaugcgagacacugaaggagcuaaaagcucacaaccucucuugcgugcaaggcgaaugucccuauugcuucacucauugugagccaaccgaaacagccauccaggcacacuacaagguaugccaggcgacccaucgguuccgugaggaucugaaaaagacugucacgccucagaauauugggcccggauguuaucgcacacuuaacuuguuuagauacaaaucgaggugcuauauccugaccauguggacucuccugcuuauaauugagagcauccugugggcugccuccgcagccgaaauuccauuggugccccucuggaccgacaaugcucacgguguuggcucagugccuaugcauacagaccuggaguuagauuucagucugccaucuagcuccaaguacaccuauaagcggcaccuaacuaacccggucaaugaccaacagucagugagccuccacaucgaaauagagucucaggggaucggagccgcaguacaucaccugggccauugguacgaugcucgacuuaacuugaaaacauccuuucacuguuacggugccugcacgaaguaucaguaccccuggcacaccgcgaaaugucauuucgaaaaggacuaugaguacgagaacaguugggccugcaauccuccagauugucccggggugggcacuggaugcacagcuugcggccuguaucucgaccaacugaaaccuguugggaccgcauuuaagauuaucagcguccgcuacucuagaaaggugugugugcaguucggagaagaacacuuaugcaaaacaauugauaugaacgacuguuuugucacuaggcaugccaagaucugcauaauugguaccguuuccaaauucucacagggcgauacgcuguuguuucuugggccaauggaaggaggcgguaucaucuucaagcacugguguaccaguacaugccauuuuggggaccccggcgaugugaugggaccgaaagacaagccuuucauuuguccagaguuucccggccaguuccggaaaaagugcaauuucgcuacuaccccugugugugaauaugacgggaacaucauuagcggauacaagaaaguacucgccacaauagauucguuucaauccuucaauacuucuaacauccacuuuaccgacgagcgcauugaguggagagaucccgacggcaugcugagggaucacaucaauauugucaucagcaaggacauagauuucgaaaaccuagcagagaauccaugcaaagugggucugcaggcggccaacaucgaaggggcuuggggaucaggcguugguuuuacgcucacauguaaggugagucugaccgagugcccuacuuuccuuacauccauuaaagccugcgacauggcaaucuguuacggcgcugaaucugucaccuugagccgugggcagaauacugugaagauuaccggaaagggcgggcauuccggaaguagcuuuaaaugcugucacggcaaggagugcaguucuacaggucugcaagccuccgcaccccauuuagauaaaguuaacgggaucagcgagcucgaaaaugagaagguguaugacgauggagccccagaauguggcauaacgugcugguucaaaaagucgggugaguggguaaugggcauuaucaacgggaauugggucgugcugaucgugcuuuguguccuguugcucuuuucacugauucuacugucuauacucugcccgguucggaagcacaaaaagaguuga

SEQ ID NO: 10240 - RNA, 3423 nt, Artificial Sequence
  derived and/or modified CDS sequence (opt3) from SNV(NM H10)__NC_005215.1__GP
auggugggcugggucugcaucuuccugguugugcucaccacagccacugcugggcuuacgagaaaccuguacgaguugaagauugaauguccccacaccguaggauuaggucagggcuaugugacagggagcgucgagauaacuccuauccugcuaacccaaguggcagaccucaaaauugaauccucuugcaauuuugaucugcauguuccagccacaaccacucagaaguacaaccagguggacuggaccaaaaagucaaguacaacggagagcacuaaugcgggagcuaccacauucgaagccaaaacuaaggagaucaaccuuaagggcaccuguaauauuccgcccacaaccuuugaggcagccuauaaauccaggaagacggucaucugcuacgaucuggcuuguaaccagacucacugcuugccuacagugcaucucauagcaccaguacaaaccuguaugucuguucggucgugcaugaucggucugcugucaagccgcauucaggugaucuaugagaaaacuuacugugucacagggcagcucauugagggauuaugcuucauccccacccacacgauagcccugacccagccuggccauacauaugacacuaugacccuuccagugacaugcuuuuugguggcuaagaaacugggcacucaacuaaagcucgccgucgaacuggagaaacuuauuaccgggguuaguuguacagaaaauuccuuccagggauacuacaucugcuuuauugguaaacacucugaaccccuguucgugccuaccauggaggauuaucgaagcgcggaauuguuuacucguaugguacucaacccaagaggcgaggaccacgauccggaccagaaugggcagggacugaugaggaucgcaggccccgugacggccaaggucccuuccacagaaaccacugagaccaugcaagguaucgcuuucgccggggcaccaauguacucaaguuuuagcacauuagugcggaaagcugaucccgaguauguuuucucuccuggaauuauagccgaauccaaccauucagugugugacaagaaaaccgucccacugacuuggacaggcuuucucgcggugagcggcgagaucgaaaagauuacggggugcaccguauucuguacucuugccggacccggugcaaguugcgaggcuuacucugaaacaggcaucuucaauauauccagcccgaccugucugguuaacaaagugcagaaguuucgcgggucggagcagagaauuaauuucaugugccaaagggucgaucaggacguggucguguauuguaacggacagaagaaaguuaucuugacaaagacucuagugaucggccagugcauuuacaccuuuacgucucuguucucccucaucccugguguagcccacucacuggcugucgagcuuugugugcccgggcugcauggcugggccaccacagcauugcucauuacuuuuugcuucggauggcuguuaauaccagccguuacccugaucauucuaaaaauccuccggcugcuuacauuuaguuguagccacuauuccacugaaucuaaguucaaagugaucuuggagcgcgucaagguggaauaccaaaagaccaugggcagcaugguaugcgauauuugccaccaugagugugaaacggcuaaagagcuggagacacacaagaaaucaugcccugaagggcagugucccuacugcaugaccauaacugagaguacagaauccgcgcuccaggcacauuuugccaucuguaagcugaccaaucgauuccaggagaaccuuaaaaagagccugaagagaccagaggugaggaaaggaugcuaucggacuuuggguguuuuucguuacaagucucgcuguuaugucggccucgugugggggauucuguuaaccacagaacugaucauuugggcugccucagcagacacgccccuaauggagaguggauggagcgacaccgcccacggcguggguaucauaccuaugaaaacugaucucgaacuggacuucgcucuugccuccucuucgagcuacuccuauagaaggaaguuggucaacccagcaaaucaagaggaaacacugccguuucauuuccagcucgauaaacagguugugcacgcggagauccagaaccuggggcacuggauggacggcaccuucaauauuaagacagcuuuucauugcuacggagaguguaagaaauaugccuaccccuggcaaacugcaaagugcuucuuugaaaaagauuaccaguaugagaccucauggggcuguaacccuccagacugccccggggugggaacggguugcacagccuguggcguauacuuagauaagcugcggagugucgggaaggcuuauaagaucgugucucuuaaauacacccgaaagguuugcauucaguugggaacugaacagaccuguaagcacaucgacgugaaugauugccucgucacaccuagcgugaaaguuuguaugauaggcacuauuuccaagcugcaaccaggugacacccuacuguuccucgggccccuggagcagggcggaaucauucuuaaacaguggugcacaacgucauguguguuuggcgauccgggggacaucaugagcaccacuucuggaaugcgcugcccugaacauacaggcuccuucagaaagauaugugguuuugccaccacuccaacaugcgaguaucaagggaacaccguaaguggauuccagaggaugauggcaacgcgggacagcuuucagucuuucaaugucacugagccccacaucaccuccaaccgcuuggaauggauugauccugacucaaguaucaaagaucacauuaauauggugcugaacagagacgugagcuuucaggauuuaucggacaaucccuguaaggucgaucuccauacacaauccaucgacggcgcuugggguucuggcguuggguucacccuggugugcacuguaggacuuacagagugcgccaacuuuauaaccagcauuaaggcgugugauucagccaugugcuacggcgcuacagugacuaaucuguugagggggaguaacaccgucaaagugguuggaaagggcggucacuccgggucucucuucaaauguugccaugacacggauuguacagaagagggacuggcagccagcccaccucaccuagaccgugugaccggcuauaaucagaucgauuccgacaaggucuacgacgauggugcucccccaugcacuaucaaauguugguucaccaagucaggcgaauggcugcucgggauucugaacggaaacugggugguuguggccguccuuaucguaauuuugauacugagcaucuuacucuuuaguuucuuuugcccggugcggucucgaaagaauaaagcaaacuga

SEQ ID NO: 10241 - RNA, 3423 nt, Artificial Sequence
  derived and/or modified CDS sequence (opt3) from SNV(1)__JQ690283.1__GP
auggugggcugggucugcaucuuccugguugugcucaccacagccacugcugggcuuacgagaaaccuguacgaguugaagauugaauguccccacaccguaggauuaggucagggcuaugugacagggagcgucgagacuaccccuauacugcuaacacaaguggcagaccucaaaaucgaauccucuugcaauuuugaucugcauguuccagccaccacuacacagaaguacaaccagguggacuggaccaaaaagucaaguacgacugagagcaccaaugcgggagcugccacauucgaagcaaaaacuaaggaggucaaccuuaagggcaccuguaauauuccgcccacaaccuuugaggccgcuuauaaauccaggaagacggugaucugcuacgaucuggcauguaaccagacucacugcuugccuacaguacaucucauugccccaguucaaaccuguaugucugugcggucgugcaugaucggucugcugucaagccgcauacaggucaucuaugagaaaacuuacugugugacagggcagcucauugagggauuaugcuucauccccacccacacgauugcucugacccagccuggccauacauaugacacuaugacccuuccagugacauguuuucuagucgccaagaaacugggcacucaacuaaagcucgcgguugaacuggagaaacuuaucaccggggugaguugcacagaaaauuccuuccagggauacuacauaugcuuuauugguaagcacucugaaccccuguucguaccuaccauggaggauuaucgaagcgcagaauuguuuacucguauggugcucaacccaagaggcgaggaccacgauccggaccagaaugggcagggacugaugaggaucgccggccccgucacggcuaaggugccuuccacagaaaccacugagaccaugcaagguauugccuucgcaggggcuccaauguacucaaguuuuagcacauuaguucggaaagccgaucccgaguauguguucucuccuggaaucaucgcggaauccaaccauucagucugugacaagaaaaccgugccacugacuuggacaggcuuucucgccguaagcggcgagauugaacgcauaacggggugcaccguuuucuguacucuugcaggacccggugcuaguugcgaggccuacucugaaacaggcaucuucaauauuuccagcccgaccugucuggugaacaagguccagaaauuuagagggucggagcagaggaucaauuucaugugccaacggguggaucaggacgucgugguuuauuguaacggacagaagaaggugauauugacaaaaacucuaguaauuggccagugcaucuacaccuuuacgucucuguucucccucaucccuggugucgcucacucacuggccguggagcuuuguguucccgggcugcauggcugggcaaccacagccuugcucauuacuuuuugcuucggauggcuguuaaucccaaccgugacacugauuauacuaaagguccuccgccugcuuacuuuuaguuguagccacuauuccaccgaaucuaaauucaaggugaucuuggagcgaguaaaaguggaauaccaaaagacgaugggcagcaugguuugcgauauuugccaccaugagugugaaacagcuaaggagcuggagacccacaaaaagucaugcccugaagggcagugucccuacugcaugacuaucacagagaguaccgaauccgcgcuccaggcacauuuuagcaucuguaaacugacuaauagauuccaggagaaccuuaagaaaucucugaagaggccagagguccggaagggaugcuaucguaccuuggguguguuucgcuacaaaucaagauguuaugugggccucgucugggggauucuguuaacaacggaacugauaaucugggccgcuagugccgacacccccuugauggagagcggaugguccgacacugcacacggcguugguauuaucccuaugaagacagaucucgaacuggacuucgcccuugcuucuucgagcuccuacucauauaggcggaaauuggugaacccagccaaucaagaggaaacccugccguuucauuuccagcucgauaaacaggugguacacgcagagauucagaaccuggggcacuggauggacggcacauucaauaucaagacugcguuucauugcuacggagaguguaagaaguaugcuuaccccuggcaaaccgccaaaugcuucuuugaaaaggauuaccaguaugagacgaguuggggcuguaacccuccagacugccccggggucggaacagguugcaccgcauguggcguguacuuagauaaacugcgaucuguugggaaggccuauaaaauagugagccuuaaguacacucgcaaagucugcauccaguugggaaccgaacagacauguaagcacauugacgugaaugauugccucguuacuccuuccgugaagguauguaugaucggcaccauuucaaaacugcaaccaggugacacacuacuguuccucgggccccuggagcagggcggaaucauacuuaagcaguggugcacgaccagcugugucuuuggcgauccgggggacauuaugucuacuacauccggaaugagaugcccugaacauaccggcaguuucaggaaaaucugugguuuugcuacuacaccaaccugcgaguaucaagggaacacggugagcggauuccagcggaugauggccacucgcgacucuuuucaguccuucaaugugaccgagccccacauuacaucaaacagauuggaauggaucgauccugacaguagcauaaaggaucacaucaauaugguccugaacagggacguuucguuucaggauuuauccgacaaucccuguaaaguggaucuccauacccaaucuauugacggcgcaugggguagcggcguaggguucacucuggugugcacagucggacuuaccgagugcgcuaacuuuaucacaucaauuaaggccugugauagugcgaugugcuacggcgccacugugaccaaucuguugcguggguccaacacgguuaagguggucggaaaaggcggucacucugggagccucuucaaguguugccaugacacagauuguaccgaagagggacuggcugcauccccaccucaccuagaccgggugacuggcuauaaucagaucgauucagacaaaguuuacgacgauggugcucccccaugcaccauaaaguguugguucacaaaaagcggcgaauggcugcucgggauucugaacggaaacuggguggucguagccgugcuuaucguuaucuugauucugaguaucuuacucuuuucuuucuuuugcccggugcgaaauagaaagaacaaggccaauuga

SEQ ID NO: 10242 - RNA, 3423 nt, Artificial Sequence
  derived and/or modified CDS sequence (opt3) from SNV(1)__JQ690279.1__GP
auggugggcugggucugcaucuuccugguugugcucaccacagccacugcugggcuuacgagaaaccuguacgaguugaagauugaauguccccacaccguaggauuaggucagggcuaugugacagggagcgucgagacuaccccuauacugcuaacacaaguggcagaccucaaaaucgaauccucuugcaauuuugaucugcauguuccagccaccacuacacagaaguacaaccagguggacuggaccaaaaagucaaguacgacugagagcaccaaugcgggagcuaacacauucgaagccaaaacuaaggagauuaaucuuaagggcaccuguaacaucccgcccacaaccuuugaggcagccuauaaauccaggaagacggucauuugcuacgaucuggcuuguaaucagacucacugcuugccuacagugcaucucaucgcaccaguacaaaccuguaugucuguucggucgugcaugauaggucugcugucaagccgcauccaggugauuuaugaaaagacuuacugugucacagggcagcucaucgagggauuaugcuucauucccacccacacgaucgcccugacccagccuggccauacauaugacacuaugacccuuccagugacaugcuuuuugguggcuaagaaacugggcacucaacuaaagcucgccgucgaacuggagaagcugauaaccgggguuaguuguacagagaacuccuuccagggauacuacauuugcuuuaucgguaaacacucugaaccccuguucgugccuaccauggaggauuaucgaagcgcggaauuguuuacucguaugguacucaauccaagaggcgaggaccacgauccggaccagaacgggcagggacugaugaggauugcaggccccgugacggccaaggucccuuccacagaaaccacugagaccaugcaagguaucgcuuucgccggggcaccaauguacucaaguuuuagcacauuagugcggaaagcugaucccgaguauguuuucucuccuggaaucauugccgaauccaaucauucagugugugacaagaaaaccgucccacugacuuggacaggcuuucucgcggugagcggcgagauagaacgcaucacggggugcaccguauucuguacucuugccggacccggugcaaguugcgaggcuuacucugaaacaggcauuuucaacaucuccagcccgaccugucugguuaauaaggugcagaaauuuagagggucggagcagaggauaaacuucaugugccaacgggucgaucaggacguggucguguauuguaauggacagaagaagguuauuuugacaaaaacucuagugaucggccagugcaucuacaccuuuacgucucuguucucccucauuccugguguagcccacucacuggcugucgagcuuugugugcccgggcugcauggcugggccaccacagcauugcucaucacuuuuugcuucggauggcuguuaauuccaaccguuacacugcuaauacucaagauccugcgccuuuugacuuuuaguuguagccacuauuccaccgaaucuaaauucaaggugauucuggagcgagucaaaguggaauaccaaaagacgaugggcagcaugguaugcgauaucugccaccaugagugugaaacagccaaggagcucgagacccacaaaaagucaugcccugaagggcagugucccuacugcaugacuaucacagagaguaccgaauccgcucugcaggcgcauuuuagcauuuguaaacuuacuaacagauuccaggagaaccugaagaaaucuuugaagaggccagaggugaagaaaggaugcuaucggacccucgguguuuuucguuacaagucacgcuguuaugucggccuggugugggggauauuacugacaacggaacuaaucauuugggcagccagugcugacacuccccucauggagagcggaugguccgacacugcccacggcguggguaucauuccuaugaaaucugaucuggaacuugacuucgcauuggccucgagcuccucauacaguuauagaaggaagcuggucaauccagcuaaccaagaggaaacacucccguuucauuuccagcuggauaaacagguugugcacgccgagauccagaauuuagggcacuggauggacggcaccuucaacauaaagacagcauuucauugcuacggagaguguaagaaauaugcguaccccuggcaaacugcuaagugcuucuuugaaaaagauuaccaguaugagaccucuuggggcuguaauccuccagacugccccggggugggaacggguugcacagccuguggcguauaccuggauaaacuucggagcgucgggaaagcauauaagaucguguccuugaaauacacccgaaagguuugcauucagcucggaacugaacagaccuguaagcacaucgacgugaacgauugccuggucacaccuucagugaaaguuuguaugauuggcacuaucagcaagcuacaaccaggugacacccuucucuuccuggggccccuugagcagggcggaauaauuuugaaacaguggugcacaacgucuuguguguuuggcgauccgggggacaucauguccaccaccaguggaaugcgcugcccugaacauacaggcagcuucagaaagauuugugguuuugccaccacuccaacaugcgaguaucaagggaauaccguaucuggauuccagaggaugauggcuacgcgggacuccuuucagucauucaacgucacugagccccacaucaccaguaaucgccuggaauggauagauccugacagcucgaucaaagaucacauuaacaugaucuuaaauagagacguguccuuucaggaucucucugacaaccccuguaagguggaucugcauacacaaagcauugacggcgccugggguucaggcgucggguucacccuuguuugcacugugggacugacagagugcgcaaauuuuaucaccaguauaaaggcuugugauuccgccaugugcuacggcgcgacaguaacuaacuugcucagggggucuaauaccgugaaagucgugggaaagggcggucacagcgggucccuguucaaauguugccaugacacggauuguacagaagagggacuagccgcuucaccaccucaccuggaccguguuaccggcuauaaccagauugauagcgacaagguguacgacgauggugcacccccaugcacuaucaaauguugguucaccaagaguggcgaauggcuccuggggauccuuaacggaaauugggucgugguugccguguugauugucauccugauuuuaucuauacuccuguuuuccuucuuuugcccgguacggagccgaaagaacaaagcuaauuga

SEQ ID NO: 10243 - RNA, 3423 nt, Artificial Sequence
  derived and/or modified CDS sequence (opt3) from SNV(2)__JQ690284.1__GP
auggugggcugggucugcaucuuccugguugugcucaccacagccacugcugggcuuacgagaaaccuguacgaguugaagauugaauguccccacaccguaggauuaggucagggcuaugugacagggagcgucgagacuaccccuauacugcuaacacaaguggcagaccucaaaaucgaauccucuugcaauuuugaucugcauguuccagccaccacuacacagaaguacaaccagguggacuggaccaaaaagggaucaacgacugagaguaccaaugcgggcgcuaacacauucgaagccaaaacuaaggaggucaaucuuaaggguaccuguaacauuccgcccacaaccuuugaggcagccuauaaaagcaggaagacggugaucugcuacgaucuggcuuguaaucagacucacugcuugccuacaguacaucucauugcaccaguucaaaccuguauguccgugcggucuugcaugaucgggcugcugucgucacgcauacaggucaucuaugaaaagacuuacugugugacaggacagcucauugagggcuuaugcuucauccccacccacacgauugcccugacccagccuggccauacauaugacacuaugacccuuccagugacauguuuucuugucgcuaagaaacuggggacucaacuaaagcucgccguugaacuggagaaguugaucaccggagugagcugcacagagaacaguuuccaggguuacuacauaugcuuuauuggcaaacacuccgaaccccuguucguaccuaccauggaggauuaucgaucugcggaaguguuuacucguauggucuugaauccaagaggggaggaccacgauccggaccagaacggacagggccucaugaggaucgcaggucccgugacggccaagguuccuagcacagaaaccacugagaccaugcaagggauugcuuucgccggagcaccaauguacuccucauuuaguacacuggugcggaaagcugaucccgaguaugucuucagcccuggcaucaucgccgaaucuaaucauuccgugugugacaagaaaaccguaccauuaacuuggacaggcuuucuggcgguuucaggggagauugaacgcauaacgggaugcaccguguucuguacucucgccggucccggcgcaagcugcgaggcuuacagugaaacagggaucuucaacauuucuuccccgaccugucuugucaauaaggugcagaaauuuagaggaagcgagcagaggaucaacuucaugugccaacgggucgaucaggacgugguuguguauuguaauggccagaagaagguaauacugacaaaaacuuuggucauuggucagugcaucuacaccuuuacgucgcuauucucucugaucccugggguggcccacucccucgcuguugagcugugugugcccggccuucauggaugggccaccacagcacuguugauuacuuuuugcuucggcuggcuccugaucccaaccgucacauuaauuauacugaagauccuacgccuccugacuuuuucauguagucacuauagcaccgaauccaaauucaaggugauucuugagcgaguaaaaguggaauaccaaaagacgauggggucuaugguuugcgauaucugccaccaugagugugaaacagccaaggaguuggagacccacaaaaagagcugcccugaaggacagugucccuacugcaugacuaucacagagucaaccgaaagugcucugcaggcgcauuuuuccauuuguaaacucacuaacagauuccaggagaaccugaagaaaagccuuaagaggccagaggucaagaaagguugcuaucggacccugggcguguuucguuacaagucucgcuguuaugugggguuggucuggggaauacuccugacaacggaauuaaucauuugggcagccucagcugacacuccccugauggagaguggcuggagcgacaccgcccacgguguugggaucauuccuaugaaaacagaucuagaacucgacuucgcacuggccuccucuucgagcuacuccuauagaaggaaacuugugaauccagcuaaccaagaggaaaccuugccguuucauuuccagcuggauaaacaggugguacacgccgagauccagaaucucggccacuggauggacggaacauucaacauaaagacugcauuucauugcuacggcgaguguaagaaauaugcguaccccuggcaaaccgcuaagugcuucuuugaaaaagauuaccaguaugagacgucauggggguguaauccuccagacugccccggagucgguacaggcugcaccgccugugggguguaccuggauaaguuacggaguguuggaaaagcauauaagaucgugucucugaaauacacucgaaaggucugcauucagcuuggcaccgaacagacauguaagcacaucgacgugaacgauugcuugguuacuccuagcgugaaaguauguaugauugguaccaucuccaagcuccaaccaggggacacacugcuauuccugggcccccucgagcagggaggcauaauucugaaacaguggugcacgaccucaugugucuuuggggauccgggagacaucaugagcacuacaucuggcaugcgcugcccugaacauaccgguuccuucagaaagauuuguggguuugccacuacaccaaccugcgaguaucaaggaaauacggugaguggcuuccagaggaugauggcuacucgggacagcuuucagucuuucaacgugaccgagccccacaucacauccaaucgccuugaauggauagauccugacucaaguaucaaagaucacauuaacauggucuugaauagagacguuagcuuucaggaucugucggacaaccccuguaagguggauuuacauacccaauccaucgacggugccuggggcucugggguaggauucacucucgugugcacagucggccugaccgagugcgcaaauuuuauuacaagcaucaaggcuugugauucagccaugugcuacggggcgacugugaccaaccuucugaggggaaguaauacgguuaaaguggucggcaagggugggcacuccggaucuuuguucaaauguugccaugacacagauuguaccgaagagggccucgccgcuagcccaccucaccuggaccgugugacugguuauaaccagauagauuccgacaagguuuacgacgauggcgcacccccaugcaccauuaaauguugguucacaaagucaggggaauggcuacugggaauccucaacggcaauuggguggucguagccgugcugaucguuauucuuaucuugagcauucuguuauuuaguuucuuuugcccggugcggucucgaaagaacaaagcuaauuga

SEQ ID NO: 10244 - RNA, 3423 nt, Artificial Sequence
  derived and/or modified CDS sequence (opt3) from SNV(2)__JQ690280.1__GP
auggugggcugggucugcaucuuccugguugugcucaccacagccacugcugggcuuacgagaaaccuguacgaguugaagauugaauguccccacaccguaggauuaggucagggcuaugugacagggagcgucgagacuaccccuauacugcuaacacaaguggcagaccucaaaaucgaauccucuugcaauuuugaucugcauguuccagccaccacuacacagaaguacaaccagguggacuggaccaaaaagucaaguacgacugagagcaccaaugcgggagcuaacacauucgaagccaaaacuaaggaggucaaucuuaagggcaccuguaacauuccgcccacaaccuuugaggcagccuauaaauccaggaagacggugaucugcuacgaucuggcuuguaaucagacucacugcuugccuacaguacaucucauugcaccaguucaaaccuguaugucugugcggucgugcaugaucggucugcugucaagccgcauacaggucaucuaugaaaagacuuacugugugacagggcagcucauugagggauuaugcuucauccccacccacacgauugcccugacccagccuggccauacauaugacacuaugacccuuccagugacauguuuucuagucgcuaagaaacugggcacucaacuaaagcucgccguugaacuggagaaacuuaucaccggggugaguugcacagagaacuccuuccagggauacuacauaugcuuuauugguaaacacucugaaccccuguucguaccuaccauggaggauuaucgaagcgcggaauuguuuacucguauggugcucaauccaagaggcgaggaccacgauccggaccagaacgggcagggacugaugaggaucgcaggccccgucacggccaaggugccuuccacagaaaccacugagaccaugcaagguauugcuuucgccggggcaccaauguacucaaguuuuagcacauuaguucggaaagcugaucccgaguauguguucucuccuggaaucaucgccgaauccaaucauucagucugugacaagaaaaccgugccacugacuuggacaggcuuucucgcgguaagcggcgagauugaacgcauaacggggugcaccguuuucuguacucuugccggacccggugcaaguugcgaggcuuacucugaaacaggcaucuucaacauuuccagcccgaccugucuggugaauaagguccagaaauuuagagggucggagcagaggaucaacuucaugugccaacggguggaucaggacgucgugguuuauuguaauggacagaagaaggugauauugacaaaaacucuaguaauuggccagugcaucuacaccuuuacgucucuguucucccucaucccuggugucgcccacucacuggcuguggagcuuuguguucccgggcugcauggcugggccaccacagcauugcucauuacuuuuugcuucggauggcuguuaaucccaaccgugacacugauuauacuaaagauccuccgccugcuuacuuuuaguuguagccacuauuccaccgaaucuaaauucaaggucauuuuggagcgagugaaaguagaauaccaaaagacgaugggcagcauggugugcgauaucugccaccaugagugugaaacagccaaggagcuggagacccacaaaaagucaugcccugaagggcagugucccuacugcaugacuaucacagagaguaccgaauccgcucuccaggcgcauuuuagcauuuguaaacugacuaacagauuccaggagaaccuuaagaaaucucugaagaggccagagguuaagaaaggaugcuaucggaccuugggugucuuucguuacaagucacgcuguuaugugggccucgugugggggauacuguuaacaacggaacugaucauuugggcagccagugcugacacccccuugauggagagcggaugguccgacacugcccacggcgucgguaucauuccuaugaaaacagaucucgaacuggacuucgcacuugccucuucgagcuccuacucauauagaaggaaguugguuaauccagcuaaccaagaggaaacccugccguuucauuuccagcucgauaaacagguggugcacgccgagauccagaaucuggggcacuggauggacggcacauucaacauaaagacugcauuucauugcuacggagaguguaagaaauaugcguaccccuggcaaaccgcuaagugcuucuuugaaaaagauuaccaguaugagacgaguuggggcuguaauccuccagacugccccgggguaggaacagguugcaccgccuguggcgucuacuuagauaagcugcggucuguggggaaagcauauaagaucguuagccuuaaauacacucgaaaggugugcauucaguugggaaccgaacagacauguaagcacaucgacgucaacgauugccucgugacuccuuccguuaaaguguguaugauuggcaccaucucaaagcugcaaccaggugacacacuacuguuccucgggccccuggagcagggcggaauaauucuuaaacaguggugcacgaccagcuguguauuuggcgauccgggggacaucaugucuacuacauccggaaugcgcugcccugaacauaccggcaguuucagaaagauuugugguuuugccacuacaccaaccugcgaguaucaagggaauacggucagcggauuccagaggaugauggcuacucgggacucuuuucaguccuucaacgugaccgagccccacaucacaucaaaucgcuuggaauggauagauccugacaguagcaucaaagaucacauuaacauggugcugaauagagacgucucguuucaggauuuauccgacaaccccuguaagguugaucuccauacccaaucuaucgacggcgccugggguagcggcgugggguucacucugguaugcacagugggacuuaccgagugcgcaaauuuuauuacaucaaucaaggcuugugauagugccaugugcuacggcgcgacugucaccaaccuguugaggggguccaauacggugaaaguugugggaaagggcggucacucugggagccucuucaaauguugccaugacacagauuguaccgaagagggacuggccgcuuccccaccucaccuagaccgugucacuggcuauaaccagauagauucagacaagguguacgacgauggugcacccccaugcaccauuaaauguugguucacaaagagcggcgaauggcugcucgggauccugaacggaaauuggguuguggucgccguacuuaucgugauuuugauccugaguauuuuacucuuuucuuucuuuugcccgguucggucccgaaagaacaaagcuaauuga

SEQ ID NO: 10245 - RNA, 3423 nt, Artificial Sequence
  derived and/or modified CDS sequence (opt3) from SNV(CC107/POR)__KT885045.1__GP
auggugggcugggucugcaucuuccugguugugcucaccacagccacugcugggcuuacgagaaaccuguacgaguugaagauugaauguccccacaccguaggauuaggucagggcuaugugacagggagcgucgagacuaccccuauacugcuaacacaaguggcagaccucaaaaucgaauccucuugcaauuuugaucugcauguuccagccaccacuacacagaaguacaaccagguggacuggaccaaaaagucaaguacgacugagagcaccaaugcgggagcuacaacuuucgaagccaaaaccaaggaggucaaccuuaagggcacauguaauauuccgcccaccacguuugaggcagccuauaaauccaggaagacugugaucugcuacgaucuggcuuguaaccagacacacugcuugccuaccguacaucucauugcaccaguucaaacuuguaugucugugcggucgugcaugaucggucugcugucaagccgcauacaggucaucuaugagaaaacauacugugugaccgggcagcucauugagggauuaugcuucauccccacgcacaccauugcccugacacagccuggccauacuuaugacaccaugacacuuccagugacuuguuuucuugucgcuaagaaacugggcacccaacuaaagcucgccguugaacuggagaaguugaucacaggggugaguugcaccgaaaauuccuuccagggauacuacauaugcuuuauugguaaacacucugaaccccuguucguaccuacuauggaggauuaucgaagcgcggaauuguuuacgcguauggugcucaacccaagaggcgaggaccacgauccggaccagaaugggcagggacugaugaggaucgcaggccccgucacagccaaggugccuuccaccgaaacuaccgagacaaugcaagguauugcuuucgccggggcaccaauguacucaaguuuuagcaccuuaguucggaaagcugaucccgaguauguguucucuccuggaaucaucgccgaauccaaccauucagucugugacaagaaaacugugccacugacauggacgggcuuucucgcgguaagcggcgagauugaacgcauaaccgggugcacuguuuucuguacacuugccggacccggugcaaguugcgaggcuuacucugaaaccggcaucuucaauauuuccagcccgacaugucuggugaacaagguccagaaauuuagagggucggagcagaggaucaauuucaugugccaacggguggaucaggacgucgugguuuauuguaacggacagaagaaggugauauugacuaaaacccuaguaauuggccagugcaucuacacguuuaccucucuguucucccucaucccuggugucgcccacucacuggcuguggagcuuuguguucccgggcugcauggcugggccacaacugcauugcucauuaccuuuugcuucggauggcuguuaaucccaacagugacucugauuauacuaaagauccuccgccugcuuaccuuuaguuguagccacuauuccacggaaucuaaauucaaggucauuuuggagcgagugaaaguagaauaccaaaagacaaugggcagcauggugugcgauaucugccaccaugagugugaaaccgccaaggagcuggagacucacaaaaagucaugcccugaagggcagugucccuacugcaugacaaucaccgagaguacugaauccgcucuccaggcgcauuuuagcauuuguaaacugaccaauagauuccaggagaaccuuaagaaaucucugaagaggccagagguucggaagggaugcuaucguacauugggugucuuucgcuacaaaucaagauguuaugugggccucgugugggggauacuguuaacgaccgaacugaucauuugggcagccagugcugacacuccccuaauggagagcggaugguccgacacagcccacggcgucgguaucguuccuaugaagaccgaucucgaacuggacuucgcacuugccucuucgagcuccuacucauauaggcggaaauuggugaacccagcuaaucaagaggaaacacugccguuucauuuccagcucgauaaacaggugguacacgccgagauucagaaccuggggcacuggauggacggcacuuucaauaucaagaccgcauuucauugcuacggagaguguaagaaguaugcguaccccuggcaaacggcuaaaugcuucuuugaaaaggauuaccaguaugagacaaguuggggcuguaacccuccagacugccccggggucggaaccgguugcacugccuguggcguguacuuagauaaacugcgaucuguugggaaggcauauaaaauagugagccuuaaguacacccgcaaagucugcauccaguugggaacagaacagacuuguaagcacauugacgugaaugauugccucguuaccccuuccgugaagguauguaugaucggcacaauuucaaaacugcaaccaggugacacgcuacuguuccucgggccccuggagcagggcggaaucauacuuaagcaguggugcaccacuagcugugucuuuggcgauccgggggacauuaugucuacaaccuccggaaugagaugcccugaacauacuggcaguuucaggaaaaucugugguuuugccacaaccccaacgugcgaguaucaagggaacacugugagcggauuccagcggaugauggcuacccgcgacucuuuucaguccuucaaugugacagagccccacauuaccucaaacagauuggaauggaucgauccugacaguagcauaaaggaucacaucaauaugguccugaacagggacguuucguuucaggauuuauccgacaaucccuguaaaguggaucuccauacucaaucuauugacggcgccugggguagcggcguaggguucacacuggugugcaccgucggacuuacagagugcgcaaacuuuaucacuucaauuaaggcuugugauagugccaugugcuacggcgcgaccgugacgaaucuguugcguggguccaacacaguuaagguggucggaaaaggcggucacucugggagccucuucaaguguugccaugacaccgauuguacugaagagggacuggccgcuuccccaccucaccuagaccgggugaccggcuauaaucagaucgauucagacaaaguuuacgacgauggugcacccccaugcacaauaaaguguugguucacuaaaagcggcgaauggcugcucgggauucugaacggaaacuggguggucguagccgugcuuaucguuaucuugauucugaguaucuuacucuuuucuuucuuuugcccggugcgaaauagaaagaacaaggcuaauuga

SEQ ID NO: 10246 - RNA, 3423 nt, Artificial Sequence
  derived and/or modified CDS sequence (opt3) from HPS(Convict Creek 107)__L33474.1__GP
auggugggcugggucugcaucuuccugguugugcucaccacagccacugcugggcuuacgagaaaccuguacgaguugaagauugaauguccccacaccguaggauuaggucagggcuaugugacagggagcgucgagacuaccccuauacugcuaacacaaguggcagaccucaaaaucgaauccucuugcaauuuugaucugcauguuccagccaccacuacacagaaguacaaccagguggacuggaccaaaaagucaaguacgacugagagcaccaaugcgggagcuacaacuuucgaagccaaaaccaaggaggucaaccuuaagggcacauguaauauuccgcccaccacguuugaggcagccuauaaauccaggaagacugugaucugcuacgaucuggcuuguaaccagacacacugcuugccuaccguacaucucauugcaccaguucaaacuuguaugucugugcggucgugcaugaucggucugcugucaagccgcauacaggucaucuaugagaaaacauacugugugaccgggcagcucauugagggauuaugcuucauccccacgcacaccauugcccugacacagccuggccauacuuaugacaccaugacacuuccagugacuuguuuucuugucgcuaagaaacugggcacccaacuaaagcucgccguugaacuggagaaguugaucacaggggugaguugcaccgaaaauuccuuccagggauacuacauaugcuuuauugguaaacacucugaaccccuguucguaccuacuauggaggauuaucgaagcgcggaauuguuuacgcguauggugcucaacccaagaggcgaggaccacgauccggaccagaaugggcagggacugaugaggaucgcaggccccgucacagccaaggugccuuccaccgaaacuaccgagacaaugcaagguauugcuuucgccggggcaccaauguacucaaguuuuagcaccuuaguucggaaagcugaucccgaguauguguucucuccuggaaucaucgccgaauccaaccauucagucugugacaagaaaacugugccacugacauggacgggcuuucucgcgguaagcggcgagauugaacgcauaaccgggugcacuguuuucuguacacuugccggacccggugcaaguugcgaggcuuacucugaaaccggcaucuucaauauuuccagcccgacaugucuggugaacaagguccagaaauuuagagggucggagcagaggaucaauuucaugugccaacggguggaucaggacgucgugguuuauuguaacggacagaagaaggugauauugacuaaaacccuaguaauuggccagugcaucuacacguuuaccucucuguucucccucaucccuggugucgcccacucacuggcuguggagcuuuguguucccgggcugcauggcugggccacaacugcauugcucauuaccuuuugcuucggauggcuguuaaucccaacagugacucugauuauacuaaagauccuccgccugcuuaccuuuaguuguagccacuauuccacggaaucuaaauucaaggucauuuuggagcgagugaaaguagaauaccaaaagacaaugggcagcauggugugcgauaucugccaccaugagugugaaaccgccaaggagcuggagacucacaaaaagucaugcccugaagggcagugucccuacugcaugacaaucaccgagaguacugaauccgcucuccaggcgcauuuuagcauuuguaaacugaccaauagauuccaggagauacuuaagaaaucucugaagaggccagagguucggaagggaugcuaucguacauugggugucuuucgcuacaaaucaagauguuaugugggccucgugugggggauccuguuaacgaccgaacugauuaucugggcagccagugcugacacuccccuaauggagagcggaugguccgacacagcccacggcgucgguauuguuccuaugaagaccgaucucgaacuggacuucgcacuugccucuucgagcuccuacucauauaggcggaaauuggugaacccagcuaaccaagaggaaacacugccguuucauuuccagcucgauaaacaggugguacacgccgagauccagaaucuggggcacuggauggacggcacuuucaacauaaagaccgcauuucauugcuacggagaguguaagaaguaugcguaccccuggcaaacggcuaaaugcuucuuugaaaaggauuaccaguaugagacaaguuggggcuguaauccuccagacugccccggggucggaaccgguugcacugccuguggcguguacuuagauaaacugcgaucuguugggaaggcauauaaaaucgugagccuuaaguacacccgcaaagucugcauucaguugggaacagaacagacuuguaagcacaucgacgugaacgauugccucguuaccccuuccgugaagguauguaugauuggcacaaucucaaaacugcaaccaggugacacgcuacuguuccucgggccccuggagcagggcggaauaauucuuaagcaguggugcaccacuagcugugucuuuggcgauccgggggacaucaugucuacaaccuccggaaugagaugcccugaacauacuggcaguuucaggaaaauuugugguuuugccacaaccccaacgugcgaguaucaagggaauacugugagcggauuccagcggaugauggcuacccgcgacucuuuucaguccuucaacgugacagagccccacaucaccucaaauagauuggaauggauagauccugacaguagcaucaaggaucacauuaacaugguccugaauagggacguuucguuucaggauuuauccgacaaccccuguaaaguggaucuccauacucaaucuaucgacggcgccugggguagcggcguaggguucacacuggugugcaccgucggacuuacagagugcgcaaauuuuauuacuucaaucaaggcuugugauagugccaugugcuacggcgcgaccgugacgaaccuguugcguggguccaauacaguuaagguggucggaaaaggcggucacucugggagccucuucaaguguugccaugacaccgauuguacugaagagggacuggccgcuuccccaccucaccuagaccgggugaccggcuauaaccagauagauucagacaaaguuuacgacgauggugcacccccaugcacaauuaaguguugguucacucgaagcggcgaauggcugcucgggauccugaauggaaacuggguggucguagccgugcuuaucguuauuuugauccugaguauuuuacucuuuucuuucuuuugcccggugagaaacaggaaaaauaaggcuaacuga

SEQ ID NO: 10247 - RNA, 3423 nt, Artificial Sequence
  derived and/or modified CDS sequence (opt3) from HPS(Convict Creek 74)__L33684.1__GP
auggugggcugggucugcaucuuccugguugugcucaccacagccacugcugggcuuacgagaaaccuguacgaguugaagauugaauguccccacaccguaggauuaggucagggcuaugugacagggucugucgagacuaccccuauacugcuaacacaaguggcagaccucaaaaucgaauccucuugcaauuuugaucugcauguuccagccaccacuacacagaaguacaaccagguggacuggaccaaaaagucaaguacgacugagagcaccaaugcgggagcuacaacuuucgaagccaaaaccaaggaggucaaccuuaagggcacauguaauauuccgcccaccacguuugaggcagccuucaaauccaggaagacugugaucugcuaugaucuggcuuguaaccagacacacugcuugccuaccguacaucucauugcaccaguucaaacuuguaugucugugcggucgugcaugaucggucugcugucaagccgcauacaggucaucuacgagaaaacauauugugugaccgggcagcucauugagggauuaugcuuuauccccacgcacaccauugcccugacacagccuggccauacuuacgacaccaugacacuuccagugacuuguuucuuggucgcuaagaaacugggcacccaacuaaagcucgccguugaacuggagaaacuuaucacaggggugaguugcaccgaaaauuccuuucagggauauuacauaugcuucauugguaagcacucugaaccccuguuuguaccuacuauggaggauuaccgaagcgcggaauuguucacgcguauggugcucaacccaagaggcgaggaccacgauccggaccagaaugggcagggacugaugaggaucgcaggccccgucacagccaaggugccuuccaccgaaacuaccgagacaaugcaagguauugcuuuugccggggcaccaauguauucaaguuucagcaccuuaguucggaaagcugaucccgaguacguguuuucuccuggaaucaucgccgaauccaaccauucagucugugacaagaaaacugugccacugacauggacgggcuuccucgcgguaagcggcgagauugaacgcauaaccgggugcacuguuuucuguacacuugccggacccggugcaaguugcgaggcuuauucugaaaccggcaucuuuaauauuuccagcccgacaugucuggugaacaagguccagaaauucagagggucggagcagaggaucaauuuuaugugccaacggguggaucaggacgucgugguuuacuguaacggacagaagaaggugauauugacuaaaacccuaguaauuggccagugcaucuauacguucaccucucuguuuucccucaucccuggugucgcccacucacuggcuguggagcuuuguguucccgggcugcauggcugggccacaacugcauugcucauuaccuucugcuuuggauggcuguuaaucccaacagugacucugauuauacuaaagauccuccgccugcuuaccuucaguuguagccacuacuccacggaaucuaaauuuaaggucauuuuggagcgagugaaaguagaauaucaaaagacaaugggcagcauggugugcgauaucugccaccaugagugugaaaccgccaaggagcuggagacucacaaaaagucaugcccugaagggcagugucccuacugcaugacaaucaccgagaguacugaauccgcucuccaggcgcauuucagcauuuguaaacugaccaauagauuucaggagauacuuaagaaaucucugaagaggccagagguucggaagggaugcuaccguacauugggugucuuccgcuauaaaucaagauguuacgugggccucgugugggggauccuguuaacgaccgaacugauuaucugggcagccagugcugacacuccccuaauggagagcggaugguccgacacagcccacggcgucgguauuguuccuaugaagaccgaucucgaacuggacuuugcacuugccucuucgagcuccuauucauacaggcggaaauuggugaacccagcuaaccaagaggaaacacugccguuccauuuccagcucgauaaacaggugguacacgccgagauccagaaucuggggcacuggauggacggcacuuuuaacauaaagaccgcauuccauugcuauggagaguguaagaaguacgcguaucccuggcaaacggcuaaaugcuuuuucgaaaaggauuaccaguacgagacaaguuggggcuguaauccuccagacugccccggggucggaaccgguugcacugccuguggcguguauuuagauaaacugcgaucuguugggaaggcauacaaaaucgugagccuuaaguauacccgcaaagucugcauucaguugggaacagaacagacuuguaagcacaucgacgugaacgauugccucguuaccccuuccgugaagguauguaugauuggcacaaucucaaaacugcaaccaggugacacgcuacuguuucucgggccccuggagcagggcggaauaauucuuaagcaguggugcaccacuagcugugucuucggcgauccgggggacaucaugucuacaaccuccggaaugagaugcccugaacauacuggcaguuuuaggaaaauuugugguuucgccacaaccccaacgugcgaguaccaagggaauacugugagcggauuucagcggaugauggcuacccgcgacucuuuccaguccuuuaacgugacagagccccacaucaccucaaauagauuggaauggauagauccugacaguagcaucaaggaucacauuaacaugguccugaauagggacguuucguuccaggauuuauccgacaaccccuguaaaguggaucuccauacucaaucuaucgacggcgccugggguagcggcguaggguuuacacuggugugcaccgucggacuuacagagugcgcaaauuucauuacuucaaucaaggcuugugauagugccaugugcuauggcgcgaccgugacgaaccuguugcguggguccaauacaguuaagguggucggaaaaggcggucacucugggagccucuucaaguguugccaugacaccgauuguacugaagagggacuggccgcuuccccaccucaccuagaccgggugaccggcuacaaccagauagauucagacaaaguuuaugacgauggugcacccccaugcacaauuaaguguugguuuacuaaaagcggcgaauggcugcucgggauccugaauggaaacuggguggucguagccgugcuuaucguuauuuugauccugaguauuuuacucuucagcuuuuucugcccggugcgaaacagaaagaauaaggcuaacuga

SEQ ID NO: 10248 - RNA, 3423 nt, Artificial Sequence
  derived and/or modified CDS sequence (opt3) from BRV(Indiana)__AF030551.1__GP
auggugggcugggucugcaucuuccugguugugcucaccacagccacugcugggcuuacgagaaaccuguacgaguugaagauugaauguccccacaccguaggauuaggucagggcuaugugacagggagcgucgagacuaccccugugccacugggacaaguuacagaccuaaaaauagaauccucuugcaauuuugaucuccaugugccgucaaccacuauccagaaguacaaccaggucgagugggcuaaaaagacaaguaccacggaaagcacuaaugccggcgcguccaccuucgaggcuaaaacaaaggaggugaaccugaaggguacuuguaauauucccguaaccacauuugaagccgcauauaaaucuaggaagaccguuaucugcuacgaccuugccuguaaccagacgcacugccugccuacugugcauuugauugcuccaguccaaacauguaugucggugcggucaugcaugaucgggcuccugagcagucgcauacacgugaucuaugagaaaaccuacugugucacuggacagguuguggaaggccugugcuucauucccacacauaccaucgcacucacgcagccuggccacaccuaugauacaaugacuuuaccaauuaccuguuuucugguagccaagaaacuugggacacaguugaagaucgcuguggagcuggagaagcuaauaacugccuccggaugcaccgaaaauucuuuccaagguuacuacauuugcuuucucggcaaacacagcgagccccuguaugucccuacaauggacgauuaccgauccgcggaacuuuucacccguauggugcugaacccaaagggggaggaccaugauccggaccaggauggacagggcuugaugagaaucacuggucccauuacggcaaaaguuccuucaacagaaaccacugagaccaugcaggggguggccuuugcuggaacaccaauguauaguagcuucucuacccuccugaggaaggccgaccccgaguacgucuuuuccccuggcaucaucccagaaucaaaucacagcgugugugauaaaaagacuaugcccauuacauggacgggcuucuuagcaguaaguggggagauagaaaagaucaccggaugcacuguuuucuguacacuggcugguccgggcgccucuugcgaggcguauuccgaaaccgggauuuucaacaucagcucgccuacaugucucgugaauaagguccaaaaguuccggggaucugagcagcgcgugaacuuuaugugccagagagucgaccaagaugugguuguguacuguaauggccagaaaaagguaauacuuacuaaaacccuggucauuggucagugcaucuauacguucaccuccuuguuuucacuacugcccgggguggcccauagucucgcaguugagcugugugugccaggccuucacggaugggcuacaacugcccuguugaucaccuucugcuuuggcuggcuccugauuccuagcgucacauuaaucauucugaggauacuacggcuccugacuuucuccuguucucacuacagcaccgaaucaaaguuuaaaauccuuuuggagaaggugaagguagaauaccagaaaacgauggggaguauggugugcgacauuugccaucacgagugugaaacagcuaaggagcuggacacccaucgcaaauccugccccgagggacaauguccauauugcaugacuaugacagaaagcaccgagucugcccuccaggcacacuucucaguuuguaagcugacuaaccgauuucaggaaaaucuuaaaaagagucugaagcaucccgaggucaaacaggguugcuacagaaccuugggcguguucagguauaagagccgguguuacguggggcucgucuggggaauccuguuaacagccgagcugaucauuugggcugcguccgcagaaacgccucuaauggagucuggcuggucggauaccgcccacgguguugggauagugccaaugaaaacugaccucgaacuggauuuugcucuugccagcuccucaaguuauucuuaccgucgcaaguuggugaacccggcaaacagcgaggaaacacugcccuuccaccuccaacuggagaaacagguaguccaugccgagauccacaauuuaggccauuggauggacggaaccuuuaacauuaagacagcuuuccacugcuauggcgaauguaagaaauacgccuacccuuggcagacugcaaagugcuucuuugagaaagauuaucaguacgaaaccuccuggggguguaauccacccgacugcccuggaguggguacgggcuggacagcgugcgggguuuaucuggauaaacuuagaucagugggaaaagcauacaagaucgucagcuugaaauauaccaggaagguguguauucaacucggcacugagcagaccugcaagcacaucgacguuaacgauugucuggugacaccaucuguaaaagucugcaugauagguacuguguccaagcuacagcccggggacacccugcucuuucugggcccgcuugaacagggaggcaucauuuugaaacaaugguguacaacgaguugcguguuuggggauccuggagacaucaugagcaccacuucuggcaugaaguguccagagcauacagguuccuuccggaaaauuugcggguuugccaccacucccacaugugaguaccagggaaauaccgucucaggcuucaagcgaaugauggcaacgcgcgacaguuuucagagcuucaacguuacugaaccucacaucaccucgaauagacuggaguggauagaucccgacuccucuauuaaggaucauaucaacgugguauuaaauagggacgugagcuuucaagaucucucagacaacccaugcaaagucgaucugcacacacagaguauugacggugccuggggcuccggggugggauucacccuuguuuguacugugggccugacagaaugcgcuaauuuuaucaccucuauaaaggccugcgauuuggcaauguguuauggggcuacagucacuaaccuccugcggggaagcaauaccgugaaaguugugggcaagggugggcauuccggaucacuauucaaaugcugucacgacacggauugcacagacgagggccuggccgcgagcccuccccaccucgaucgcgucaccgguuuuaaccagaucgacagugacaagguauacgaugacggcgccccaccguguucugugaagugcugguucacuaaauccggggaauggcugcuuagaauuuugaauggaaacuggaugguuguggcuguccugaucgugauuuuaauccucagcauacugcuuuucucguuuuucuguccuauuaggucacguaagucuaaacccaacuga

SEQ ID NO: 10249 - RNA, 3423 nt, Artificial Sequence
  derived and/or modified CDS sequence (opt3) from BRV(Oklahoma)__AF030552.1__GP
auggugggcugggucugcaucuuccugguugugcucaccacaagcacugccgggcuuacgagaaaccuguacgaguugaagauugaauguccccacaccguaggauuaggucagggcuaugugacaggguccgucgagauaacuccugugccacugggacaaguuaccgaccuaaaaaucgaaucuucaugcaauuuugaucuccaugugccgaguacaaccauucagaaguacacucaggucgagugggcuaaaaagagcuccacaaccgaaucuacgaacgcagccgcgacuaccuucgaggcuaaaacaaaggaggugucgcugaagggcacuuguaauauccccguaaccacauuugaagccgcauauaaaucaaggaagaccguuauuugcuacgaccuugccuguaaccagacgcacugccugccuacugugcauuugaucgcuccaguccaaacauguaugagcgugcggaguugcauggugggucuccuguccucucgcauacaggucaucuaugagaaaaccuacuguguuacugggcagcugguggaaggacucugcuucauucccacacacaccaucgcauuaacgcagccuggccauaccuaugauacaaugacucugccaauuaccuguuuucuuguagccaagaaauugggcacacaacugaagaucgcuguggagcuagagaagcucauaacugccagcgggugcaccgaaaauuccuuccagggauacuacauuugcuuucuggguaaacacucagagcccauguaugucccuacaauggacgauuaccgaagugcggaacuuuucacccguauggugcugaacccaaagggcgaggaccacgauccggaccagaaugggcagggauugaugagaaucgcaggccccauuacugccaaaguuccuagcacggaaacaaccgagacuaugcaagguaucgcuuuugccggggcaccaauguauucuaccuucgcuacacucgugaggaaggccgaucccgaguacgucuuuuccccuggaaucauuccagaaucaaaccauagcgugugugacaaaaagaccaugcccauaacuuggacaggcuuccuggcguuaaguggcgagaucgaacggauuacggggugcaccguauuuuguacucuggccggaccgggugcaucuugcgaggcuuauuccgaaacaggcaucuucaauauaagcucgccuaccugucucguuaacaaagugcagaaguuccgcgggucugagcagagaauuaauuuuaugugccaaagggucgaucaggacguggucguguacuguaacggacagaagaaaguuauccuuacaaagacucuggugaucggccagugcauuuauaccuucacguccuuguuuucacuacugcccgguguagcccacagucucgcugucgagcugugugugccagggcuucauggcugggccaccacagcacuguugaucacuuucugcuuuggauggcuccugauuccugccauaaccuuaaucguucugaaaauucuacggcuccugacauucagcuguucccacuacucuaaggaaagccgcuuuaaaauccuuuuggagaaggugaaggucgaauaccagaaaacuaugggcucaauggugugcgauaucugccaccaugacugugagaccgcuaaggaacuggacacgcacaaaaagaguugccccgaggggcaauguccauauugcaugacaaugaccgaguccacugaaagcgcgcuccaggcacauuucucuguauguaaacugacaaaucgauuucaggagaaccuuaagaagucacugaaacaccccgaagugaagcaaggaugcuacagaaccuuggguguuuucagguauaaaagucgguguuacgucggccucgugugggggcuguuacugacuaccgagcuaauuauaugggccgcuagcgccgagacaccucucauggaauccggauggucugauacggcacauggcguggguaucgucccaaugcguaccgaccuggagcuugauuuugccuuggcuucgagcuccucauauaguuaccgcagaaagcugguuaauccggccaacacugaagagacacuccccuuccaucugcaguuagaaaaacagguggugcacgcagagauucagaaccuggggcacuggauggacggcaccuuuaauaucaagacagcguuccacugcuauggagaguguaagaaauacgcuuacccuuggcaaacugccaagugcuucuuugaaaaagauuaucaguacgagaccucuuggggcuguaacccacccgacugcccugggguaggaacggguugcacagcauguggcgucuaucuugauaaguugaggagcguggggaaagccuacaagauuguuucccucaaauauacccggaaggugugcauccagcugggaacugaacagaccuguaagcauauagacgucaaugauugccuagugucaccaagcguuaaaguguguaugaucggcacaguaucuaagcugcaacccggugacacucuccuguuccuugggccguuggagcagggcggaauuauccugaaacaguggugcaccacauccugugucuuuggcgauccuggggacauuaugaguacgaccagcggaaugcgaugcccagaacacacuggcucuuuccgcaagaucugugguuuugcuacaacccccacuugcgaguaccaagggaacacaauauccggauucaaaagaaugauggccaccagggacucauuucagaguuucaaugugacggagccucacauuacuagcaaccgguuagaauggaucgaucccgacucguccauuaaggaucauaucaaugugguccucaaccgcgacguuucuuuucaggaucugagcgacaauccauauaagguggaucuucacacccagucaauagacggcgcaugggguaguggcguaggguucacacugguguguaucgucggauugaccgagugcgcuaacuuuauuacuuccaucaaagccugcgauauggcgauguguuacggcgccacagugaccaaucuccugagagggucuaacacaguuaagguggucggaaaaggcggucauagcgggucccuauucaagugcugucacgacacugauugcaccgaagagggacuggcugcaucaccuccccaucucgacagggugacgggcuacaaucaaauugauagcgacaaaguuugugacgauggugccccacugugcagugugaaguguugguuuacaaagucuggcgaauggcuuuuggggauccugaacggaaauuggauggucguagcuguguuaguugugauacucauucuguccauccuucuguucagcuucuuuugcccgauccguucgaaaaagucaaaaccuaacuga

SEQ ID NO: 10250 - RNA, 3399 nt, Artificial Sequence
  derived and/or modified CDS sequence (opt3) from THAIV(Thai749)__L08756.1__GP
auguggggccugcucgugauugccguccuuguugggcccggauucgcuauuaagaacguguacgacaugaaaauagagugcccucacagcguaaauuuuggugaaaccuccgugacaggccaggucgagcugccagcauugccgaucacugaagccgagcaauuagugcccgaaucuucauguaacauggauaaucaucagagucuggcgacgauuaacacccuaacaaagguuagcuggagaaagaaggcugaccagguguccgccucucaaaauucguucgaggucaucgaggcagaaacuucauuuaaagggcucugcaugcugaagcacaggaugauugaggagagcuucaagaaccggcgcagugugaucuguuaugaucuuuccugcaauaccacauuuuguaaaccuaccguauacaugguugugccaguccaugccugcaacaugaugaagucuugucuggugggauugggccccuaucgagugcaggucguuuacgagcguacuuauugcacaguggguauacucaccgaggggaaauguuucaucccugacaagacgauucugagcuccaucaaaagaggaauguuuguagugacuucaguccaggugcugugcuucuuuauuguucagaagggccacaguuacaagaucauggaugaagugaaaaagagcaugaugaauaaauguaacgacaccgagaauaagguccagggcuauuacauaugcauucucgggggaaacucugcuccaguguacguacccuccuuagaugacuucaggucaauggaaaucuuuagcaauaugcugcggaguccuuucggugaggaucaugaccuuccaggcgaagaguuuucuacauaucaaauugcagggccgacugaggccaaaguuccccacaccgcuuccagcaagaacuuggcccugaucgcguacucgggaaauccuucuuauuccucacuaagucucaucacaagcucccaggauggccgcuacguguucucuccaggucuguuccccaaccuuaaccagacccagugcgagaaaaaugcacugccuauggucuggagagggaugauugacuugagcggauauuacgaagccauacacccauguaacaucuuuugcgugcucucaggccccggcgcuaguugugaagccuucuccgaagggggaauuuuuaauaucacgagcccgacuugccuggucucuaagcaaaacagguuccgggcagcugaacagcagauaaauuuugugugucaacgcguugauauggacauugugguauauugcaacggucagaagaaaacaaucuuaaccaagacucugaucauuggccaguguaucuacacaauuaccucacucuucagucuucugccuggggucgcccauagcauagcgaucgaguugugcgugcccggauuucacggcugggccacggcagcucuacugauuaccuucuguuuugguuggauccucaucccaacaauuacucuggccguucuugugguccugaaauucauagcuaauaucuugcauaccaacucccaggagaaucgauuuaagcucauucugaaaaaggugaaggaagaguucgagaaaacaaaggggucuaugguaugcgaaguguguaaauacgaaugcgagacuucgaaggaguuaaaagcccacaaccugagcugcccucaauccaagugucccuauugcuuuacccacugugaaccaacagaggcaaccuucaaggcccauuacaaaguuugccaggcuacucacagauucagggaagaccuaaagaaaacggucacaccccagaccgugggcccuggauguuaucggacucucaaucuguuucguuacaagucacgcugcuauauccuuaccaugugguuguuccugcucaguauugagucuaucaugugggcggcaagcgccgcugagauaccacuggugccgcuuuggacagauaacgcccauggcaucggguccguccccaugcacaccgaccuggaauuggauuuuucacucccuucuagcuccaaauacacuuauaagagaaagcugacaaauccaguuaacacggagcagggagugcaauuacauauugaaaucgaggaacaggguauuggcgcagacgugcaccaccuggggcauugguucgaugccaggcuaaaucucaaaaccaguuuucacuguuacggagcuugcagcaaguaccaguaucccuggcauacugccaaaugucacuucgagaaggacuacgaguaugaaaacucuugggcaugcaacccugcggauuguccaggcguagguacagggugcaccgcuugcggccuguaccuugaccagaugaaacccaucggaacagccuauaaguuggucgcaauacgguacucccgaaaagccugugugcaauuuggcgaggaacaccugugcaagacuauugauaugaaugacuguuucguuacccgccaugugaagaucugcauuaucgggacggucucaaaauuuauacagggagauacccuccuguucuuagguccgcuggagggcgggggacuuaucuuuaagcacugguguacaaguacuugccaguucggcgacccuggugacauuaugagcccaaaagauaagcccuuuuuguguccugaguuccccgggcaguucaggaaaaagugcaacuuugcuaccacaccagugugugaauaugacggcaaucaaaucucgggauacaagaaaaugaaggccacuauugauuccuuccagucuuuuaacaccagcucaauccauuucacggacgagagacucauggaagauccugacggcaugcugcgggaucacauaaauauuguugugacaaaagacaucgauuuugagaaccuagcagaaaaucugugcgggaucggacuccagguaagugcuauuaagggcgccugggguuccggggucggauucacccugacuugucaagugucucuuacagagugccccaccuuuuugacuagcaucaaagcgugcgacauggccauuuguuacggcgcugaauccgugacccugguccgcggucagaacacaguuaagauaucaggcaaagggggacauagcggcaguucuuucaaaugcugucacgggguggauugcuccagcaauggauuacaggcaaacccaccgcaccucgacagaguagccggcgugucggagcugacgaaugagaaggucuaugaugacggugcuccucagugugggaucgccugcugguuuauuaaaucaggagaaugggugaagggcaucuucucugguaacuggauuguucuuaucgugcugugugucuugcuccugauaagucuaauccugcucggcaucuuuugccccgugaggaaacauaagaaguccuga

SEQ ID NO: 10251 - RNA, 3426 nt, Artificial Sequence
  derived and/or modified CDS sequence (opt3) from TULV(Moravia/5302v/95)__NC_005228.1__GP
auguucugccugugucucagccuucugggcuuguuacugugcuggcccgccgcuaccagaaaccuacucgagcugaagguggaauguccucacacaaucgggcuuggacaggguauugucauaggcuccgcagagcugccaccgguucccuuggccaaaguggaaucucucaagcuggagucaaguugcaauuuugaccugcauacuagcacggcggcucaacaggccuucaccaaaugguccugggaaaagaaagcagauacagccgagaacgcuaaggcagccucuacuaccuuucagucgucaagcaaggagguacagcucaggggguuaugugugaucccuacacugguccuugaaaccgcuagucggacucgcaaaacagugaccugcuucgacuuguccuguaaucaaacgguuugccagccaacuguguaccugauggcccccauucagaccugugucacaacuaagucuugccuacucggacugggcgaucagcgaauccaagugguauaugagaaaaccuacuguguuagcggucagcuuauugaagggaacugcuuuaauccucugcacacaaucgcgauaucccagccaacccauacguaugacaucaugacuuuggcagugcacugcuucuuuauuucaaagaaaggaggcacagaugacacccucaagaucgagaagcaguucgagacucuggucgagaaaacaggcuguaccgaaaacgccuuaaagggguacuaugcuugcauucugggaacgaguagcgaagugguguacguccccgccauggaugacuaucguucuuccgagauccucucaagaaugaccacagcaccucauggugaagaucacgacauagauccaaaugcuauuagcagucuuaggaucguuggccaacugacugggaaagccccgucuaccgaguccagcgacacagugcagggaauugcguuugccggcacucccuuguacaccucgacaucuauccuaguacggaaggaggauccuaucuaccugugguccccagguauuauacccgaagggaaccacucacagugugacaaaaagacccucccucugacuuggacgggauucaucacacuuccaggcgagauugaaaagaccacucaaugcaccguguuuuguacacugaguggccccggggcagacugcgaggcuuauagcgauaccggaaucuucaauauauccucuccgacuuguuuggucaaccgcgugcagagauuuaggggugccgaacagcagguuaaauucgugugccaacgggucgaccucgauauuacaguguacuguaauggcguaaagaaaguuauccugacgaagaccuuagugaucgggcagugcauuuauacuuucacaagcaucuuuucacugaugccuggagucgcucauagucuagccguggagcucuguguccccggccugcacgguugggcaaccauuucccuuuugauaacauucugcuuuggguggcuggccaucccacuccugagcaugauuaucauccgcuuccuucugauuuuuacuuacuugugcucuaaauauucaaccgacaguaaguucaaacucauaaucgagaaggugaagcaggaauaccagaaaacgaugggcagcaugguuugugaggugugccaacagggaugugaaaccgcuaaggagcuggaaucccauaaaaagucuugcccucacggccagugucccuauugcuuaaacccaacagaggcgacugagucggcacugcaggcccacuuuaaaguauguaagcuaaccacacgauuccaagaaaaucucaagaaaagccuguccacuuacgagcccaagagagggcuuuacaggaccuugucaauguuucgguauaaaaguaagugcuacgucggacuggugugguguauucuccugacgauggaauuaaucguuugggcugccucugcagagacaauuaaccuggagccugguuggaccgauacugcccauggcagcgggaucauaccacuuaaaacagacuuggaacucgauuucucccugccgucaagcgcuaccuauacuuaccgucgcgagcuacagaaucccgccaacgaacaggagaagaucccuuuucacuuccagauggaaagacaagugauucaugcagagauccagcaccugggacauuggauggacggcaccuuuaaccucaagacagcguuccacugcuaugguucuuguauuaaauacgcuuauccauggcagacggccaagugcuuccuggagaaagauuuugaauuugagaccggguggggcugcaaucccccugacuguccaggagucggcacugggugcacagcauguggaguguaccuugauaaguugagguccguagguaaaguguacaagauccugaguuuaaaauauacccggaagguuugcauacaacucggcacagaacagacuuguaagaccauugacagcaacgacugccuggucacgacaucugugaaaguguguaugaucgggaccauuuccaaguuucagcccggagauacucuucuguucuugggcccgcucgaggaaggugggaugaucuuuaaacaguggugcaccacaacuugucaauucggcgacccuggagauauaaugucaaccccacugggcaugaagugccccgagcacgccgggaguuuucgcaaaaaguguagcuucgcuacacuaccuucgugccaguacgacggaaauacggucuccggcuaucagcgaaugaucgccaccaaggauucuuuucagagcuucaacauuacugagccccauaucacaaccaauucacuggaauggguugacccagauaguucccucaaagaccacgugaaccugauugugaauagagaucuuucuuuucaagacuuggcagagaacccuugccagguagaucugagcgucuccucaaucgacggugcuugggggagcggagugggcuucaauuuaguuuguagugugucucucacugaaugcgccuccuuucugacaagcauaaaggcgugugauucggccaugugcuacgguucaucuaccgcuaaccuugucaggggccagaauacggugcauguuguggggaaaggaggccacaguggguccaaguucauguguugccacgacaaaaaguguagcgcaacuggacugguagccgcugcaccccaucuagaccgggucaccggcuauaaccagauugauacaaauaagguguucgacgauggugccccacaaugcggggugcacuguugguuuaaaaagucuggagaguggcuccugggcaucuugagcgguaacuggauggucguugcggugcugaucgccuuauucauuuucucccuccugcuuuucucacugugcuguccgcgcagacagaauuacaaaaagaacaaauga

SEQ ID NO: 10252 - RNA, 5055 nt, Artificial Sequence
  derived and/or modified CDS sequence (opt3) from CCHFV(10200)__U39455.2__GP
augcacaucagccugauguacgccauucucugccuucagcuguguggcuugggggagacccauggaucccacaacgaaacaagacauaauaagacugacacgaugaccacacacggugauaaccccucuucagagccuccagugaguacugcuuuaagcauaacccuggacccguccacagucacccccacuacuccugcaucuggccuagaagggucgggagagguuuauaccucaccacccaucacgacuggcagccucccucugagugaaaccacaccagagcuucccgugacuaccgguacagauacccuguccgccggggacguagauccuucuacgcagacugcgggaggcacaagcgcuccaaccgugaggacuuccuugcccaauucacccaguacaccuagcaccccacaggacacgcaucaccccguccggaaccuccugucugugaccuccccuggcccagaugagacaucaacucccagcgggaccggaaaagaaaguucugccacauccagcccgcacccuguuucgaaucgcccgccaacuccucccgcaaccgcccaggguccaacagagaacgacucucauaaugcuaccgaacaccccgagucccugacucagucagcaacgccuggccucaugacaaguccaacccaaauugugcauccgcagagcgccacucccaucaccguccaggauacacacccuuccccaaccaaccgaucuaagcguaauuuaaaaauggagauuauccugacucuuagccagggguugaagaaauacuauggaaagauacugagacuacuccaacugacacuugaagaggacacggaaggccuguuggaguggugcaagaggaaccucggucuggauugugacgauaccuucuuucagaaacggaucgaagaguucuuuauuacuggggagggacacuucaaugaaguguuacaguuucgcacacccggcacccugucaacaacugagaguaccccugcuggccucccaacggccgaacccuucaaguccuacuuugcgaaaggguuccuuagcaucgacucuggauauuacucagcaaagugcuauagugguaccagcaacuccggccugcaguugauuaauaucacaagacauucuacuaggauaguagacaccccggggccuaaaauuacaaaccuaaagacuaucaauuguauuaaccugaaggccucgaucuuuaaagagcaccgggaaguugagaucaacgugcuccugccacaagucgcugugaaucuuagcaacugccauguggucauuaagucccacguuugugauuacucacuggacauagauggagccgugcgcuugccccauaucuaccacgagggcguauucauuccugguaccuauaaaaucgugauagacaagaaaaauaagcucaacgaucgaugcacgcuguuuacagacugugucauuaaagggagagaagugaggaagggccagaguguuuuacggcaguacaagaccgagauccguaucggaaaagcaucuacuggcuuccgcagacugcuaagcgaggaacccuccgaugacugcgugucaaggacacaacuccugcggaccgaaacugcugagauucacggggauaauuauggagguccaggcgacaagaucaccauuuguaacgggagcacaauagucgaucagcgacuuggaucugaguugggcugcuacacgaucaaucgcgugagauccuuuaaacugugcgaaaacagugccaccgguaagaauugugagauugacagcguaccuguuaaaugcaggcagggguauugucuccggaucacucaggaaggccgcggacaugugaagcugucuagaggcuccgaggucgugcuugacgcgugcgauacaucaugugagaucaugauucccaaggggaccggagacauacuggucgauugcagugguggccaacagcacuucuugaaagacaaccucaucgaucugggguguccaaagauuccguuacugggaaaaauggccaucuacauuugcaggaugagcaaucauccuaagacaacuauggcauuccuauuuugguucucguuuggcuaugugaucaccuguauacucugcaaagcuaucuucuaccugcuuauuaucguugguacguuggggcgucggcugaagcaguaccgagaacucaagccccagacauguaccauuugcgagacuaccccagugaacgccaucgacgcugaaaugcacgaucugaauugcuccuauaacauaugucccuacugcgccucuagauuaacaagcgacggccuggcaaggcacguaauucaauguccuaaacgcaaggagaaagucgaagagacugagcuuuauuugaaucucgaacggaucccaugggugguuagaaagcugcuacaggugucagagaguaccggagucgcccugaaaagguccucuuggcucauugugcugcuuguauuguuuacagugagccugucccccguucagucagcuccuaucggccaggggaagacgauagaagcguaccgcgcacgagagggauauaccagcaucugcuuauucguccucggcaguauucuguuuaucgugucuugucuuaugaagggucugguggauuccgucgggaacagcuucuuuccgggauugucgauuugcaaaacuuguucaaucucuaguauaaacggcuucgaaauugagucccauaagugcuacuguagccucuuuugcuguccauauugccggcacugcucuacagacaaagagauccauaagcugcaccuaagcaucuguaaaaagcguaaaaccgguuccaauguuaugcuggccgugugcaagcucauguguuucagagcuacuauggaagugucaaacagggcccuguuuauucgcaguaucauuaauacaaccuucguacuuugcauauugauccuggcagucugugugguuagcacgucugccguggagauggaaaacuuacccgcuggcacuugggagcgggaagaggaucucaccaauuucugccaucaagagugucaggucacagaaaccgagugccuguguccuuacgaagcccuugugcugagaaagccacuauuucucgacuccacugcaaaagggaugaagaaccugcucaauucaacaagucuggagaccagcuuauccauugaggcgcccuggggagcuaucaacguucagucuacauacaaaccuacugugucgaccgccaauauugcacucagcuggucauccguagaacacaggggcaacaagauccuggucagugggcgaucugagagcauaaugaaacuugaggaacgcacgggaaucuccugggaucugggcguggaagacgccucagagucuaaguugcucacagugagcgucauggaccugagucagauguauuccccgguuuucgaguaccuaagcggugaucggcaaguggaagaguggcccaaggcuaccugcacuggggacuguccagaaagaugcggaugcaccucuucaacaugucugcacaaagaguggccucauuccaggaauuggcguugcaaccccacuugguguuggggcguagguaccggcugcacguguugcgggcuugaugugaaggaccucuuuacagauuauauguucgucaaauggaagguggaauacauuaaaaccgaggccaucguuuguguggagcugacaagucaggaacgccagugcagcuugauugaggcaggaacacgguuuaaucugggcccagucaccaucacuuuaucggaaccuagaaacauacaacagaaguugcccccagagauuaucacacugcacccgaggaucgaagagggguucuuugaccuuaugcaugugcagaagguucugucugcuuccaccguguguaaauugcagagcugcacgcacggagucccuggcgaucuccaaguauaucauauugguaaucugcuaaagggggacaaagugaacggacaccugauacacaagaucgagccccauuucaacacuucauggaugaguugggauggcugugaccuugauuacuauugcaauaugggugacuggccaucuugcaccuacacaggcguuacccagcacaaccaugccuccuuugugaaucuccugaacauugaaacagauuacacuaaaaauuuccacuuucacagcaagcgagucaccgcgcauggggacacgccccaguuggacuuaaaggcccggccuacauauggagcuggcgagaucacugugcugguagaaguggcagauauggagcuccacaccaaaaagauugagaucucagggcugaaauucgccagucuugcuuguacaggaugcuacgccuguagcuccucuauaagcugcaagguccgcauccauguugacgaaccagaugagcugaccgugcacgugaaauccgacgaucccgacgucguggcagcgucaucuaguuugauggccagaaagcuagaauuuggcacugauucgaccuucaaggcuuucagcgccaugccuaaaacaucccuguguuuuuauauuguugagagggaacauugcaagucuuguucagaggaggacacgaaaaagugcguaaacacuaaacucgaacagccgcaaagcauccugauugagcacaaggguaccaucauagggaaacaaaauuccacauguaccgcaaaggcuaguugcuggcuugaaucugucaagagcuucuuuuacggacugaaaaacauguuaucaggcauuuucggcaauguguuuauggggaucuuccucuuuuuggccccauucauccugcucauucuguuuuucauguuuggauggcggauccuuuucuguuucaagugcugccgaagaacucgcggucuguuuaaauauaggcacuugaaggaugacgaggaaacaggcuaccgucggauaauugagaaacuaaacaauaagaaggggaaaaacaagcugcucgauggagagagauuagcagacggcaggaucgccgaacuguucuccaccaaaacgcauauugguuga

SEQ ID NO: 10253 - RNA, 5055 nt, Artificial Sequence
  derived and/or modified CDS sequence (opt3) from CCHFV(IbAr10200)__AF467768.2__GP
augcacaucagccugauguacgccauucucugccuucagcuguguggcuugggggagacccauggaucccacaacgaaacaagacauaauaagacugacacgaugaccacacccggugauaacccuucuucagagccaccggugaguacugcuuuaagcauaacccuggaccccuccacagucaccccuacuacaccagcaucuggccuagaagggucgggagagguuuauaccucacccccuaucacgacuggcagccucccacugagugaaaccacacccgagcuuccugugacuaccgguacagauacccuguccgccggggacguagauccaucuacgcagacugcgggaggcacaagcgcuccgaccgugaggacuuccuugcccaauucaccuaguacaccaagcacaccccaggacacgcaccauccuguccggaaccuccugucugugaccuccccaggccccgaugagacaucaacuccgagcgggaccggaaaagaaaguucugccacauccagcccucaccccguuucgaaucgcccaccuacucccccagcaaccgcccagggucccacagagaacgacucucacaaugcuaccgaacauccugagucccugacucagucagcaacgccaggccucaugacaaguccgacccaaauugugcacccccagagcgccacuccuaucaccguccaggauacacauccaucccccaccaaccgaucuaagcguaauuuaaaaauggagauuauccugacucuuagccagggguugaagaaauacuauggaaagauacugagacuacuccaacugacacuugaagaggacacggaaggccuguuggaguggugcaagaggaaccucggucuggauugugacgauaccuucuuucagaaacggaucgaagaguucuuuauuacuggggagggacacuucaaugaaguguuacaguuucgcacaccuggcacccugucaacaacugagaguaccccagcuggccuccccacggccgaaccguucaaguccuacuuugcgaaaggguuccuuagcaucgacucuggauauuacucagcaaagugcuauagugguaccagcaacuccggccugcaguugauuaauaucacaagacacucuacuaggauaguagacaccccugggccaaaaauuacaaaccuaaagacuaucaauuguauuaaccugaaggccucgaucuuuaaagagcaucgggaaguugagaucaacgugcuccugccccaagucgcugugaaucuuagcaacugccacguggucauuaagucccauguuugugauuacucacuggacauagauggagccgugcgcuugccucacaucuaccaugagggcguauucauucccgguaccuauaaaaucgugauagacaagaaaaauaagcucaacgaucgaugcacgcuguuuacagacugugucauuaaagggagagaagugaggaagggccagaguguuuuacggcaguacaagaccgagauccguaucggaaaagcaucuacuggcagccgcagacugcuauccgaggaaccaucagaugacugcauuagcaggacacaacuccugcggaccgaaacugcugagauccacggggauaauuauggagguccuggcgacaagauuaccauauguaacgggucuacaaucguggaucagcgacuuggauccgaguugggcugcuacacgauuaaucgcgucagaaguuucaaacugugcgaaaacagcgccaccgguaagaauugugagaucgacucugugcccguaaaaugcaggcagggguauugucuccggaucacucaggaaggccgcggacacguuaagcuguccagaggcucagaggugguccuugacgcgugcgauacaaguugugagauuaugauaccaaaggggaccggagacauccugguggauugcagcgguggccaacagcauuuucuuaaagacaaccucauugaucugggguguccgaagaucccuuuacugggaaaaauggccauuuacaucugcaggaugucgaaucaccccaagacaacuauggcauuccuauucugguuuuccuucggcuaugucauaaccuguauccucugcaaagcuaucuuuuaccugcuuauuauuguggguacguuggggaagcgucugaagcaguaccgggaacucaaaccacagacauguaccaucugcgagacuacccccguuaacgccauagacgcugaaaugcaugaucugaauugcucuuauaacauuuguccuuacugcgccagccgauuaacaucagacggccuggcaagacacgugauccaauguccaaagaggaaagagaagguagaagagacugagcuuuauuugaaucucgaacgcauucccugggucgugcggaaacugcuacagguuagugaguccaccggaguggcccugaagagaucuagcuggcucaucguccugcuuguguuguucacaguaucccugucaccugugcagagcgcuccgauaggccaggggaagacgaucgaagcguacagggcacgcgagggauauaccaguauuugcuuauuuguucucggcucuauccuguucauugucuccugucuuaugaaaggucugguggauagcguggggaacucguuuuucccaggauugucaaucugcaagacuuguucuauaaguuccauuaacggcuuugaaaucgagagccacaaaugcuacuguucucucuucugcugucccuauugccgacauugcagcacagacaaggagauccacaaacugcaucuauccauuuguaagaaacggaagaaggguucaaaugucaugcuggccguuugcaaacucauguguuuucgugcuaccauggaagugaguaacagagcccuguucaucaggagcauuauaaauacuacauuugugcuuugcaucuugauucuggcaguaugugucgugucuaccuccgccguugagauggaaaacuuaccugcuggcacgugggagcgcgaagaggaucucacuaauuucugccaccaagagugucaggugaccgaaacagagugccuguguccauacgaagcccuuguccugcggaagccccuauuccucgacucaaccgcaaaagggaugaagaaccuguugaauaguacuagccuggagacauccuuaucuaucgaggcgccuuggggagcuauuaacgugcagucgaccuacaaaccgacaguuagcacugccaauaucgcacucucaugguccaguguggaacauagaggcaacaagauacugguaucugggaggagcgaguccaucaugaaacuugaggaacgaaccggaauuucaugggaucugggcgucgaagacgccucugagagcaaauugcucacggugagugugauggaccugucccagauguauagccccgucuuugaguaccuaucuggugaucgccaaguuggggaauggccaaaggcuacaugcaccggagacuguccugagcggugcggcugcacuucauccaccugucugcacaaagaauggccccacaguagaaauuggaggugcaacccaacaugguguuggggugugggcacugggugcaccuguugcggacuugauguaaaggaccucuucacggauuauauguuugugaaauggaaggucgaguacaucaagacagaagccauuguguguguugagcugaccagccaggagcgucagugcucguugaucgaagcaggcacucgcuucaaucuggggccugugacaauaaccuuaucugagccccggaacauucaacagaaacucccaccggaaaucaucacucugcauccuagaauugaggaaggauuuuucgaccuuaugcacguccagaaggugcuguccgcuagcacaguuuguaaauugcagucaugcacccauggcgugcccggugaucuccaagucuaucacauagggaaucugcuaaagggagacaaaguaaacggccaucugauccacaagauugagccacacuuuaacacgaguuggaugucuugggaugguugugaccuugauuacuauugcaauaugggcgacuggcccuccugcacuuacaccggggugacacagcauaaccacgccagcuucguuaaucuccugaacaucgagaccgauuacacaaagaauuuucauuuccacucaaaaagggugacugcgcacggagacaccccucaguuggacuuaaaggcccgaccaacguauggcgcuggggaaauuacaguccugguggagguagcagauauggaacuccauacuaaaaagaucgagauaaguggacugaaauuugccagccuugcuuguaccggcugcuacgccuguuccucugguaucagcugcaaggugcggauucacgucgacgagcccgaugaacugacaguucaugugaaauccgacgauccugacguggucgcagcgucaucuaguuugauggcccgcaagcuagaguucgggaccgauucgacuuuuaaggcuuucagcgccaugccgaaaaccucccuguguuucuauaucguggaaagagagcacugcaagucuuguucagaagaggacaccaaaaagugcguuaacacgaaacucgagcagccacaaagcauucugaucgaacauaagggaacuauaauuggcaagcaaaauuccaccuguacagcaaaagcuaguugcuggcuugagucuguaaagagcuuuuucuacggcuuaaagaacaugcugucagggaucuuuggaaauguguucauggguaucuuucucuucuuggcccccuuuauucugcucauccuguucuuuauguucggcuggaggauauuguuuuguuucaagugcugccggcgaaccagagggcuguucaaauaucgccacuugaaggaugacgaagagacuggauacaggcguauuaucgaaaagcuaaacaauaaaaagggcaaaaacaagcugcucgauggugagcgguuagcagacagaaggauugccgagcuguuuuccacaaaaacccacaucggguga

SEQ ID NO: 10254 - RNA, 5067 nt, Artificial Sequence
  derived and/or modified CDS sequence (opt3) from CCHFV(Turkey-Kelkit06)__GQ337054.1__GP
augcccaccaacaucaugcacacaccucuggugugcuucauucucuaccuucagcuguuguguuuaggcggggcccauggacaacugaaugcuacugagcacaacgguacgaauaacaccacagcaccaggcgccagccaguccccgaagcccccuaugucuacuaccccaccccaugcgccugaaucaaguacaauaaaaccaaccacucccaucagcgaggcugaaggguccggagagacaaccucuccuccaaauacgacucagggccuaucgucaccggaaaccacaagcgagagacccgccacuaccaguauuuccacaucuagcaccgacuccacgaacccuacuacacagaugaccgauaauacuccaacacccaccgucucaacgaguccuucuucuuccccaucaacccccagcacaccgcaagguauccaccauccugcaaggagucuccugucuguuuccagccccaagacugugaccacaccaacuccuaccucgcccggggagaugucuuccgaaacaucaagucagcacagcgccaugucccggauuccaacuccccacacugcuacgcgcguaucuacagagaucaccaaccaucgaacuccucgucagagcgaaucaagugcacagcaaaccacaccauccccgaugaccagccccgcccagucuauacuucugaugucagcugccccuacugcggugcaggacauccacccaagucccacaaauagaagcaaaaggaacuuggagacggagauuauccucacccugucccagggacugaagaaauauuacggcaagauucucaaguuacugcaucuuacuuuggaacaagauacagagggccugcuagaauggugcaaagggaaucucggaucuaacugugacgaugacuuuuuccagaagcggaucgaggaauuuuucaugaccggugagugcuauuuuaaugagguccugcaguucaaaacacuuucgacucugagcccuaccgaaccaucccacgcacgcuugcccacggccgagccguuuaagucauacuucgcuaaaggcuuucucaguauagauucuggguauuucagcgccaaguguuacccuagauccucagcaagcggacugcaauuaauuaacgugacccagcacccagcuaggaucgccgaaacacccggcccuaagacuaccucucugaaaacaauuaauugcaucaaccuccgggcguccguuuuuaaggagcaucgcgaaguggagaucaacguccuucugccccagauugccgugaauuugaguaacugucacguaguuauaaauagccaugugugcgacuauucucuagauacugacgguccaguccgacugccuagaaucuaccacgaggggaccuucauucccggaacguacaaaaucgugauagauaagaaaaacaagcucaaugacagguguacacuggugaccaacugcgucauuaaaggccgggaaguucguaagggccaguccgugcuucgccaauauaagacugagaucaaaaucgggaaggcaucaacaggauuuagaaaacuguugagugaggaaccaggugaugacuguauuagcaggacccagcuccugcggacugaaaccgcugagauccaugacgauaauuacggcgggccgggagacaagauuacaauaugcaacggcucgacgaucguagaucagcgauuagguuccgagcuggggugcuauaccauuaaucgcgugaaaucuuucaagcuauguaagaacagcgccacuggcaaaacaugcgaagucgacucaaccccugugaaguguagacagggauucugccucaaaaucacacaagagggcagggggcacguuaagcugagucggggauccgaagugguccuugaugcuugugacucuagcugcgaggugaugauccccaaagguacuggcgauauuuugguagacuguuccgggggacagcagcacuuucugaaggauaaucucauagaccugggcugcccacauaucccccuucugggucgcauggccauuuacaucuguagaaugucaaaccacccuaggaccacgauggcauucuuguuuugguucagcuuuggguauguuauuacaugcaucuucuguaaggcccucuuuuacagucugauaaucauuggcaccuuagggaaaaagaucaaacaguaucgugagcugaagccacaaacuugcaccauuugcgaaacagcucccgugaaugcgaucgaugcagagaugcaugaccuaaacuguucuuacaauauaugcccuuacugugccucccggcucacuagcgacggccuggcucgacacgucacccagugcccgaaaagaaaggaaaagguggaggaaacagagcuuuauuugaaccuggagaggauuccauggaucguccgcaaacuccugcaagugucggaaucaacggggguugccuuaaagcggucuaguuggcugauugugcuuuugguacuccugaccgucucccuaagccccgugcagucugcaccuguuggacacgguaaaacuaucgagauauaccagacaagagaaggcuucgccagcaucugucuguuuaugcucggguccauucuguucaucgugucaugccuugucaagggauugguggauaguguaagcgagagcuuuuucccaggccuguccguguguaaaaccugcucaauugguaguguuaacggguuugaaaucgagagccauaaguguuauugcuccuuauucuguugccccuacugcaggcacuguucugcugaccgcgagauacaucagcuccaccugucgauuugcaaaaagcgaaagacuggcagcaaugucaugcuugccguguguaaacggaugugcuuccgugcaacaaucgaagcgucaagaagggcucuguugauccgcuccauuaucaacaccacguuugugauuuguauacucacucugaccaucugcgucguuaguacaucugccguggagauggaaaaucuaccugcaggaaccugggagcgggaagaggaucugacuaacuucugucaucaggagugccaagugacagaaaccgagugucucugcccguaugaagcccugguacuuagaaagcccuuguuucuggacagcauugucaaaggcaugaagaauuuacucaacuccacaucacuggagacuucucuuagcaucgaggcuccauggggagccauuaaugugcagaguaccuucaaaccuacgguuuccacagcaaacaucgcucugagcuggucuucagugguccacaggggaaauaagauauuggugaccggccgauccgaaaguaucaugaagcucgaggaacgcacugguguuagcugggaucuggggguggaggacgccucggaaucuaaauugcugaccguauccauuauggauuuaagccagauguacucacccgucuuugaguaucucaguggagacagacagguggaggaauggccaaaggcgacauguacuggcgauugcccugagcggugcgguuguaccucuuccacgugccugcacaaagaauggagccauucaaggaacuggcguuguaaucccacauggugcuggggcguggggaccggauguacuugcuguggcgucgacguuaaggaucuuuucacagaccacauguuugugaaauggaagguagaguacaucaagaccgaagccauugugugcgucgcucugaccagucaagagcgccaguguagcuugaucgaggcagggacacgguucaaccucggaccagugaccauaacgcuguccgaaccgagaaauauucagcagaaacuaccucccgagaucaucacucugcauccaaagauugaagagggcuuuuucgaucuuaugcacguucaaaaagugcucucugccagcaccgucugcaagcugcaguccuguacacaugguauacccggggaccuacagguguaccacaucggaaaccuguuaaaaggcgacaggguuaauggucaccucauucauaagaucgaaucacacuuuaacaccucuuggaugaguugggauggcugcgaccuggauuauuacugcaacaugggggacuggccuucguguacauauacuggagugacccagcauaaucacgcugccuucgucaaccuucugaauauugagacggauuacacaaagacuuuucacuuccauagcaaacgaguaaccgcacacggcgacacaccacaauuggaucucaaggcgcggcccaccuauggggccggaggcaucacugugcugguugagguggcugacauggaacuacauaccaaaaaggucgagauauccggucugaaauucgccucucuugcaugcacaggguguuacgcuugcucaagcggaaucuccuguaaggugcgcauucacguagaugaaccugacgagcucacggugcaugucaaaaguucugauccggacguuguggccgcaagcacuucacugauggccagaaaguuggaguuuggcaccgauuccacauucaaggcuuuuagugcgaugccaaaaaccagcuuaugcuucuauaucguggaaagggaguacuguaagucuugcuccgaagacgacacucagaaaugugucgauacacggcuggagcagccccaaucaauucucaucgaacacaaggguaccauaauuggcaaacagaacgacacgugcacugccaaggcaagcuguuggcuggagucggugaagucuuucuuuuacgggcuuaaaaauaugcugggaaguguuuuuggcaacuuguucaucgggauccuacuguuucucgcuccuuucguacugcuuguguuauuuuucauguucggauggaagauucuguuuugcuucaaaugcugucgaagaacacgcggccucuuuaaguauaggcacuugaaagaugacgaggaaaccgguuaccgucggaucauagagagacugaacuccaagaaggggaaaaauaggcuccuggauggagaccgccuugccgaucgaaagauugccgaacuguucagcaccaaaacucauaucggcuga

SEQ ID NO: 10255 - RNA, 5103 nt, Artificial Sequence
  derived and/or modified CDS sequence (opt3) from CCHFV(UCCR4416)__KY484026.1__GP
auguuccugcacuuuaaguucaugcuccuuaccaacuuuuucuuuugccagcuguuguggggcgggggagguguggccagcggcgggagaacaaauacuuccucuacgcaaaccacauuaaucucaaguaacacucugaauagcaccauguccguccuagagucuucgauuggaacagcuaccgaaacuguucccucaacaaccacgaacacuccugacacccaggugacaacugauagcggcaguggugaguccucuaccgacccacagacaaccagcaaagaaguaccguccacgucaguggcaacuauaaagacacaggagagugaaacccauagggcccaaaaucccagcacuacagcggggucuggagcuuccaccccuucaaacacgaccagcaauaaaccagaugucaacagucucacaucucccauccuggaggccaaguccagcccuucgccaucuaaaacuuccaugccccagaccgcacaccaucuuucacggagucuguugagcgccgcuacaacugagaccaaucaggcagccuccgugaugacaaccacucgcgaaacgacaaccaugucuagcccuacuaccguuaagaacucagugacagcuauuccaacccagggcaucacuacaaguaauacguccaagcaaaccgacacuauuacacucgagaucagcccgaaaauacagaccacacagucucagcaaacugccacccccgcgaucgccccugcaacgaccgcuauugccuucaucucaccaacaaaccgaaguaagcgugaaagcaaaguccagauuauccugacuuuuucccagggccugaagaaauacuauucuaagauacucaaguuacugcaccuuacccaagaggaggauucggaaggguugcuggagugguguacaagagugcuagaacaggcaugcaaugacgauuacuucaacgagaggauugaagaguuuuucaucacuggaaaagguuauuuuaaugacguacuccaguuccggcuguacgauacccuuagcacgacagaguccacccagaacacuucacccacagcuaagccuuuucgcaguuauuacgccaaaggcucucugaccuucgacagcggguauuucuccgcgaaguguuacccaagagccucaaacagcggauugcaacucauuaauguuacucagcauucugugaaaaucgcaaacacccccggcccgaagaucuccaauccuaaaacaauuaacugcauaaaucugaaggucaguacggauaaggaccacagcaaauuagaaaucaacgugcugcucccccagguggcugucaaucuuucuaacugucacguucugauugagucccaugugugcgauuacucauuggacaccgacgguacuaucaagcuaccaaaaauaacacacaauggggccuuuauuccuggaaccuauaagaucguaaucgauaaaaagaacaagcugaaugacaggugugcucucuucacaaacugcgugauuaaaggccgggaaguccgccgaggccagagugcccugagacaauacaggacugagauccggauugggcagaccuuuacgggaagccgucgccuucuggcagaagguggcucgaaugauuguguguccagaacacaguugguuaagaccgagguggccgagauacaugaagacucuuaugggggacccggcgagaaaaucacuauuugcaacgguagcaccaucgucgaucagaggcucgggucagaacugggcuguuacacaaucaaucgggugcgaacuuauaaguuaugcgagaacagugcuaccgaaaaauccugcgagauugacucuguaccaguuaaguguaagcaaggauucugccugaaaauaacacaggagggccgcgggcacgugaagcuaagcagaggaacggaaaucguccucgaugugugugacaccuccugcgagcugaugauucccaaagguacuggcgauauccuugucgacuguucagggggacagcagcacuuuuugcaagauaaccugauugaccucggcugcccuaauaucccacugcuugguaggacagcgauauacgugugucggaugagcaaccauccgaagaccacuauggcauuccuguuuugguucaguuuuggguauguuaucacaugcgugguauguaaagucuuguucuaccuccugauugugaucggcaccuuaggaaagcgccugaagcaguacagagaacuaaaaccccagacgugcauuguuugugagucuaucccugugaaugccauagacgcugagaugcacgaucucaacugcaauuauaacauuugcccauacugugccuccaggcugacuagcgacggccuuguccgucaugugacccaaugccccaagcggaaagaaaagguagaggaaacagaguuguaucugaaucucgaacgaaucccuuggcuggugagaaaauuacugcagguuucggagucaaccggggucgcacuuaagaggucuuguuggaugauuacuuugcucauccugcuaacagugaguauguccccagugcagagcgcccccgucggacacaaacgcgcuguugagguguaccagaugcgggaaucuuauaccgguauaugccuguuugugcucggcagcguacuguucgccgucuccuggcuugugaaggcauugaucgauucaauugggaacagcuuuuucccgggacugaguaucuguaagacaugcucuauuggcuccaucaaugguuucgagauagaaucacauaaauguuacugcaguuuauuuuguugcccuuauuguagagcgugcagcuccgacaagauuacucacaggaugcaccucaacguuugcaaaaagcgcaaaguggggucuaaugucaugcuggcuguguguaagcgaaugugcuucaaggccaccaucgaggcaucgaaccgggccacguuuauccguaauauuaucaacagcacauucguuauuuguauacuuauccuggugauuugcguagucucaaccuccgcuguggauauggaaaauuugccagccggcaucugggagaaagaggaagaccucacuaacuuuugucaucaagagugccaggugaccgaaacagagugucugugccccuacgaagcacuaaugcugagaaagccucucuuccuggauaggauugcuaaaggaaugaagagucuuuugaacucuacuagccuggagaccuccuuaucaaucgaggcccccuggggcgcgauaaauguccagucuacguuuaaaccaacaguuagcgccgcuaacaucgcacucaguugguccagcguggaacacaaggggaauaagauucugguaucuggacgcucagaguccaucaugaaacuugaggaacggaccggcauuaguuggugucuggguguggaggacgccagcgaaucgaagacucuaacagucucugugauggaucucucccagauguacagcccuguuuucgaguaucugucaggggacagacaaguggaagaguggcccaaagcuaccugcacuggagauuguccagaaaggugcggcugcacaaguucuaccuguuugcauaaggaguggccgcacucccgaaacuggcgcugcaauccuacgugguguuggggugucggcacugggugcaccuguugcggacuggacgugaaagauuuauuuacagacuacaugcucguuaaguggaagguggaguauaucaaaaccgaagccauaauuugugucgagcugacaagccaggaacggcagugcucacuuaucgaggcaggcacuagauucaaccuggggcccguaaccaucacguugagugaaccaaggaaugugcagcaacgucuucccccugagauuauaacacugcacccaaagaucgaggaaggauuuuucgaccuaaugcauguucagaaagugaugagcgcguccacugucuguaagcugcagucuugcacccacggcgugcccggugaucuucaaguauaccauguggggaaccuccugaaaggagacaaggucaauggccacagcauucauaaaaucgagucccacuugaacacaucauggaugucuugggaugguugugaccuggauuauuuuugcaauaugggcgacuggccuaguugcaccuacacugggguuacccagcacaaccaugccgcuuucauuaauauguuaaacaucgaaacagauuauacgaagacuuuccacuuucauucgaagcgcgugaccgcccacggagacacaccgcagcucgaucugaaagcacggccagcuuacggcgccggggagauaaccgugcuugucgaaguggcagaccuggaguugcauacuaagaaaaucgagguuagcggacucaaguucgccucccugucuuguucaggcugcuacgcuuguagcuccgguauuaguugcaaaguaagaauccacgugaaugaacccgaugaguuuacaguccacgugaagucuaacgacccugauguuguggcggccgggagcucacuaauggcaaggaagauugaauccggagcugacaguaccuucaaagccuuuagcucuaugccaaagaacucccuguguuucuauaucgucgagcgagacuacugcucaagcuguacggaugacgauacucagaaaugcguggacauaaagcucgagcauccccaaucgauucucaucgaacacaaaggcacaaucauugguaagcagaaugauaccuguccuaccaagacuucuugcuggcuggagaguaucaaauccuuuuucuauggcuugaagaacauguuaagcgggauauuuggaaauguauuccugggcaugcuccuguuucuugccccguucauucuguugauccuauucuuuuucuuuggguggcggcugcuuuucugucugaaaugcugccgcagaacaaggaagcucuuaaaauacaagcaucugcgggacgaagaggaaucaggauauaagaaaauuaucgagcgacucaacgauaagaaaggcaaguccagauuguuugacggugagcgccuggcugauaggaaaauagcagaacucuucucuaccaagacacacauuggguga

SEQ ID NO: 10256 - RNA, 5103 nt, Artificial Sequence
  derived and/or modified CDS sequence (opt3) from CCHFV(ArD15786)__DQ211627.1__GP
auguuccugcacuuuaaguucgugcuccuuaccaacuuuuucuuuugccagcuguuguggggcgggggaggugucacaagcggcgggggaacuaauacguccucuacccaagccaucuuaauuucaaguaacacacccaauagcacuauguccguucuggagucuucgaccggcacagcugcagaaaccgugccuucaacuacaauaaacaccccagacacgcagguaacuaccgauagcgguaguggggaguccucuacagacccgcagacuaccaauggagaagugcccagcacauccaucgccaccauuaaaacgcaggagucagaaacuagaaggacacaaaaccuaaguaccacugcgggcagcggcgcuucuacaccugggaauaccacguccaacaagccagaugucaaucuccugaccucacccaucagcgaggccaaaaguucuccuuccccaagcaagacaucgacuccccagaccgcacaucaccuuucucggucccuguugucagccgcuacaacugagaccagucaggcagccagcgugaugacaaccacucgcgaaacgacaaccauguccucuccuacuaccguuaaaaacagcgcuacagccaccccaacucagggaauuacaacgucaaauaccaguaagcaaacugacacaaccacacucgagaucccgcccaagauacagacuacccagucccagcaaacggcgaccccugcaaucacaccagccacuaccgcuauugccuucaucagccccacaaaccgaucuaaacgugaaucaaaggugcagauuauccugacuuuuagucagggucugaaaaaguacuauagcaaaauacucaaguuacugcaucuuacccaagaggaggauuccgaaggcuugcuggagugguguacgagaguccuagaacaggcaugcgacgaugacuacuucaaugagaggauugaagaguuuuucaucacagggaagggauauuuuaacgaugugcuccaguuccggcuguacgacaccuuuucuacuacagagucgacccagaauacuagcccuaccgcuaaaccauuccgcuccuauuacgccaagggcucacuuacauucgauagugguuauuuuucugcgaaauguuaccccagagccagcaacuccgggcugcaauugauuaacguaacgcagcacucaguuaagaucgcaaauaccccgggaccuaaaaucagcaaccccaagacuauuaauugcauaaaccucaaagugucuacagacaaggaucauuccaagcuggaaaucaaugucuuacugccacagguggcugugaaccucaguaauugucacguccuuauugagagccacguuugcgacuacucucugaacaccgacggcacaaucaaauugccuaagauagcccauaauggcgcuuucauucccgggacuuauaaaaucgugaucgauaagaaaaacaagcuaaaugacaggugugcccuguuuaccaacugcguaauuaagggacgggaagugcgccgaggucaguccgcacucagacaauacaggacggagauccggauuggccagacauucaccgggucacgucgccugcuugccgaaggaggcaguaaugauugugucagcagaacucagcuggugaaaaccgagguuacagagauacacgaagacucguauggugggccaggcgagaagaucacuauuugcaacggauccaccaucguggaucagagguugggcucugaacucggguguuacacaaucaaucggguccgaacguauaaacugugcgagaacagcgcuaccgaaaagucaugcgagauugacagugugcccguaaaauguaagcaaggauuuugcuuaaagauaacucaggagggucgcggccauguuaaacuguccagagggacagaaaucgugcuagaugucugugacaccucuugcgagcucaugauuccuaagggaacuggcgauauccugguggacuguagcggugggcagcagcacuuccuucaagauaacuugauugaccugggcugcccaaauaucccgcuccugggacagacagcgauauacgucuguaggauguccaaccaccccaaaaccacgauggcauuucuuuucugguuuucauucggcuaugugaucacuugcguuguguguaagguacuguuuuacuugcucauugucaucgggacccugggaaaacgguuaaagcaguaccgcgaacugaagccucaaacaugcauugugugugagagcaucccaguuaaugccauagacgcugagaugcaugaucuaaacugcaauuauaacauuugccccuacugugccaguagacucaccucugacggucuggugaggcacgucacucagugcccuaaacguaaggaaaaaguggaggaaacagagcuuuauuugaaucuggaacggaucccauggcucguacgaaagcuguuacagguguccgagagcaccggcguugcacugaaaagaucguguuggauuaucacacuuuugauacuccugacugucucaaugucucccgugcagagugccccgguggggcauaagagggcugucgagguuuaccaaauccgcgaauccuauaccggaauuugccuauucgugcugggcggugugcucuuugccguaagcuggcuggucaaagcacuuaucgauucuauugggaacagcuucuucccuggcuuguccaucuguaagacgugcucaauaggaaguauuaauggcuuugagaucgaaagccacaaguguuacugcucucuguuauguugcccauauugucgggcgugcuccucagacaaaaucacacauagaaugcaccucaacgugugcaagaaaaggaagguugggaguaaugugaugcuggcugucuguaaacgcaugugcuucaaggccaccauugaggcaaacaaucgagccacuuuuauccggaacauuauaaauagcaccuucgugaucuguauucuuauccugguuauuugcgugguauccacaucugcugucgauauggaaaacuugcccgccggaaucugggagaaggaggaagaccucacuaacuuuugucaccaggagugccaggugaccgaaacggagugucugugcccuuacgaagcacuaaugcugcguaaaccccucucgcuggauagcauagcuaagggcaugaaaucacuucuuaauuccacaagucuggagaccucuuuaagcaucgaggccccauggggugcgauuaacgugcaguccacuuucaagccuacaaucucagccgcuaauauugcacucucuuggagcagugucgaacauaaagggaacaagauccugguuuccggaagaagcgagucuauaaugaaguuggaagagaggaccggcauuucauggugucuggguguggaggacgccuccgaaaguaaaacucuaacaguaagcgugauggaucucucgcaaauguacucucccgucuuugaguaucuguccggcgaccgccagguggaagaguggccaaaggcuaccugcacgggggauuguccggaacggugcggaugcacuagcucaaccuguuugcacaaagaguggccucauaguagaaauuggaggugcaaccccacaugguguuggggcguugggaccggaugcacauguugcggccuggacgugaaggauuuauucacugacuacaugcucgucaaauggaagguggaguauaucaagaccgaagccaucauuuguguugagcugacgucucaggaacgacagugcucccuuauagaggcagguacacgcuuuaaucuggggccagugacuaucaccuugagcgaaccccggaacguccaacagagacucccuccagagauuaucacacugcaccccaaaauugaggaaggauucuuugaccuaaugcacguacagaaggugaugucagcgaguaccguuuguaaacugcaaagcugcacucauggcgugccuggugaucuucaggucuaccacgugggcaaucuccugaagggggacaaaguaaacggacauuccauccacaagauagagucucauuugaauaccagcuggauguccugggauggcugugaccuggauuauuucugcaacaugggggacuggccgucaugcacauacacgggagugacucagcacaauagggccgcuuuuaucaacauguuaaauauugaaaccgauuauacaaaaaccuuccacuuccauucuaagcgugucacugcccacggcgacacaccacagcucgaucugaaggcacgccccaccuacggugcuggggagaucacgguucuuguggaaguggccgaccuggaguugcauacuaaaaagauugaggucaguggacucaaauuugcaucgcugacauguagcggcugcuacgccuguuccucugguaucucaugcaaggugcggauacacguuaacgaaccugaugaguucaccguacaugugaaaagcaacgacccagaugucguggcugcgggcuccagucuaauggccagaaagauugaaucuggggcagacagcaccuuuaaggcuuucucauccaugcccaaaaauagucuguguuuuuauaucguugagagggacuacugcagcucuuguacugaugacgauacacaaaagugcguggacaucaaacuugagcacccucaguccauucucaucgaacacaagggaaccauaauuggcaaacagaacgauacauguccgacuaagacgucaugcuggcuggagagcaucaagucguucuuuuauggguugaaaaauauguuaucuggaauuuucggcaacaucuuucuggguaugcuccuguuccuugcccccuuuguccuguugauacuauucuucuuuuucggguggcgacugcucuuuugucugaagugcugccggcgcaccagaaaacuuuuaaaguacaaacaucugagggacgaagaggaaaguggauauaagaagauuaucgagcggcucaaugauaaaaagggcaaaucccgauuguucgacggcgagagacuggccgaucgcaagaucgcugaacucuuuagcacaaaaacucacgugggguga

SEQ ID NO: 10257 - RNA, 5100 nt, Artificial Sequence
  derived and/or modified CDS sequence (opt3) from CCHFV(UCCR4432)__KY484047.1__GP
auguucugccugagacucgugcuucugaucaacuuggccuuaugucagcugcuagagggcaaugacggggucaccagcgcugaugaaauuaacuccaauacaacucaaacgucucucggacugcccaccauacuuaacucaacaacuccugcaccagguccgaguaucgacgccaccauggaggcgguucccggcacaaccaauagcgugcuggaaacucagguaacaauggauuccgggucuggagaguugucgaccgacccuacgacuaccagggaagcuacaacuccaauuaccgccgcaacagugucagcccaggagaccaagacgcacaugacucagaaccccggcacaaccgucgauccugacacuacaaccagcaauacgaccacaaguaucgagccaauuacuacacccccuacauccccaacuccgcaagcuacccccacaccuucuuacagcgaaaccccaacucuccccaacacgcaucaccugucccggucacugcucagugcaguggguacagaggccgggcagaccgcuccugccacuccaaccgcggaaguugcauuagcccccggaggcagcucuacagcugaguccaauaccaucucaauaccggcccaggauacuacaaucagcggcgugaguaaacaggacaacccuacgaccacugggauuucucccgaggcacaaacaaugcagucccagcaggcugucgccccagugaccaccccugcgacugccaucagcgcacccaccucgccaacgaaucgcucuaagcgagaauccaaaguacaaauuauccugaccuuuccccagggacuuaagaaauauuacucaaagauauugaaguuccugcaucuaacacaggaggaagauagugagggucuccuggaauggugcacucguguucuucaacaggugugugacgauaccuauuuuaacgagagaauuaaagaguucuuuaucacaggcaagggguacuucaaugacguccugcaguuuaaauugcacgauacuccugcuaccacggugccagcccucgcugccagcuccacagcaaugccguucaggucuuauuacgccaagggaagccugaccuuagacucaggcuauuuuagugcuaaaugcuacccccgggcguccaacagcgguaugcagcugauuaaugugacucaacauccuaugaagaucgcaaacacaccagggcccaagaucucuaaccucaaaaccauuaauuguauaaaccuuaaggucucaacugacaaagaacacagugagcuggaaaucaauguuuugauuccucagguggccguaaaccuaagcaauugcuucguguccaucaagucucacgucugugauuacucgcuggacaccgauggagcuauacgccucccaaaaguggcccauaacggcguuuuuaugcccggcacauauaagauugugaucgacaaaaagaauaagcugaacgauagaugcgcacuuaucacgaauugugucauuaaagggagggaggugcggaagggacagagcacccugcgccaguacaaaacugaaauccgaauuggucaaacaauagccggcuccagaagguugcucgcugaggggguaucaaacgacugcguuagucggacccagcugaucaagacagagguggccgaaauucacgaggauucuuauggaggcccgggugagaaaaucacuaucuguaaugggagcaccauugucgaccagcguuuaggcuccgaacugggaugcuacacgauaaaccgcgugaagacauauaagcuaugcgaaaauucagcaaccgagaaaggcugugagaucgauagcgucccugugaagugcaaacagggguucugucucaagguuacucaagaaggaagaggucaugugaaacugucuaggggcaccgagauuguacuugacgucugcgauacauccugugaauugaugaucccaaaggggacuggagacauucugguggacugcaguggcggucagcagcacuuucuccaggauaaccugaucgaccuugggugucccaauguuccucuguugggcaagauggcgauauacaucugccggaugagcaaccaccccaaaaccacaauggcuuuccucuucugguuuucuuucggauaugugauuacguguaucgucugcaaggugcuguuuuacuuacugauuguaaucggcacccuauccaaaaagcucaaacaauaccgagagcugaagccacagacuuguauagugugcgagucaacaccuguuaacgccauugaugcagaaaugcaugagcuuaauugcaacuauaauaucugucccuacugcgccagucgcuugaccagcgacgggcuggucagacacgugaaccaguguccaaagaggaaagaaaagguggaggaaacugagcucuaucugaauuuagagcggauuccguggcugguccgcagacuuuugcaaguuucggaauccacaggaauggcucucaaaaggucuugcuggaugaccacgcugcuaauccugcucguggugagccugucaccuguacagagugcccccgucggucagggcaaggcaguggagguuuaccgugugcgggaauccuauacuucuauaugucuuuucgucuuggggagcgugcuguuugcuguuuccugguuaaucaaaggacucauugauggcaucgguaacucauucuuuccagggcugagcgugugcaagaccuguaguauuggcucuaucaauggauucgagauagaaucccauaaaugcuacuguagccuguuuugcugucccuauugccgagccugcucgucagacaagauuacacacagaaugcaucuuaacguauguaagaaaaggaaggcgggcucuaaugucauguuggccgugugcaaacgcauguguuucaaggcuaccguggaggcaaguaacacugcccuccugauccgggggaucauuaauuccacauuugucaucugcguucuaauucuggugauauguguagugagcaccucugcugucgauauggagaaccucccugccggaaucugggaaagagaggaagaccugacaaauuucugccaccaggagugucaagugacugaaaccgagugccuuuguccauacgaggcauugauucugaggaaacccuuauaccucgauagcaucgcgaagggcaugaagucccugcuuaacucaacgaaucuggaaacaagucuaagcauugaggccccuuggggugcuaucaacguucagucuaccuuuaaaccgacuguguccgccgcaaacauagcucucucauggaguagcgucgaacaccgcgggaauaagauccugguguccggacgaucugagucgauuaugaaauuggaggaacggaccggcaucagcuggucacuggguguugaggacgccuccgaaaguaagacauuaacugugucugucauggaucucagccagauguauuccccaguauucgaguaccugucaggcgaccgucagguggaagaguggcccaaagcaaccugcacgggggauugucaagagagaugcggaugcacaucuagcaccugucuucauaaggaauggccucacaguaggaacuggcgcugcaauccaacuugguguuggggcguugggacaggaugcaccuguugcggccuggacgugcgggacuuguucacugauuauaugauggucaaguggaaaguggaguacguaaagacagaagccauuauguguguggagcucaccucccaggaaagacagugcagccugaucgaggcugguacgagguuuaaccuagggcccgucacuauaacccugucugagccucgaaauauucagcaacgccuuccgucagaaaucguuacacuccaucccaaaaucgaggaaggauucuuugaccugaugcacgugcagaagguguuguccgcgaguaccgucuguaaacugcagagcugcacacacggcgugccaggugauuuacaaguuuaucauguaggcaaccuccugaagggggacaaggugaauggacacucgauucauaaaauagagucucacuucaacacuuccuggaugagcugggauggcugugaccuugauuacuuuugcaauaugggggacuggccuucaugcaccuauacgggagucacacagcauaaccgggccgcauucaucaauaugcugaacauugaaacugauuacaccaagacauuucacuuccacaguaaaagagugaccgcucauggcgacacuccccaguuggaucucaaggccaggccaaccuacggugccggggagguuacagugcuggucgagguggcugaccuagaacugcacacgaaaaagaucgagguaucuggacuuaaauuugcaucccucacuuguagcggcugcuaugccuguucaagugguauuagcugcaagguccguauccaugugaaugaaccugaugaguucaccguucacgugaaguccucugaccccgacgucguggcggcuggcagcucccugauggcccgcaaaauagaguuuggggcagauucaacauucaaggccuuuucuaguaugccgaaaaacucguuguguuucuacaucguugaacgggacuauugcagcuccuguaccaaugaugacacucagaagugcguggauacaaaauuagagcauccacaaucuauucugaucgaacacaagggaaccauuaucggcaagcagaacgacacguguucaacuaaaacaagcugcuggcucgaguccgucaagaguuucuuuuacgggcugaaaaacaugcuuggaggcauauucgguaauguguuucuggggauuuucuuguuucuagcuccuuucgcacugcucaucuuuuucuuuuucuuuggauggagacugcuuuucuguuuaaagugcugcaggcgaacccggggccugcucaaauauaagcaguugaaggaugaagaggaggccggcuacaaaaagaucauugaacgccugaacgacaaaaaggggaaaucuagacucuucgauggagagaggcuggcggaccggaagaucgcugaacuuuuuagcaccaagacucacauagguuga

SEQ ID NO: 10258 - RNA, 5100 nt, Artificial Sequence
  derived and/or modified CDS sequence (opt3) from CCHFV(Nakiwogo)__KX013484.1__GP
auguucugccugaagcucgugcuucugaucaacuugaccuuaugucagcugcuagagggcaaugacagagucacaagcgccgaugggauuaacuccaauacuacgcaaaccaaccucggaauaucuacaauccugaauaguacuacccccgcuccugguccaaguacagacaccacuauggaaacaguuccgagcaccgcagauuccaugcuugagacucaggugacuaccgacucuggcucgggggaacccucaacagagccuacuaccacaggagaagccaccagcaguacgacugcggcuacaguauccaugcaggagaccaaaaagcacaugacucagaacacaaggucuaccgccgauccagacacgaccacacccaauagcacuaccuccguggagccuacaacuauuccacccaccucaccuaucccacaagcaacaccgacccccggccaugguaaagccccuacucugccaaacacgcaccauuugagucggagccuccugucugcugucuccacagaagcagggcagaccacucccgccaccucaacaaccgaggcugccagcgcgccuaguucuuccagcacugcagaaaauaacacagugucgcagccagcccaggauacgaccacuucuggaguuuccgagcaauacaaucccacaaccacaggcauuucaccgaaggcucagacuaugcagggccagcaagccaucgugccugucaccacgcccgugaccacaacuuuuaccccaacaaacccuacuaaucgcaguaaacgagagagcaagguacagauaauccugaccuucccccaggggcucaagaaauauuacuccaagauuuuaaaacugcuucacuugacgcaagaagaggacucugaaggacugcuagaguggugcacacguguucuccaacaggugugugaugacaccuauuuuaacgaaagaaucgaggaguucuuuauuacugguaagggcuacuucaaugauguccugcaguuuaaacuucaugacacaccaaccacuaccgugagcgcacuggcugccucaaguacagcgaugcccuucagguccuauuacgccaaggggagcuugacgcucgauucuggauauuuuucagcaaagugcuacccucgggcuaguaacagcggcaugcagcugaucaacgugacccagcacccaaugaaaauagccaauacuccgggucccaagacauccaacuuaaaaaccaugaauuguauuaaccugaaggucucuacagacaaagaacacucggagcucgaaaucaauguucuuauuccucagguggcuguaaaccugagcaauugcuugguguccaucaagucacaugucugugacuacagucuagauacugacggggccauccgccugccaaaaguggcauauaacggaguuuucaugcccggcaccuacaagauugugauagauaagaaaaauagacucaacgacaggugcgcccugaucacgaauugugucauuaagggccgggaggugcgcaaagggcagucuacacuucgacaauauaagaccgaaaucagaauaggacagacucugauggguagcaggcgguugcucgcugagggcguauccaacgauugcguuucacguacccagcugauuaaaacagagguggcggaaauccacgaggacagcuacgggggaccuggcgaaaagaucacuauuuguaaugguucuaccaucgucgaucagcgcuuaggguccgagcugggcugcuauacaauuaacagagugaagacguacaaacuaugcgaaaauagugcaaccgagaagggaugugagauagacagcgucccagugaaaugcaagcaaggcuuuugucucaaaguuacucaggaagggaggggacaugugaagcugucucgggguacagagaucguacuugaugucugcgacaccuccugugaauugaugauucccaagggcacuggggauauccugguggacugcucaggaggccagcagcacuuccuccaagacaaccugaucgaucuugguuguccgaacguuccucuguuggggaaaauggccauuuauauaugccgaaugaguaaucacccaaagacaaccauggcuuuucucuucugguucagcuuuggcuacgugaucacgugugucgugugcaaaguacuguucuacuuacugauugugaucggaacucuaggcaagaaacucaagcaguaucgcgagcugaagccccagaccuguauuguuugcgagucgaucccugucaacgugauagacgccgaaaugcaugagcuuaauugcaacuacaauaucugucccuauugcgcauccagauugacaucugaugggcuggugaggcacgucacccaauguccaaaacggaaggaaaaaguugaggaaacugagcucuaccugaacuuagagcgcauuccuuggcuggugagaaggcuucuccaggugagcgaaucaacaggaauggccuugaagcguaguugcuggaugaccacacugcuaauccugcucguagucucccugucucccgugcagagcgcuccaguuggucaggagaaagccauugaaguguaucaaguccgggaguccuacacuucaaugugucuuuuuguguugggcagcguucuguucgcagugaguugguuaguaaaggggcucaucgacggaauaggcaauuccuuuuucccgggucugucugucugcaaaaccuguagcauugggucgaucaacggcuuugaaauugagucacauaagugcuauuguucucuuuucugcuguccuuacugccgagcgugcaguuccgauaagaucacgcacagaaugcaucugaauauauguaaaaggcgcaaggugggaagcaacgugauguuggcugucugcaaacggauguguuuuaaggccacaguugaggcaucuaauagcgcccuccugaucagauccauuaucaacucaaccuucgugauuugcguacuaauccuggugauaugugucgugaguacuagcgcuguugacauggaaaaucuccccgccggcauuugggagagggaagaggaucugaccaacuuuugccaccaggaaugucaggugacagagacugagugccuuuguccauacgaagcauugauccugcgcaaacccuuauaucucgacucuaucgcuaaggggaugaagucccugcuuaauucaaccaaccuggagacgagucuaagcauugaagccccuuggggagcgaucaacguccaguccacauucaaaccaaccgugucugccgcuaauauugcacucucguggagcucaguugagcaccgaggcaacaagauacugguguccggucggagugagucuaucaugaaauuggaggaacguacugggauuagcuggucccugggagucgaagaugccucagagucuaagacauuaaccguaagcgugauggaccucagucaaauguacucccccguuuuugaauaucugagcggcgauagacagguggaggaguggccuaaagcuacuugcacaggugacuguccggaaaggugcggcugcaccucuucaacgugucuucauaaggaguggccacacucccgcaauuggcggugcaaccccacuugguguuggggugucggaaccggcugcacauguugcgggcuggaugugagagacuuguucaccgacuacaugaugguaaaguggaaaguggaauaugucaagacagaggccaucauguguguugaacucacuucacaggagaggcagugcagccugauugaggcaggaacccgauucaaucuaggcccugugacgaucacacugucggaaccacgcaacgugcaacagcggcuucccucugagauagucacucuccauccuaaaaucgaagagggguuuuucgaucugaugcacgugcagaagguuuuguuuuguaaacacucccugcaagcgaccagcugcacacaugggguaccgggagacuuacagguguaccacgucggcaaucuccugaagggugauaaggugaacggccauucaauucacaaaaucgaaagucauuucaauaccucuuggauguccugggacgggugugaucuugacuauuuuugcaacaugggagauuggcccagcugcacuuacaccggcguuacacagcacaauagagccgcuuucgugaacaugcugaauauugagacggacuacacuaagaccuuucacuuccauucaaaaagggucacagcccacggggauaccccacaguuggaccucaaggcacguccuacuuauggagcuggcgaggugacaguacuggucgaaguggccgaucuagagcugcauaccaaaaagaucgaaguuaguggucuuaaauuugcaagccucacguguuccgggugcuacgccuguucuagcggaauauccugcaaggugcgcauucacgucaacgagcccgacgaguucacugugcauguuaagucaaaugauccagacguggucgcugcgggcucuagucugauggcccggaaaaucgaauugggugcagacucgacauuuaaggcuuucagcuccaugccuaaaaacucuuuauguuuuuauaucguggagagagauuacugcucaagcuguaccgacgaugacacccaaaagugcguaaacacuaaacuggaacacccccaguccauucucauagagcacaagggcacaaucauugggaagcagaaugauaccuguccaacaaaaacgaguugcuggcuggaaucuguuaagagcuucuucuauggacuuaaaaacaugcugggcgggaucuuuggaaauguguucuugggcauuuuucuauuccuggccccguuugcccuccugauccuuuucuuuuucuuugguuggagguuacuguucugucucaagugcugccgacggacgcgcggguugcugaaauacaagcagcucaaggacgaggaggaagcuggauauaaaaagauaaucgagagacugaacgauaaaaagggcaaaucaaggcuuuuugacggcgaacggcuggcagaucgaaagauugccgaguuguucuccaccaagacacauaucggguga

SEQ ID NO: 10259 - RNA, 5100 nt, Artificial Sequence
  derived and/or modified CDS sequence (opt3) from CCHFV(UG3010)__AY900143.1__GP
auguucugccugagacucgugcuucugaucaacuuggccuuaugucagcugcuagagggcaaugacggggucaccagcgcugaugaaauuaacuccaauacaacucaaacgucucucggacugcccaccauacuuaacucaacaacuccugcaccagguccgaguaucgacgccaccauggaggcgguucccggcacaaccaauagcgugcuggaaacucagguaacaauggauuccgggucuggagaguugucgaccgacccuacgacuaccagggaagcuacaacuccaauuaccgccgcaacagugucagcccaggagaccaagacgcacaugacucagaaccccggcacaaccgucgauccugacacuacaaccagcaauacgaccacaaguaucgagccaauuacuacacccccuacauccccaacuccgcaagcuacccccacaccuucuuacagcgaaaccccaacucuccccaacacgcaucaccugucccggucacugcucagugcaguggguacagaggccgggcagaccgcuccugccacuccaaccgcggaaguugcauuagcccccggaggcagcucuacagcugaguccaauaccaucucaauaccggcccaggauacuacaaucagcggcgugaguaaacaggacaacccuacgaccacugggauuucucccgaggcacaaacaaugcagucccagcaggcugucgccccagugaccaccccugcgacugccaucagcgcacccaccucgccaacgaaucgcucuaagcgagaauccaaaguacaaauuauccugaccuuuccccagggacuuaagaaauauuacucaaagauauugaaguuccugcaucuaacacaggaggaagauagugagggucuccuggaauggugcacucguguucuucaacaggugugugacgauaccuauuuuaacgagagaauuaaagaguucuuuaucacaggcaagggguacuucaaugacguccugcaguuuaaauugcacgauacuccugcuaccacggugccagcccucgcugccagcuccacagcaauuccguucaggucuuauuacgccaagggaagccugaccuuagacucaggcuauuuuagugcuaaaugcuacccccgggcguccaacagcgguaugcagcugaucaaugugacucaacauccuaugaagaucgcaaacacaccagggcccaagauuucuaaccucaaaaccauaaauuguaucaaccuuaaggucucaacugacaaagaacacagugagcuggaaauuaauguuuugaucccucagguggccguaaaccuaagcaauugcuucguguccauaaagucucacgucugugauuacucgcuggacaccgauggagcuauucgccucccaaaaguggcccauaacggcguuuuuaugcccggcacauauaagaucgugaucgacaaaaagaauaagcugaacgauagaugcgcacuuauuacgaauugugucaucaaagggagggaggugcggaagggacagagcacccugcgccaguacaaaacugaaauucgaauaggucaaacaaucgccggcuccagaagguugcucgcugaggggguaucaaacgacugcguuagucggacccagcugauuaagacagagguggccgaaauccacgaggauucuuauggaggcccgggugagaaaaucacuauuuguaaugggagcaccauagucgaccagcguuuaggcuccgaacugggaugcuacacgaucaaccgcgugaagacauauaagcuaugcgaaaauucagcaaccgagaaaggcugugagauugauagcgucccugugaagugcaaacagggguucugucucaagguuacucaagaaggaagaggucaugugaaacugucuaggggcaccgagaucguacuugacgucugcgauacauccugugaauugaugauuccaaaggggacuggagacauccugguggacugcaguggcggucagcagcacuuucuccaggauaaccugauagaccuugggugucccaauguuccucuguugggcaagauggcgaucuacauuugccggaugagcaaccaccccaaaaccacaauggcuuuccucuucugguuuucuuucggauaugugaucacguguauugucugcaaggugcuguuuuacuuacugaucguaauaggcacccuauccaaaaagcucaaacaauaccgagagcugaagccacagacuuguauugugugcgagucaacaccuguuaacgccaucgaugcagaaaugcaugagcuuaauugcaacuauaauauuugucccuacugcgccagucgcuugaccagcgacgggcuggucagacacgugaaccaguguccaaagaggaaagaaaagguggaggaaacugagcucuaucugaauuuagagcggaucccguggcugguccgcagacuuuugcaaguuucggaauccacaggaauggcucucaaaaggucuugcuggaugaccacgcugcuaauacugcucguggugagccugucaccuguacagagugcccccgucggucagggcaaggcaguggagguuuaccgugugcgggaauccuauacuucuaucugucuuuucgucuuggggagcgugcuguuugcuguuuccugguuaauuaaaggacucaucgauggcauugguaacucauucuuuccagggcugagcgugugcaagaccuguaguaucggcucuauaaauggauucgagauugaaucccauaaaugcuacuguagccuguuuugcugucccuauugccgagccugcucgucagacaagaucacacacagaaugcaucuuaacguauguaagaaaaggaaggcgggcucuaaugucauguuggccgugugcaaacgcauguguuucaaggcuaccguggaggcaaguaacacugcccuccugauccgggggauuaucaauuccacauuugucauuugcguucuaauacuggugaucuguguagugagcaccucugcugucgauauggagaaccucccugccggaauuugggaaagagaggaagaccugacaaauuucugccaccaggagugucaagugacugaaaccgagugccuuuguccauacgaggcauugauccugaggaaacccuuauaccucgauagcauugcgaagggcaugaagucccugcuuaacucaacgaaucuggaaacaagucuaagcaucgaggccccuuggggugcuauaaacguucagucuaccuuuaaaccgacuguguccgccgcaaacaucgcucucucauggaguagcgucgaacaccgcgggaauaagauucugguguccggacgaucugagucgaucaugaaauuggaggaacggaccggcauuagcuggucacuggguguugaggacgccuccgaaaguaagacauuaacugugucugucauggaucucagccagauguauuccccaguauucgaguaccugucaggcgaccgucagguggaagaguggcccaaagcaaccugcacgggggauugucaagagagaugcggaugcacaucuagcaccugucuucauaaggaauggccucacaguaggaacuggcgcugcaauccaacuugguguuggggcguugggacaggaugcaccuguugcggccuggacgugcgggacuuguucacugauuauaugauggucaaguggaaaguggaguacguaaagacagaagccaucauguguguggagcucaccucccaggaaagacagugcagccugauagaggcugguacgagguuuaaccuagggcccgucacuauuacccugucugagccucgaaauauccagcaacgccuuccgucagaaaucguuacacuccaucccaaaauugaggaaggauucuuugaccugaugcacgugcagaagguguuguccgcgaguaccgucuguaaacugcagagcugcacacacggcgugccaggugauuuacaaguuuaucauguaggcaaccuccugaagggggacaaggugaauggacacucgauacauaaaaucgagucucacuucaacacuuccuggaugagcugggauggcugugaccuugauuacuuuugcaauaugggggacuggccuucaugcaccuauacgggagucacacagcauaaccgggccgcauucauuaauaugcugaacaucgaaacugauuacaccaagacauuucacuuccacaguaaaagagugaccgcucauggcgacacuccccaguuggaucucaaggccaggccaaccuacggugccggggagguuacagugcuggucgagguggcugaccuagaacugcacacgaaaaagauugagguaucuggacuuaaauuugcaucccucacuuguagcggcugcuaugccuguucaagugguaucagcugcaagguccguauacaugugaaugaaccugaugaguucaccguucacgugaaguccucugaccccgacgucguggcggcuggcagcucccugauggcccgcaaaaucgaguuuggggcagauucaacauucaaggccuuuucuaguaugccgaaaaacucguuguguuucuacauuguugaacgggacuauugcagcuccuguaccaaugaugacacucagaagugcguggauacaaaauuagagcauccacaaucuauccugauugaacacaagggaaccaucauaggcaagcagaacgacacguguucaacuaaaacaagcugcuggcucgaguccgucaagaguuucuuuuacgggcugaaaaacaugcuuggaggcauuuucgguaauguguuucuggggaucuucuuguuucuagcuccuuucgcacugcucaucuuuuucuuuuucuuuggauggagacugcuuuucuguuuaaagugcugcaggcgaacccggggccugcucaaauauaagcaguugaaggaugaagaggaggccggcuacaaaaagauuaucgaacgccugaacgacaaaaaggggaaaucuagacucuucgauggagagaggcuggcggaccggaagauagcugaacuuuuuagcaccaagacucacauugguuga

SEQ ID NO: 10260 - RNA, 5100 nt, Artificial Sequence
  derived and/or modified CDS sequence (opt3) from CCHFV(Semunya)__DQ094832.1__GP
auguucugccugaagcucgugcuucugaucaacuuggccuuaugucagcugcuagagggcaaugacagagucaccagcgcugaugggauuaacuccaauacaacucaaacgaaccucggaauaucuaccauccuuaauucaacaacucccgcaccugguccaaguaccgacacaaccauggaaacuguuccgagcacagccgauuccaugcuugagacccaggugacgacugacucuggcucgggggaacccucaaccgagccuacaacuaccggagaagcgacaagcaguaccacggcugccacuguauccaugcaggagacaaaaacccacaugacucagaacacaaggucuaccgcagauccagacacgaccacacccaauacuaccacaagcguggagccuacuaccauuccacccacauccccuauccugcaagccaccccaacuccgggccaugguaaggcucccacguugccuaacacacaccaucucucacggagucugcugagcgcagucucuaccgaagccgggcagacuaccccagcuacauccaccacugaggccgcgucagcacccagcaguucuuccacagccgaaaauaacacgauguuucagccugcucaggauaccacuacaagcggagugucggagcaauacaauccaaccacaacuggcauuucucccaaagcccagaccaugcaggcacagcaagcuaucguuccggugacgaccccugucacaacuaccuucacacccauaaacccaacuaaucgcuccaagcgagagucaaaagugcagaucauucucaccuuuccucagggcuuaaagaaguauuacaguaaaauccugaaacuuuugcaccugacgcaagaagaggacagcgaagggcuacucgaguggugcacacguguacugcagcagguuugugaugacaccuauuucaacgaaagaauugaggaguuuuucaucacuggaaaagguuacuuuaaugaugugcuucaguucaagcugcaugacacacccaccacuaccgucccagccuuggcggccuccucuacagcaaugcccuuuaggagcuauuacgcuaaaggcucacucacgcuggauaguggguauuucuccgccaagugcuacccucgggcuagcaacucuggaaugcaauuaauaaacgugacccagcacccaaugaagauugccaauacuccgggccccaaaacaucaaaccugaagaccaugaauuguaucaaccucaaagugaguacagacaaggaacacagcgagcuugaaauuaauguccugaucccucagguugcagugaacuuguccaauugccuaguaucuaucaaaucgcaugugugugacuacagccuggauacugacggugccauucgccucccaaaggucgcuuauaacgggguguuuaugcccggaaccuacaaaauaguuaucgauaagaagaauagacugaacgacaggugcgcgcuuauuacgaauugugugaucaaaggccgggagguccgcaagggccaguccacacugcgacaauauaaaaccgaaauaagaauugggcagacuuugaugggaucaaggcggcuccuggcagagggugugaguaacgauugcguaucucguacccaguuaaucaagacagagguugccgaaauccacgaggacagcuacggcgggccuggagaaaagauuacuaucuguaauggcuccaccauuguggaucagcgccuggguucagagcuagggugcuauacaauaaacagagucaagacguacaagcucugcgaaaauagcgcuaccgagaaaggcugugagaucgacucugugccagucaagugcaaacaaggauucugucugaaggugacucaggaaggcagggggcauguuaaacuuucccggggaacagagauuguguuggauguaugcgacaccaguugugaacugaugauccccaaggguacuggcgauauccucgucgacugcagcgggggacagcagcacuuucugcaagacaaccuuauugaucugggcuguccgaacgugccuuugcucgguaagauggccauauauaucugccgaaugucuaaucacccaaaaacaaccauggcauuccuguucugguuuuccuucggguacguuauuacguguguggucugcaagguguuauuuuaccugcuaaucguaauuggcacucucgggaaaaagcugaaacaguaucgcgagcuuaagccccagaccuguaucgugugcgagucaauaccuguuaacgccaucgacgcugaaaugcaugaguugaauugcaacuacaauauuugucccuauugcgccaguagacugacaagcgauggccucgucaggcacgugacccaauguccaaagcggaaagaaaagguggaggaaacugagcuguacuuaaaccuggagcgcaucccuuggcuugucagaagguugcuccagguuucggaauccacagggauggcacugaaacguucuugcuggaugaccacacuacugauucuccugguggugagccuuucacccguacagagugcgccagucggacaggagaaggcuaucgaaguguaucaaguucgggaguccuacacuucuauauguuuguucgugcuggguagcgucuuauuugccguguccuggcucguuaaaggccugauugacgggaucggaaauucauucuuuccgggccuuagcgugugcaagaccuguaguauugguucuaucaacggguucgaaauagagucccauaaaugcuauuguagccuguuuugcuguccuuacugccgagcaugcucgucagauaagaucacgcacagaaugcauuugaauauuuguaagaggcgcaaaguaggcucuaacgucaugcucgccgugugcaagcggauguguuucaaagcuacaguggaggccaguaauuccgcacugcuaaucagaagcauuaucaacucuaccuuugucauaugcguucugauucucgugaucuguguagugagcacuuccgcugucgacauggaaaaucugcccgccggaaucugggagagggaagaggaucuuaccaacuucugccaccaggaaugucaggugacagagacugagugcuuguguccauacgaagcgcugauuuuacgcaagccccucuuucuggacucaaucgccaaaggcaagaagagucuucugaauagcaccaaccuagagacgucucucuccauugaagcuccuuggggagcaauaaacguucagucaacauucaaaccaaccgugagugccgcuaauaucgcccugagcugguccucugucgagcaccgaggaaacaagauuuuggugucgggccggagcgagucaaucaugaaacuggaggaacguacugguauuuccuggaguuuagggguugaagaugcaucugagagcaagacacucaccguguccgucauggaccugucacaaauguauucucccguauucgaauaccuuagcggagauagacagguggaggaguggccuaaagcgacuugcacaggcgacuguccggaaaggugcgguugcaccaguuccacgugucugcauaaggaguggccacacagccgcaauuggcggugcaaccccacuugguguuggggcguugggaccggaugcacauguugcggcuuggaugugagagaccucuuuaccgacuauaugauggucaaguggaaaguggaauacguaaagacagaggccaucauguguguggaacugacuucucaggagaggcagugcucacuaauagaggcugggacccgauucaaucugggaccugucacgaucacacuuuccgaaccacgcaacguucaacagcggcuccccagugagauugugacucugcauccuaaaaucgaagagggcuuuuucgauuugaugcacgugcagaagguccuguuuuguaaauauagcuuacaagccaccucgugcacacacggugugccgggggaccuccagguuuaccauguaggaaaucugcuuaagggcgauaaggugaacggucacucuauucauaaaaucgaaucccacuucaauaccagcuggaugucaugggacggcugugaucuggacuauuuuugcaacaugggggauuggcccaguugcacuuacaccggagucacacagcauaauagagcagcuuucgugaacauguugaauauagagacggacuacacuaagaccuuucacuuccacucuaaaaggguuacagcccauggcgauaccccacagcucgaccugaaggcacguccuacuuauggggccggagaggugacaguccuaguggaaguagcugaucuggagcuucacaccaaaaagauugaagucuccggccucaaauuugcgagccugacguguucagguugcuacgccuguaguagcgggaucuccugcaaggugcgcauccauguuaacgagcccgacgaguucacugugcacgucaagucuaaugauccagacgugguugcagcuggaagcuccuugauggcccggaaaauugaauuuggcgccgacucaacauucaaggcuuucucuaguaugccuaaaaacucguuauguuuuuauauaguggagagagauuacugcagcuccuguaccgacgaugacacccaaaagugcgucaacaucaaacuggaacauccccagucuauucucaucgagcacaaggguacuauuaucggcaagcagaaugauacauguccaaccaaaacaucaugcuggcuggaaagcgugaaguccuucuuuuaugggcuuaaaaacaugcugggaggcauauucgggaauguauuuuugggaaucuuccuauuucuggcaccguucgcccuccugauucuguuuuucuuuuucggcuggagguuacuguucugucucaagugcugccgacggacucgcgguuugcugaaauacaagcagcucaaggacgaggaggaagcgggguauaaaaagaucauugagagacugaacgauaaaaagggaaaaaguaggcuuuuugacggcgaacggcuggcugaucgaaagaucgccaaguuguucucuacgaaaacccacauaggcuga

SEQ ID NO: 10261 - RNA, 5094 nt, Artificial Sequence
  derived and/or modified CDS sequence (opt3) from CCHFV(79121)__AB069673.1__GP
augcuguuccacuuuaaguucaugcuccuuaucaacuuuauucugugccauuuguuauggggcgggggaggugugaccggcggggucgagacaaauagcuccucuacucaggccauacaaacgcccccuguuaccucaaacaguacaacuccaggaccgagcaccgacacagcuaccgaaacugcauccucuaugacaaccucgacgcccgauacucaggugaccacagacaauggcucaggugagccuagcacugauccacugaccacaaacgaagccacucccccucuaaguguaacgacugcgcagacaaccgagacuaaaaagcacacaacccucgacccauccacgucuaccaaucccgaugcuacaacuccuagcaucaccauucuguccgccucaaacacaagucuuccaaucagcucugugcaugcauccccgucacccagcaguucugaggaaccuacuccacagaaugcccaccaucuguccaggagcuugcucucggcugucucuaccgagacagggcaaauugcauccgccgcuaccgccgcgaaagaaaucacuacgaagaacucacccccuacagcaggaaaugacaccauggugaccagugccccaaacggcaauauaagaaacacccccgagcaggcuaauccgacagccccugaagcaagccccaaaauccagaccacucagaaccaacagacaguuacgccagaggcuaccccuauuacuacaaucaccgcccugacagaucugacuaaucgguccaagcgcgacucuaaggugcagaaaauucucaccuucagccagggcuuaaagaaauacuauucaaagauccugaaacuuuugcaacugacgcaggaggaagauagugaggggcuacucgaaugguguacccgaguccuggagcaggcgugcgacgaugacuacuuuaacaagcguauagaagaguucuuuauuacaggaaaggguuauuucaacgaugugcuucaauuuagacugcacgacgccuuguccaauacugagcccgcacagaccacaagcccaacugcuguacccuucaaaucuuacuaugccaagggcucacucaccuuugacaguggguacuucagcgcuagguguuauccucgggccuccaacucuggacugcaguuaaucaauguuacgcagcacccagugaaaauugcaaacacaccgggccccaagcugucgaaucucaaaaccaucaacugcaucaaucuuaaggucagcacugauaaagaacauuccgagcuggaagugaacguguugcuaccucaagucgccguuaaucugucaaacugucacgugaguauuaagucucauguaugcgacuacagccucgauacagacggugcuauaaagcugccacgcguggcgcacaauggggucuuuauccccggaaccuacaaaauugugaucgauaagaaaaacaaucuuaacgacagauguacucugauaaccaauugcguuauuaagggcagggaggugcggaaaggccaguccgcauugcgccaguauaagacagaaauccgaaucgggcagacguucaccggaucaagaaggcuccuggccgaggguggcagcucugauuguauuucccggacucaauuagucaagacagagguggcugaaauccacgaggacaguuacgggggaccuggcgaaaagauuaccauaugcaacgguagcacaaucguagaucaggggcugggcucugagcuaggauguuauacuauuaaccguguucgcuccuacaagcucugcgaaaauucagccaguggcaaaagcugcgagaucgacucgaucccagugaaguguaaacagggguucugccugaagauuacccaggagggaagaggucaugucaaacuuuccaggggcacggaaauaguguuggaugucugugacucuagcugcgagcugaugauccccaaagggacaggagacauucucguggauuguucaggcggucaacagcacuuucugcagaacaaucuuaucgaccuggggugcccgaacguuccuuugcucggcaagauggcaauuuaugugugucggaugaguaaucauccaaaaaccacuauggccuuccuguuuugguucuccuuuggauacguaauuaccugcauagcuugucgagucuuauucuaucugcuaaucgccauuggcacaguggggaagaaacucaagcaguaccgcgaacugaagccccaaacuugcaucguuugugagucugugccugucaacgcaauugaugcggagaugcacgaacuuaauugcagcuacaacaucugccccuauugugcuuccagauugucaaccgacggacugauaaggcaugugacacagugcccaaaacggcgcgagaagguagaagagacggaacucuuucugaauuuagagagaaucccuuggcuggugaggaaacuuuugcagguuagcgagaguaccgguauggcccucaagcguucuuguuggaugaucacucugcuaauucugcuccuggucuccaucagccccgugcaaucggcaccagugggcaaagaacgggccauagagacauaccaggcucgagaaaccuauacugggaucugccuuuucgucuugggaucaguucuguuugccgugucuugguuaacaaaggcacucauugauggcaucgguaacaguuucuccccggggcugagcguguguaaaaccugcucuauuggcagcaucaauggauuugagauagaaucccacaaguguuacugcucacuuuucuguugcccuuauuguagagcuugcaguagcgacaagaacacgcacaggaugcaucugaauguaugcaaaaagcgcaaaaugggcucuaacgucauguuggccguguguaagcggaugugcuuuagagcgacuauugaggccuccaauaaagcucuccugaucaggucaaucauuaacaguaccuucguuaucuguauucuaauacugacaaucugcguggucagcaccuccgcaguggauauggagaaccuccccgccgggauuugggaaaaggaggaagaccugacuaauuucugucaccaggagugccagguuacagaaaccgagugucuuugcccauacgaggcuaugguguugcgcaagccccuguuuuuagauucuacagccaaaggaaugaagucgcuccugaacagcacuucacuugaaaccucccugaguaucgaggcaccuuggggcgcgauuaauguacaaucuacguucaaaccaacagucagcgccgcuaacaucgcccuauccuggucaucuguggaacaucgagguaauaagauacucgugagcgggcggagugaguccaucaugaaacuggaggaacguaccggagucagcuggaacuugggcguugaggacgcaucugaaucaaagacucugaccguguccguaauggauuuaagucagauguauagccccguguuugaguaccucucgggugacagacaggucgaagaguggccuaaggcuacauguacuggcgauugcccggagaggugugggugcaccucuuccacgugccugcacaaagaauggccacacagccgcaauuggcgguguaaccccacauggugcuggggagugggcaccggguguacuugcuguggacuugacguuaaggacuucuuuacagauuacaugcuggugaaauggaaggucgaguauauuaaaaccgaagccaucgugugcguugaguugacuucacaggaaagacaauguagucucauugaggcaggcacaagguucaaucuggguccugugaccaucacgcuaucugagccacgaaacguccagcagcgccugcccccugaaauaguaacucuucauccgaagauugaggaaggguuuuucgaccucaugcacgugcagaagauccuguccgccagcaccguuugcaaauugcaaucauguacacauggagugcccggcgauuuucagaucuaccacgucgguaaucuguuacggggcgacaaggugaacgggcauaguauucacaaaauagagccacacuucaauaccagcuggauguccugggauggaugcgaccucgauuauuuuuguaacaugggcgacuggccuucuugcacauacacugggguaacccagcauaauagagcugcguucaucaacaugcugaacauugaaacggauuauacaaagacuuuucacuuccauagcaaaagggugaccgcccacggagacacaccccaacuugaucugaaggcacguccagcuuacggcgccggugaggucaccguuuugguggagguggccgaccucgaacugcauacuaaaaaucuagaggucuccgggcugaagaucgcuucacuuaccugcucuggauguuaugcaugcaguucgggcauuagcuguaaggugcgcauccacguuaacgaaccugaugaguucacaguacacgugcgguccucugaccccgacgucguggccgcggguucaagccucauggcuagaaaaauagaguuuggcgccgauuccacguucaaggcauuuaguucuaugccaaaagacagccugugcuucuacaucguugaaaaggauuacuguucauccugcacugacgaugacacccagaaaugugugaauacaaaguuggaucauccgcagaguauuuuaaucgagcacaaggggaccauuaucggaaaacagaacgacacuugcagcacaaagaccucuuguuggcuggaauccgucaaaggcuuuuucuaugggcucaagaauaugcugucaggaauauuuggcaacguguuccuugguauuuuucuguucuuggccccuuuuguacuacugaucuucuucuuuuucuuuggguggaggcuccuguucugccuuaaauguugccgacggacgcgcggauuacugaaguacaagcaucucaaagaugaggaagaggcuggcuauaagaaaaucauugagagauugaauggcaagaaaggaaagagccaacuguuugacggggaaaggcucgcagaucggaagaucgccgagcuguucucgacuaaaauacacauugguuga

SEQ ID NO: 10262 - RNA, 5094 nt, Artificial Sequence
  derived and/or modified CDS sequence (opt3) from CCHFV(7001)__AB069670.1__GP
augcuguuccacuuuaaguucaugcuccuuaucaacuuuauucugugccauuuguuauggggcgggggaggugugaccggcggggucgagacaaauagcuccucuacucaggccauacaaacgcccccuguuaccucaaacaguacaacuccaggaccgagcaccgacacagcuaccgaaacugcauccucuaugacaaccucgacgcccgauacucaggugaccacagacaauggcucaggugagccuagcacugauccacugaccacaaacgaagccacucccccucuaaguguaacgacugcgcagacaaccgagacuaaaaagcacacaacccucgacccauccacgucuaccaaucccgaugcuacaacuccuagcaucaccauucuguccgccucaaacacaagucuuccaaucagcucugugcaugcauccccgucacccagcaguucugaggaaccuacuccacagaaugcccaccaucuguccaggagcuugcucucggcugucucuaccgagacagggcaaauugcauccgccgcuaccgccgcgaaagaaaucacuacgaagaacucacccccuacagcaggaaaugacaccauggugaccagugccccaaacggcaauauaagaaacacccccgagcaggcuaauccgacagccccugaagcaagccccaaaauccagaccacucagaaccaacagacaguuacgccagaggcuaccccuauuacuacaaucaccgcccugacagaucugacuaaucgguccaagcgcgacucuaaggugcagauuauccucaccuucagccagggcuuaaagaaguacuauucaaaaauacugaaacuuuugcaacugacgcaggaggaagauagugaggggcuacucgaaugguguacccgaguccuggagcaggcgugcgacgaugacuacuuuaacaaacguauugaagaguucuuuaucacaggaaaggguuauuucaacgaugugcuucaauuuagacugcacgacgccuuguccaauacugagcccgcacagaccacaagcccaacugcuguacccuucaagucuuacuaugccaaaggcucacucaccuuugacaguggguacuucagcgcuagguguuauccucgggccuccaacucuggacugcaguuaauuaauguuacgcagcacccagugaagaucgcaaacacaccgggccccaaacugucgaaucucaagaccaucaacugcauuaaucuuaaagucagcacugauaaggaacauuccgagcuggaagugaacguguugcuaccucaagucgccguuaaucugucaaacugucacgugaguauaaaaucucauguaugcgacuacagccucgauacagacggugcuaucaagcugccacgcguggcgcacaauggggucuuuauucccggaaccuacaagaucgugauagauaaaaagaacaaucuuaacgacagauguacucugauuaccaauugcguuaucaaaggcagggaggugcggaagggccaguccgcauugcgccaguauaaaacagaaauccgaauugggcagacguucaccggaucaagaaggcuccuggccgaggguggcagcucugauuguaucucccggacucaauuagucaagacagagguggcugaaauucacgaggacaguuacgggggaccuggcgaaaagauaaccaucugcaacgguagcacaauuguagaucagcgucuggggucugagcuaggcuguuauacuaucaaccgcguuagauccuacaaacucugcgaaaauucagccaguggaaagagcugcgagaucgacucgauuccagugaaauguaagcagggcuucugccugaaaauaacccaggaggggaggggacaugucaaacuuucccgggguacggaaaucguguuggaugucugugacucuagcugcgagcugaugauucccaagggcacaggggacauccucguggauuguucaggaggccaacagcacuuucugcagaacaaucuuauugaccuggguugcccgaacguuccuuugcucgggaagauggcaaucuaugugugucgaaugaguaaucauccaaagaccacuauggccuuccuguuuugguucuccuuuggcuacguaauaaccugcaucgcuugucgcgucuuauucuaucugcuaauugccaucggaacagugggcaaaaagcucaaacaguacagagaacugaagccccaaacuugcauuguuugugagucugugccugucaacgcaaucgaugcggagaugcacgaacuuaauugcagcuacaacauaugccccuauugugcuuccagguugucaaccgacgggcugauucggcaugugacacagugcccaaagcgcagagagaaaguagaagagacggaacucuuucugaauuuagagaggaucccuuggcuggugcguaaacuuuugcagguuagcgagaguaccggaauggcccucaagcggucuuguuggaugauuacucugcuaauccugcuccuggucuccauaagccccgugcaaucggcaccaguggguaaggaacgagccaucgagacauaccaggcuagagaaaccuauacuggcauuugccuuuucgucuuggggucaguucuguuugccgugucuugguuaacaaaagcacucaucgauggaauuggcaacaguuucuuuccgggucuguccguguguaagaccugcagcaucgggucuauaaauggcuucgagauugaaagccacaaauguuacugcucccuguuuuguugcccuuauuguagggcuugcucaagugacaagaacacgcaccgcaugcaucugaauguaugcaagaaacggaagaugggaagcaacgucauguuggccguguguaaaagaaugugcuucagggcgacuaucgaggccucuaauaaggcucuccugauccgcuccauuaucaacucaaccuucguuauuuguauacuaauccugacaauuugcguggucaguaccagcgcaguggauauggagaaccuccccgccggcaucugggaaaaagaggaagaccugacuaauuuuugucaccaggagugccagguuacagaaaccgagugucuuugcccauacgaggcuaugguguugcgaaagccccuguucuuagauaacauugccaaggggaugaaaucccuccuuaauucuacaucgcuugaaacuagccugucaaucgaggcaccuuggggagcgauaaacguacaauccaccuuuaagccaacggucagugccgcuaauaucgcccuaucuuggagcuccguggaacaucggggcaacaaaauucucgugucaggucguucugagagcaucaugaagcuggaggaaagaacaggggucaguuggaauuugggaguugaggacgcauccgaaagcaaaacccugacugugucuguaauggauuuaucacagauguauucccccguguucgaguaccucaguggcgacaggcaggucgaagaguggccuaaggcuaccuguacaggugauugcccggagcgcuguggcugcacuagcucgaccugccugcacaaggaauggccacacucucggaacuggagauguaaucccacguggugcuggggaguggggacaggcuguaccugcugugggcuugacguuaaagacuuuuucacugauuacaugcuggugaaguggaaagucgaguauauuaagacagaagccaucgugugcguugaguugaccucccaggaaaggcaauguagccucauagaggcaggaacucgauuuaaccugggcccugugacaauuacccuaucagagccacgcaauguccagcagcggcugcccccugaaaucguaacgcuucauccgaaaaucgaggaagguuucuuugaccucaugcacgugcagaagauucugagugccucuacuguuugcaaguugcaauccuguacccauggggugcccggagauuuccaggucuaccacgugggcaaccuguuaagaggugacaaaguaaauggccauagcauacacaagaucgagccacacuuuaacacaucauggaugaguugggaugggugcgaccucgauuauuucuguaauaugggagacuggccuagcugcaccuacacaggcgugacucagcauaacagggcugcguuuauuaacaugcugaauaucgaaaccgauuauacgaaaacauuccacuuccauuccaagcgugucacugcccacggggacacaccccaacuugaucugaaagcacgcccagcuuacggagccggcgagguuaccguguugguggaggucgccgaccucgaacugcauaccaagaaacuagaggugucuggucugaagauugcuagccuuacuugcuccggguguuaugcaugcucaucuggaaucaguuguaagguucggauacacguaaacgaaccugaugaguuuaccgugcacgucagaucgagcgaccccgacgugguugccgcgggcuccucucucauggcuaggaaaaucgaguucggugccgauucaacauuuaaggcauucagcuccaugccaaaagacagucugugcuuuuacauuguggaaaaggauuacuguucuagcugcacggacgaugacacucagaaaugugucaauaccaaguuggaucauccgcagucaaucuuaauugagcacaagggcacaaucauagggaaacagaacgauaccugcuccacuaagacaaguuguuggcuggaaagcgugaaaggauucuuuuauggccucaagaauaugcugucugggauuuucggaaacguauuucuuggcaucuuccuguuuuuggccccuuucguccuacugaucuucuuuuucuuuuucgguuggcgacuccuguuuugccuuaaauguugccggcgcaccagaggguuacugaaguacaagcaucucaaagacgaggaagaggcuggauauaagaaaauuaucgagagguugaauggcaagaaaggcaagucccaacuguucgacggggaacggcucgcagaucgaaagauagccgagcuguuuucaacgaaaauucacaucggauga

SEQ ID NO: 10263 - RNA, 5094 nt, Artificial Sequence
  derived and/or modified CDS sequence (opt3) from CCHFV(YL16070)__KY354081.1__GP
augcuguuccacuuuaaguucaugcuccuuaucaacuuuauucugugccauuuguuauggggcggggugggagucaccgguggcguugagacaaauagcuccucuacucaggccauacccacgccuccagugaccucaaacaguacaacuccggggcccagcaccgacacagcuaccgaaacugcauccucuaugacaaccucgacgccugauacucaaguaaccacagacaauggaucaggcgagccaagcacugauccccugaccacaaacgaagccaccccuccacuaagugugacgacugcgcagacaaaagagaccaagaaacacacuacacucgaccccaauaccuccgcuaacccugaugccacgaccccaucuaucacaauucugagcgcauccaauacuucacuuccgaccaguagcguccaugccucucccuccccuucaagcagugaggaaccaacaccccagaacgcucaccaucugucuagauccuugcucagcgcagugucgacugagaccggucagacagccucugcuaccacugccacgaaggaaaucacaaccaaaaauuccccuccaacugcggggaacgacaccaugguuacaucagcacccaauggaaacaccaggaauacuccggagcaagccaacccuacagcucccgaagccagucugaagauucagacgacccagaaucagcaaacugugacaccagaggcaaccccuaucacaacugucaccgcucugacggaucucaccaaccggagcaagcgcgacuccaaagugcagauaaucuuaacauucucucagggccugaagaaauacuauagcaagauucuuaaauugcugcagcuaacucaagaggaagauucagagggccuccuggaaugguguacccgaguacuugagcaggccugcgacgaugacuacuuuaacaagcguaucgaagaguucuuuauuacagggaagggauauuucaaugauguucugcaguuuagauugcacgacgcgcucaguaacacugagcccgcccaaaccacguccccaacagcagugcccuucaaaagcuacuaugcuaaggguucucugaccuuugacucaggcuacuucagugccagguguuauccucgggcuagcaauuccggguuacagcugaucaacgucacucagcacccagugaaaauagccaauacaccgggacccaagcucucuaaccuuaaaaccauuaauugcaucaaccugaaggugucgacugauaaagaacauagcgaguuggaagucaauguucuacugccucagguggcaguaaaccucuccaauugucacgugucaauuaagagucaugucugcgacuacucucuggauaccgacggcgccaucaaacuuccacgcguggcucacaacgguguuuuuauccccgggacauacaaaauugugauagauaagaaaaauaaccugaaugacagauguacguugaccacuaacugcgucaucaagggaagggaggugcggaaaggccaaagcgcgcuccgccaguauaagacagaaauucgaaucggccagaccguaacaggguccagaaggcuguuagcagagggagguucaagcgauuguauaucucggacucagcugguuaagaccgagguggccgaaauucacgaggacuccuacggcgggccuggagaaaagaucacgaucugcaacggcaguacaauugucgaucaacgucuagguagcgagcucggguguuauaccaucaaucgcgugaagucuuacaaacugugcgaaaacuccgcuucaggcaagaguugcgagauugacagcauaccagucaaauguaagcagggauucugccuuaagaucacucaggagggcagagggcaugugaaauugucgaggggaaccgaaauuguucuggaugugugugacuccucuugcgagcucaugauccccaaggguacaggcgacauccugguagauuguagcgggggacagcaacacuuccuucagaauaaccugauugacuugggcugcccgaaugucccucuccuggguaaaauggccauauaugugugucggaugucaaaccauccaaagacuaccauggcauuuuuauucugguuuaguuucggguacguuaucacaugcauugugugucgaguccuguuuuaucuacucaucgccauuggcacgguggggaaaaagcugaagcaguaccgcgaacuuaaaccccagaccugcaucguaugugaguccgugccuguuaaugcuauagaugccgagaugcacgaauugaacugcucuuacaauaucugccccuauugugcaagcagacuguccacugacggccucauuaggcaugucacacaaugcccaaagcggcgcgagaaaguggaagagaccgaacuguucuuaaaccuggagagaaucccuuggcuugugaggaaguugcuccaggucucagagagcacugggauggcgcugaaacguaguuguuggaugauuacacuacugauccuccugcuuguuucuaugucccccgugcagagcgcuccagugggaaaggaacgggccauagagaccuaccaagcacgagaagccuauacggguauuugcuuguuuguacugggcucggucuuauucgcugugucauggcucacuaaagcccugaucgaugggauuggaaauagcuuuuucccgggccuuaguguuuguaagaccugcuccaucgguagcauaaacggguuugagaucgaaucucacaaguguuacugcagccuguucuguugcccuuauuguagagcaugcuccucagacaaaaauacacacaggaugcauuugaacgugugcaagaaacgcaagaugggcaguaaugucaugcucgcuguguguaaacggaugugcuuuagagccaccauugaggcgagcaacaaggcccugcuaaucaggucuauuaucaacuccacuuucguuauauguauucugauccucacaaucugcgugguaucaaccagugcugucgauauggagaaucugcccgcaggaauuugggaaaaggaggaagaccuuacaaacuucugucaccaggagugccaggugacugaaaccgaguguuugugcccauacgaggccauggugcugcgcaaacccuuauuucucgauagcaucgcuaagggcaugaaaucccugcuuaauucuacgucgcuggaaacaagccuaucaauugaggccccuuggggagcaauaaacguccaguccaccuucaagccaacuguuagugcggccaauaucgcucucucuuggagcuccguggaacaucgaggaaacaaaauucugguaucaggccggucugagagcaucaugaaguuggaggaacguaccggugugaguuggaaucugggggucgaggacgccuccgaaagcaagacauuaacugugucuguuauggaucucucacaaauguauucccccguguuugaguaccugaguggagacagacaggucgaagaguggccuaaagcaaccuguacgggcgauugcccggagaggugugguugcacaagcucgaccugccuucacaaggaauggccacacucucgcaacuggcgguguaaucccacuuggugcuggggcguggggacaggauguaccugcuguggccuggacguuaaagacuucuuuacugauuacauguuggugaaguggaaagucgaguauauuaagacagaagcuaucguaugcguggagcucaccucccaggaaagacaguguagccugauagaggccgggacgagguucaaccuaggaccuguuacuaucacccugucagagccacgaaaugugcaacagcgccuucccccugaaauugucacacuccauccgaagaucgaggaaggcuuuuucgaccugaugcacgugcagaaaauuuugagugcaucuaccguaugcaagcugcaguccuguacacauggugugcccggggauuuucaagucuaccacguuggaaacuuacuccggggcgacaaagugaauggucauagcauccacaagauagagccacacuucaacacuucauggaugaguugggauggcugcgaccuggauuauuuuuguaauaugggggacuggccuagcugcaccuacacgggagugacacagcauaacagagccgcuuucauuaacaugcuuaauaucgaaacugauuauaccaaaacauuucacuuccauuccaagagggucaccgcgcacggcgacacuccccagcuggauuugaaagcccguccagcauacggggcuggagaggugaccguucucguagagguggccgaccuggaacuacauacaaagaagcuggaggucucuggccuuaaaaucgccagccucacgugcuccgguuguuaugcuugcucaucugggauuaguuguaaggugcgcauacacguuaacgaaccugaugaguucacugugcacguccggucgagcgaccccgacgugguagcagccggauccucucugauggcgagaaaaaucgaguuuggcgcugauucaaccuucaaggccuuuagcuccaugccaaaagacaguuugugcuucuacauugucgaaaaggauuacuguucuagcugcacagacgaugacacccaaaagugugugaauacuaaauuagaucauccgcagucaauccugauugagcacaaggguacaaucauaggcaaacagaacgacacuugcuccacgaagaccaguuguuggcucaaaucuuuuaagggguucuuuuauggacugaagaauaugcuuucuggcaucuucgggaacguuuuucugggaauuuugcuauuccuggcaccuuuugugcuccugaucuucuucuuuuucuuuggcuggaggcuuuuauucugccugaaauguugcaagaaaacaaagggucucuugaaauacaagcaucugaaggauaaagaagaggccggguauaagaaaauuaucgaacgacucaauggaaagaaaggcaagucccagcuguuugacggcgagcggcuugcuaaccgcaagauagcagagcuguucucaaccaaaauucacaucggguga

SEQ ID NO: 10264 - RNA, 5094 nt, Artificial Sequence
  derived and/or modified CDS sequence (opt3) from CCHFV(YL04057)__FJ562094.1__GP
augcuguuccacuuuaaguucaugcuccuuaucaacuuuauucugugccauuuguuauggggcgggggaggugugaccggcggggucgagacaaauagcuccucuacucaggccauacccacgccuccaguuaccucaaacaguacaacuccgggacccagcaccgacacagcuaccgaaacugcauccucuaugacaaccucgacgccugauacucaagugaccacagacaauggcucaggugagccaagcacugaucccccuaccacaaacgaaaccacgccacccccuagugccacuacagcgcagaccacugagaccaaaaagcacaccacgcuggacccaaauaccuccacaaacccggaugcuaucacucccucuauuaccauccuaagcgccuccaauacaucacucccuauuaguagcguacaugcaucuccaucccccucaagcagugaggagccuacuccacagaacgcccaccaucugucuagaucccuucugagcgcugugucgaccgagacagggcagaucgcaucugccaccacugcugccaaagaaauaacgacaaagaacucacccccgaccgcgggaaaugacacuaugaucaccuccgcaccuaauggcaacacaaggaauacccccgagcaagccaacccaacugcuccugaagccagucccaaaauucagacaacgcagaaucagcaaaccgucaucccagaggcaacucccauuacaaccaucacagcuuugacugaucucaccaaccggagcaagcgcgacuccaaggugcagauaauucugacguucucucagggccugaaaaaguacuauagcaaaauccucaaguuacugcagcuuacccaagaggaagauucagagggguugcuggaaugguguacacgaguucuagagcaggccugcgacgaugacuacuuuaacaaacguauugaagaguucuuuaucacuggaaaggguuauuucaaugaugugcuccaguuuagacugcacgacgcgcuuaguaacaccgagccugcccaaacaacuuccccaaccgcagucccguucaagagcuacuaugcuaaaggcucucugacguuugacucaggguacuucagugccagguguuauccccgggcuagcaauuccggauugcagcucaucaacgugacacagcacccuguaaagauugccaauaccccaggccccaaacugucuaacuuaaagacuauaaauugcaucaaccugaaaguuucgacagauaaggaacauagcgagcucgaagugaauguccuucugccucagguggcagugaacuuguccaauugucacgucucaauuaaaagucauguuugcgacuacucucuagauaccgacggugccaucaagcugccacgcauagcucacaacgggguguuuauucccggaacuuacaagaucguaaucgauaaaaagaauaaccucaaugacagauguacccugacaacgaacugcgugauuaaaggcagggagguccggaagggccaaagcgcgcuucgccaguauaaaaccgaaauccgaauugggcagacuuucacaggauccagaaggcuguuggcagaggguggcucaagcgauuguauaucucggacccagcucgugaagacagagguugccgaaauccacgaggacuccuacgggggaccgggcgaaaagauuacuaucugcaacgguaguaccaucguggaucaacgucuggggcgcgaguuaggcuguuauacgauuaauagagucaggagcuacaaacugugcgaaaacucugcuuccggaaagucaugcgagauagacaguaucccugugaaauguaagcagggcuucugccuaaaaauuacacaggaggggcggggacauguaaagcucagccgagguaccgaaaucguucuggaugugugugacucguccugcgagcuuaugauuccaaagggcacuggggacaucuuggucgauuguucuggaggccagcaacacuuucugcagaauaaccucauagaccuggguugccccaaugugccucuucuggggaaaauggccaucuaugucugucgcaugagcaaccaucccaagaccacaauggcauucuuguuuugguucucauuuggcuacgugauuacuugcaucgccuguagaguucucuucuaucuguuaauugcuaucggaaccgugggcaaaaagcugaaacaguacagggaacuaaagccacagacaugcauaguaugugagagugucccugugaaugccauugaugcagagaugcacgaacucaacugcuccuacaauaucugccccuauugugcgucucggcugagcacggacgggcuuauucgccauguuacccaaugcccaaagagaagggagaaaguggaagagacugaauuguuucugaaccucgagcguaucccguggcugguccggaaguuauuacagguguccgagucaacaggaauggcucuuaaacgaagcuguuggaugauaaccuugcucauccugcuacugguaaguauuucuccugugcaguccgcccccguugguaaggaaagagcaaucgagacuuaccaagccagggaaacauauaccggcauuugccucuucguccuggggagcgugcuuuuugcugugucgugguugacgaaagcccugaucgauggaauaggcaauucauucuuuccagguuuaucugucuguaagacuugcaguauuggguccaucaacggcuucgagaucgaaagccacaaauguuacugcucucucuuuuguugccccuauugucgcgcaugcagcuccgacaagaauacccaccggaugcaucugaacguuugcaagaaaagaaagaugggaucaaaugugaugcuugcuguguguaaaaggaugugcuuccgcgccacaauugaggcgaguaacaaggcccuguugauccgaagcauuauaaacucuaccuucguaaucuguauucucauccugacuauuugcgucguguccacaucagcuguugauauggagaaucuaccugcaggcaucugggaaaaagaggaagaccugaccaacuuuugucaccaggagugccaggugacagaaacugagugucucugcccauacgaggccaugguccugcggaagccccuuuucuuggauaguauagcuaaggggaaaaagagccuguuaaauuccaccucucucgaaacgucgcugagcaucgaggccccuuggggagcaauuaacgugcagucaacauuuaaaccgaccguuuccgcggccaauaucgcucuuaguuggucuagcguggaacaucguggcaacaagauucugguauccgguagaucagagucuaucaugaaacuagaggaaaggacuggggucagcuggaaucucggaguggaggacgccagugaauccaagacccugacagugagcgucauggauuugucucaaauguauucaccaguuuucgaguaccuguccggcgaccgccagguggaagaguggcccaaggcaacuuguaccggugauugcccugagcgguguggcugcacgaguagcacaugcuuacacaaagaauggccacacucgagaaacuggagguguucucccaccuggugcuggggaguagggacuggcuguacaugcugugggcucgacgugaaggacuuuuucaccgauuacaugcuggucaaauggaagguggaguauauaaaaacugaagcuauuguuugcguggagcuuacaucccaggaacgacaguguagccugaucgaggccggaacccgcuuuaauuugggcccugucacgaucacucucucagagccgcggaacgugcaacagagacugcccccagaaauuguuacccuacauccuaagauagaggaagguuucuuugaccugaugcacgugcagaagauccuuagugcaucuacagucugcaaacuccaguccuguacccaugggguacccggagauuuccaaguguaccacguuggcaaucuguugaggggugacaaggugaacggccauagcauucacaaaaucgagccacacuuuaauacaucauggaugaguugggaugggugcgaccuggauuauuucuguaacaugggagacuggccuagcugcacuuacaccggcgucacgcagcauaaucgugccgcuuuuauuaacauguuaaacaucgaaacagauuauacuaagaccuuccacuuccauuccaaacgcgugacagcgcacggggacacaccccagcucgaucugaaggcccggccagcauacggagcuggcgagguaacugugcuugucgagguugccgaccuggaauugcauaccaaaaagcucgaggugucuggucugaagauagccagccuaacaugcuccggguguuaugcuugcucaucuggaaucaguuguaaagugaggauucacgucaaugaaccggaugaguuuacggugcacguuagaucgagcgacccugacguaguggcagccggcuccucucugauggcgcgaaagaucgaguucggugcugauucaacuuuuaaagccuucagcuccaugcccaaggacagucuuugcuuuuacauugucgaaaaagauuacuguucuagcugcaccgacgaugacacacaaaagugugugaacaccaagcucgaucauccacagucaauccugauagagcacaaaggcacuauuaucgggaagcagaaugacacaugcuccaccaaaacgaguuguugguuggaaagcguuaagggauucuuuuauggccugaaaaacaugcugucugggaucuucggaaauguguuucucggcauucugcuuuuccuggcacccuuugucuugcuaaucuucuucuuuuucuuugguuggcggcuccuguucugccugaaguguugccgcagaacuagggggcuuuuaaaguacaaacaucugaaggaugaggaagaggccggauauaaaaagauaauugagcggcucaacggcaaaaagggcaagucccaguuguuugacggggaacgacuggcugauagaaaaaucgcagaacucuucucaacaaagauucacaucggauga

SEQ ID NO: 10265 - RNA, 5094 nt, Artificial Sequence
  derived and/or modified CDS sequence (opt3) from CCHFV(79121M18)__GU477493.1__GP
augcuguuccacuuuaaguucaugcuccuuaucaacuuuauucugugccauuuguuauggggcgggggaggugugaccggcggggucgagacaaauagcuccucuacucaggccauacaaacgcccccuguuaccucaaacaguacaacuccaggaccgagcaccgacacagcuaccgaaacugcauccucuaugacaaccucgacgcccgauacucaggugaccacagacaauggcucaggugagccuagcacugauccacugaccacaaacgaagccacucccccucuaaguguaacgacugcgcagacaaccgagacuaaaaagcacacaacccucgacccauccacgucuaccaaucccgaugcuacaacuccuagcaucaccauucuguccgccucaaacacaagucuuccaaucagcucugugcaugcauccccgucacccagcaguucugaggaaccuacuccacagaaugcccaccaucuguccaggagcuugcucucggcugucucuaccgagacagggcaaauugcauccgccgcuaccgccgcgaaagaaaucacuacgaagaacucacccccuacagcaggaaaugacaccauggugaccagugccccaaacggcaauauaagaaacacccccgagcaggcuaauccgacagccccugaagcaagccccaaaauccagaccacucagaaccaacagacaguuacgccagaggcuaccccuauuacuacaaucaccgcccugacagaucugacuaaucgguccaagcgcgacucuaaggugcagaaaauucucaccuucagccagggcuuaaagaaauacuauucaaagauccugaaacuuuugcaacugacgcaggaggaagauagugaggggcuacucgaaugguguacccgaguccuggagcaggcgugcgacgaugacuacuuuaacaagcguauagaagaguucuuuauuacaggaaaggguuauuucaacgaugugcuucaauuuagacugcacgacgccuuguccaauacugagcccgcacagaccacaagcccaacugcuguacccuucaaaucuuacuaugccaagggcucacucaccuuugacaguggguacuucagcgcuagguguuauccucgggccuccaacucuggacugcaguuaaucaauguuacgcagcacccagugaaaauugcaaacacaccgggccccaagcugucgaaucucaaaaccaucaacugcaucaaucuuaaggucagcacugauaaagaacauuccgagcuggaagugaacguguugcuaccucaagucgccguuaaucugucaaacugucacgugaguauuaagucucauguaugcgacuacagccucgauacagacggugcuauaaagcugccacgcguggcgcacaauggggucuuuauccccggaaccuacaaaauugugaucgauaagaaaaacaaucuuaacgacagauguacucugauaaccaauugcguuauuaagggcagggaggugcggaaaggccaguccgcauugcgccaguauaagacagaaauccgaaucgggcagacguucaccggaucaagaaggcuccuggccgaggguggcagcucugauuguauuucccggacucaauuagucaagacagagguggcugaaauccacgaggacaguuacgggggaccuggcgaaaagauuaccauaugcaacgguagcacaaucguagaucaggggcugggcucugagcuaggauguuauacuauuaaccguguucgcuccuacaagcucugcgaaaauucagccaguggcaaaagcugcgagaucgacucgaucccagugaaguguaaacagggguucugccugaagauuacccaggagggaagaggucaugucaaacuuuccaggggcacggaaauaguguuggaugucugugacucuagcugcgagcugaugauccccaaagggacaggagacauucucguggauuguucaggcggucaacagcacuuucugcagaacaaucuuaucgaccuggggugcccgaacguuccuuugcucggcaagauggcaauuuaugugugucggaugaguaaucauccaaaaaccacuauggccuuccuguuuugguucuccuuuggauacguaauuaccugcauagcuugucgagucuuauucuaucugcuaaucgccauuggcacaguggggaagaaacucaagcaguaccgcgaacugaagccccaaacuugcaucguuugugagucugugccugucaacgcaauugaugcggagaugcacgaacuuaauugcagcuacaacaucugccccuauugugcuuccagauugucaaccgacggacugauaaggcaugugacacagugcccaaaacggcgcgagaagguagaagagacggaacucuuucugaauuuagagagaaucccuuggcuggugaggaaacuuuugcagguuagcgagaguaccgguauggcccucaagcguucuuguuggaugaucacucugcuaauucugcuccuggucuccaucagccccgugcaaucggcaccagugggcaaagaacgggccauagagacauaccaggcucgagaaaccuauacugggaucugccuuuucgucuugggaucaguucuguuugccgugucuugguuaacaaaggcacucauugauggcaucgguaacaguuucuccccggggcugagcguguguaaaaccugcucuauuggcagcaucaauggauuugagauagaaucccacaaguguuacugcucacuuuucuguugcccuuauuguagagcuugcaguagcgacaagaacacgcacaggaugcaucugaauguaugcaaaaagcgcaaaaugggcucuaacgucauguuggccguguguaagcggaugugcuuuagagcgacuauugaggccuccaauaaagcucuccugaucaggucaaucauuaacaguaccuucguuaucuguauucuaauacugacaaucugcguggucagcaccuccgcaguggauauggagaaccuccccgccgggauuugggaaaaggaggaagaccugacuaauuucugucaccaggagugccagguuacagaaaccgagugucuuugcccauacgaggcuaugguguugcgcaagccccuguuuuuagauucuacagccaaaggaaugaagucgcuccugaacagcacuucacuugaaaccucccugaguaucgaggcaccuuggggcgcgauuaauguacaaucuacguucaaaccaacagucagcgccgcuaacaucgcccuauccuggucaucuguggaacaucgagguaauaagauacucgugagcgggcggagugaguccaucaugaaacuggaggaacguaccggagucagcuggaacuugggcguugaggacgcaucugaaucaaagacucugaccguguccguaauggauuuaagucagauguauagccccguguuugaguaccucucgggugacagacaggucgaagaguggccuaaggcuacauguacuggcgauugcccggagaggugugggugcaccucuuccacgugccugcacaaagaauggccacacagccgcaauuggcgguguaaccccacauggugcuggggagugggcaccggguguacuugcuguggacuugacguuaaggacuucuuuacagauuacaugcuggugaaauggaaggucgaguauauuaaaaccgaagccaucgugugcguugaguugacuucacaggaaagacaauguagucucauugaggcaggcacaagguucaaucuggguccugugaccaucacgcuaucugagccacgaaacguccagcagcgccugcccccugaaauaguaacucuucauccgaagauugaggaaggguuuuucgaccucaugcacgugcagaagauccuguccgccagcaccguuugcaaauugcaaucauguacacauggagugcccggcgauuuucagaucuaccacgucgguaaucuguuacggggcgacaaggugaacgggcauaguauucacaaaauagagccacacuucaauaccagcuggauguccugggauggaugcgaccucgauuauuuuuguaacaugggcgacuggccuucuugcacauacacugggguaacccagcauaauagagcugcguucaucaacaugcugaacauugaaacggauuauacaaagacuuuucacuuccauagcaaaagggugaccgcccacggagacacaccccaacuugaucugaaggcacguccagcuuacggcgccggugaggucaccguuuugguggagguggccgaccucgaacugcauacuaaaaagcuagaggucuccgggcugaagaucgcuucacuuaccugcucuggauguuaugcaugcaguucgggcauuagcuguaaagugcgcauccacguuaaugaaccugaugaguucacaguacacgugcgguccucugaccccgacgucguggccgcggguucaagccucauggcuagaaagauagaguuuggcgccgauuccacguucaaagcauuuaguucuaugccaaaggacagccugugcuucuacaucguugaaaaagauuacuguucauccugcacugacgaugacacccagaagugugugaacacaaaguuggaucauccgcagaguauuuuaaucgagcacaaagggaccauuaucggaaagcagaaugacacuugcagcacaaaaaccucuuguuggcuggaauccgucaagggcuuuuucuaugggcucaaaaacaugcugucaggaauauuuggcaauguguuccuugguauuuuucuguucuuggccccuuuuguacuacugaucuucuucuuuuucuuuggguggaggcuccuguucugccuuaaguguugccgacggacgcgcggauuacugaaguacaaacaucucaaggaugaggaagaggcuggcuauaaaaagaucauugagagauugaacggcaaaaagggaaagagccaacuguuugacggggaaaggcucgcagaucggaaaaucgccgagcuguucucgacuaagauacacauugguuga

SEQ ID NO: 10266 - RNA, 5088 nt, Artificial Sequence
  derived and/or modified CDS sequence (opt3) from CCHFV(ArD39554)__DQ211628.1__GP
augcugugccacaucaagcauauucuccuuuucuguauaauccuguaccaccagcaauggaacaccggcgccagcaauacaacuauuucccccacgaccaacaaaucucauacagacaucucacaccagccuaccaguauuacugcugcaagcuccccagggucuccggccacaaccgcgcccccugagagaucggugacuccaucacauacacccaccacgagcgucagugaagcuggauccggugagccuccagccgcaacucccgccucugcuaccgcacagagcccugaaccagccuccgcugcccagccgucacccacaaucccuaagccaacuacccccgauccuacaagugaggcguugagcaccccagcaacgucuaggccccaagaaccguccacucacccuucaccccggagcaguccaucuaaaccuguugagacacaguccacccgccacacugcccgagaguuacugagcgugacaggcaccgaagcugagcagcuaauaacgcagaccauccauacaacuaaggaagccaccaaagcaacaucgccccaaccaacugcuucuaaucccgacccuacccucgccacaaccucccguucaauuaacaguaucaauccaaaggggccggagagcacuagagcgacgccccaguccacaucuccuaccccagagagcucaacuauucagacccagauccugcccauaauuacaaccccuggaacucuugaagccaucauucacccaacaaacaggaguaagcggaaucugggcacggagaucaucuugacccucccccaaggucugaaaaaguauuacuccaaaguacugaagcucaugcauuuaacucgcgaagaggauagcgaagggcugcuugaguggugcacaagaauuuugggacagaccugugacgaugacuauuuucagaaaaggauaacagaguucuuuaucacuggcgugggcuacuucaacgaaguccugcuauuuaaggagaccacggaugcaccgacccucgcuccuacacacaagggggccccacccacugaaccuuucaaaucuuauuacgcuaagggauuuauuaccauggacucagguuauuucagugccaaaugcuacagccgggcauccaauucuggccugcaacuuaucaacgugacaaugcacucgagcaagaugcccauaacuccagggccuaaauacuccaaucugaagaacauuaauuguaucaacuugaaaguuucaaccgauaaggagcauaaugaaguggagaucaacguccuccugccccagguggccguaaacuuaaguucuugccacguucuggugcgcagccaugucugugacuauucccucgaugcugacggaaugauuaagcugccacagaucacgcacgagggcacauuuauuccggguaccuacaaaauaaucauugauaagaaaaauaagcagaacgaccgaugcacucugaucacaaauugugugaucaaagggagagaagugaggaagggacaaucagcguugcggcaguauaagaccgagauucgugucggccaggcaagcucuggcacucgcagacuacuguccgaaaguaacaauaacgacugcguuagcaggacccagcucauaaaaacagagaaugccgaaauccauggggaugacuacggagguccuggcgagaagauuacgaucuguaacgggucuaccauuguggagcaacggcugggauccgaacuuggcugcuauacuaucaaucgaauaaaaucauucaagcugugcgagaacagugcuagcgguaaagggugugaaaucgauucgacacccguaaagugcaagcagggcuuuuguuugaaaauuacccaggagggacgcggccacgugaagcucuccagagggucugagaucauucuggacgucugcgauagcucaugugaaaugaugaucccaaaaggaaguggugacauauuaguggauugcuccggcgggcagcaacacuuccugcaggacaaucuaguugaucucggaugucccaacgugccucugcuuggcaagauggccauuuacaucugcaggaugucuaaucauccaaaaacaacuauggcauuuuuguucugguucagcuuugguuaugucauuaccuguaucuucugcaaggugauauuuuacguacugaucauuaucgggacgcucggcaagcggauuaaacaguaccgcgagcugaagccccagacauguaccaucugcgaagccacuccuguuaacgcuauagacgccgagaugcacgaucuuaauugcuccuauaacauuuguccguacugcgcaucaagacugaccagcgaaggauuggugaggcaugucacacaauguccaaaacguaaggagaaaaucgaggaaacugagcucuaucugaacuuagaacggauccccugguucgugcgaaagcugcuacaggucagugagucuaccggcguggcgcucaaaagauccagcuggcugguuacacuuuuggugcugcucacgguaucgcugucaccuguccagucugcuccaauugggcaagaaaggaccgugguuacuuaccaggugcgcgagaguuauacaggaaugugcuuauuuauccuggguuccguccuuuucgccauuagcugguugaccaagggccucguggacucuguagggaauauauuuuuccccggacugagcguguguaagacuugcuccaucggcucaauuaacgguuuugagaucgaaagucacaaauguuacugcagccuauucuguugcccuuauugucgguacugcucugcagacagaggggcccaccagucccaucugucaguuugcaagaaaaggaagacaggcaguaaugucaugcucgcuguguguaaacgcaugugcuuucgagccacccugaaggugagcuccgaggcacuuauuauccggucuauaaucaacacgacuuucgucguuuguauuuugauccugguggugugcguagucucgaccagcgcuguggaaauggagaauuuaccggccggaacaugggaaaaggaggaggaucucaccaacuuuugucaccaggaaugccaaguuacugagacagaaugucugugccccuacgaggcguucgugcuucguaaaccacuguucuuggacucaaccgccaaguccaugaaaagucuccuuaauucuacaagccuagagacuucccugucaauugaagcuccuuggggcgcaaucaacguccagucuaccuuuaagcccacggccagcacagcuaauauagcccucaguugguccagcguggagcauagagggaacaaaauucugguuaccggaaggucugaaucaaucaugaaacuugaggaacgcacuggcaucuccuggaauuuggguguggaggaugcaagugagagcaagacccugacaguaucggucauggacuuaucucagauguauuccacuguguucgaauaccucagcggggauagacagguggaggaauggccaaaggcgaccuguacgggagacugcccugagcgguguggcugcacaucaaguaccugccugcacaaggccuggccccauucuaggaacuggcgauguaauccaacuuggugcuggggugucggcacaggguguaccugcuguggacuugauguuaaaaaccuguuuacugacuauaugcuaauuaaguggaaaguggaauuuauaaagacagaggcuaucguaugcguggagcucaccucccaagaacgccaguguagccugauugaggccggcacgcgguuuaauuuggggccggucacuaucacccugucagaaccuagaaacauucagcagaaguuacccccagagcucgugacacugcaccccaggguugaagagggauucuuugaucuuaugcacgugcaaaaaguccugagugcaagcaccgugugcaaguugcaguccuguacacauggcguuccuggugaccuccagguguaccacgucgggaaccugcuaaaaggagauaagaucaauggcaacucuuuccauaaaauagagccaaaucugaacacuagcuggauguccugggacgguugcgaucuugacuauuacuguaauaugggcgacuggcccucaugcaccuauacggggguaacacaacacaaccaugcugccuuugugaaucuccugaacaucgaaacugauuacaccaagaauuuccacuuucacucuaaacguguuacagcacauggagagaccccucaguuggaccugaaggcccgcccgaaguacggcgcuggggaagugacugucuuaguggagguagcggauauggagcuccacaccaaaaagauugaaaucaguggacugaaauucgccucgcuuacaugcacgggcuguuaugcaugcagcuccgguauuucuuguaaggugcggcugcaugucgacgagccagaugaauugacuguucacgugaaaucagacgaucccgacguggucgcugccagcuccagucucauggccagaaagaucgaguuugggaccgauucuacauucaaggcuuucagcucaaugccuaaagacaagcugugcuuuuacauaguggaaagggauuauuguuccaguugcagcaaagaggacacccagaaguguguuaacgcaaaacuagagcagccccaaucuauucugaucgaacacaagggaacuaucauuggcaagcagaaugauacaugcaccguaaaagccuccuguuggcuugagucagucaagagcuucuuuuacggucucaaaaacaugcugggcgggaucuucggaaaugugauauugggcauuaucauguuuuuagcgccauucgcucugcuccugcuuuucuuccuguuuggguggcgaauuuuguucugccuacgguguugccgcagaacgaggggacuguuuaaguauaaacauaucaaggacgacgaagagucgggcuacaagcggauaauugaacgacucaacaauaaaaaggguaaaaacaagcuguucgauggggagagacuugccgacaaaaagaucgcagaguuauucucuacuaagacacacaucggauga

SEQ ID NO: 10267 - RNA, 5088 nt, Artificial Sequence
  derived and/or modified CDS sequence (opt3) from CCHFV(AP92)__DQ211625.1__GP
augcccgaccacuucauccugcuccuucugauguacaccguguuucaucagcacccucaagaugucagcgccaacguucauuuggugaauccauccaacucuacaacuggcgcuucaacggcauucaauccgguacacaacgccaccacagacgggcagaagcagaguacuagcaccacaaccauggcgagacccuccacugugacacagauuaccacggcucaagccauggaggucgauggaucuggugaaucgacuaccuuaccugcagugacaccaacucccgccgagaccacaacccaugcuaaucagaaaucagcaagcacgaugggcacucugacaaccagucuagaagacacugcccucaugacacugaccgggagguccauacuuacgucucagagccagaccggauccuuugaucggacaucaaagccucaaacuccacgcaguaccaaccagccccugcgaaaauugcucagcgcuguuucuacagaggccgcgccucagacuuccccaaccgcagugacagccgaccagaccgaagcuagcacuagcccgcaagucacgacagauaccagucccucuacuccuacccaggugacauccagcgccggcucgucuuccucaaauaccaguaaccacagcaagacuacaccacagcugacguccucugguagcgaggcacaacagacccagcccacuacaaugccuaauaccacagcucugguaacuccaaccgcccacaucucacccacgaaccguaguaaaagaaauuccgagguugaaauuauccucaccuuaccgcaggggcugaagaaguauuacagcaaaauucuuaaguugcugcaucuaacacucgaggaagacucugagggacugcuugaguggugcacuaggacccugaaacaagcgugugaugacggcuauuuccaggaacggaucaaggaguuuuucuugacaggcgaaggguacuuuaacgaggugcuccuguuccgcucaccuagucaguuaggaacuaccgguagcccccuggccuccccaccuacggcagaacccuuuaaaucuuucuaugcuaagggcuuucucauaauggauucgggguacuucagcgccaagugcuauccaaaggcuuccaauucaggacuucagcugaucaacauuacacaacacaguaucaaggucgugaauacccccggcccuaaauacucuaacuugaagacugugaacuguauuaaucuaaaagucagcacagacaaggaucauuccgagcuggagguuaacgugcuccugccacagguagccgugaauaucucaaacugccacguccuuauaaaaagccacgugugugacuacucucuggacaccgaugguaugauuagauugccgcagguuacucaugaagggaccuuuauccccggaacauauaagauugugaucgacaagaaaaauaagcucaacgauaggugcacgaugaccacuaauugugucaucaaaggcaaggaggugcggaaaggccaguccacacugcgccaauaccgaaccgaaauuagaguagggcagaugaguagcggaacaaggcgguuacugucugaggguggcgacgggggaugcauaucccguacucagcuaaucaagaccgaaacggcagagguucacggcgaugacuauggugggccuggcgagaagauuacaaucuguaacggaucaaccauaguggaucagcgccucggcagugaacuggggugcuacacuauuaauagaaucaaaucauucaaacuuugugagaacucggcccaagguaaaaauugcgaaaucgacuccgcuccaguccagugcaggcagggauauuguuugaagauuucucaagagggccgggggcaugugaaacugagccgaggaucagaaaucguccucgaugugugcgacaccaguugugagauuaugauacccaagggcacaggugauauccugguugacugcuccgggggccagcagcacuuccuucagucuaaccugguggacuugggauguccuaauauuccacuccugggcaagauggcgaucuacaucugccgcaugagcaaccaucccaaaacuaccauggcauuuuuauucugguuuuccuucggguauguaauuacauguauacugugcaagacgcuauuuuacauccucauuaucauuggaacccuggguaaaaagcucaaacaauacagagaguugaagccgcagacuuguacaaucugcgaaucagucccugugaaugccauagaugcugagaugcacgaccugaacuguagcuauaacaucugcccauacugcgccaguaggcucaccucugaaggccugacucggcacguuaaucagugucccaagcgcaaagagaagguggaggaaacagaguuauaucugaaccuugaaaggauuccuuggaucgucagaaaauugcuccagguguccgagagcaccgggguagcacugaagcguucgucauggaugauugugcuacugauccuccugauaguuucuaugagucccguccaauccgccccaauuagccaggaacggacgguggcucuuuaccagucucgagaggauuauaugggaaucugcuuggugauuaugggcagcguccuguuagccguuucccuccuggugagaggucuuaucgacucaauaaguagcacuuucuuuccugggcugucuguguguaggaccugccauaucggcuccauuaauggauucgagaucgaaucacacaaauguuacugcggcuugcucuguugccccuauugucgcgcaugcaguacagaucaggacgcgcaucaauuucaccugagcguauguaagaaacggaaggcuggguccaacgucaugcuagccgugugcaagagaaugugcuucaaagcaauuaucgaggccucuaauaagguucuguuuauaaggaacgugauuaauaccacuuucgucguguguauccucguuaugguggcuugcaucgccucgagcgcagcuguagaaauggagaaccugccagccggaacaugggaacgcgaggaggaacuuaccaauuuuugucaccaggagugccaggucacagaaacugaguguuugugcccguacgaaucauucauucugcgaaaaccuuuauuccucgauuccaucgcgaagggcgugaaaaaccugcuuaauaguaccucucuggagacgagccuauccauugaggcccccuggggugcuauaaacgcacaaucaacauacaagccaaccgccucuagcgcuaauaucgcccucacuuggaguuccguggaacaucgggggaacaagauucuggucagcggacguucugagucaaucaugaaauuggaagagagaaccggcauuuccuggaaucuggguguugaggacgcaagugaaagcaggacauuaacuaucucggugauggaucucucucagauguauucccccguauuugaguaccugagcggcgaccgccagguggaagaguggccuaaggcgaccuguacggggaacugcccagaacgguguggaugcacaucaaguaccugucuuuauaaagaguggccccacucuagaaacuggaggugcaauccuacuuggugcuggggcgucgggacaggauguaccugcuguggccuggaugugaaggaguuguucacugaccauaugcucguuaaauggaagguggaauacauaaagacagaggccaucgucugcguggaacugaccucccaggagcgacaauguagccuaauugaagcugguacgcgcuuuucacuggggccgguuacuaucacccuuagugagccacggaacauucagcagaaacuucccccugagcugaucacauugcacccaaagauagaagauggauauuucgaccugaugcaugugcagaaagucaugagcgccuccaccguaugcaaguuacaaucuuguacacacggcgugcccggugaccuccagauuuaccacguuggcaaucugcuuaaaggggauagagugaacggacaucugauccacaaggucgagccucauuugaauacuagcuggauguccugggacggcugcgaucucgacuauuuuuguaacaugggggauuggccgucaugcaccuacacgggagugacacagcacaaucaugcagcuuucgccaaccugcuaaauaucgaaacugacuacaccaagacauuucacuuccacucuaaaaggguaaccgcacauggcgauacuccccagcuggaccuuaaggcccguccacgcuauggugcuggggagauuaccgugcucgucgaaguugcggauauggagcugcacacgaaaaagguggaggugacaggauugaaauuugccaguuuaacuuguucgggcugcuacgcaugcagcuccgguauaucuuguaagguccggauccauguggacgaaccugaugagcugaccguucacguaaaaucaagcgaccccgauauuguggcugccuccaguucucucauggccagaaagaucgaguucggcgucgacagcacauuuaaggcuuucucauccaugccaaaagacagucugugcuuuuauauuguggaaagggauuacuguaacagcugcaagaaugaggaaacccaacgauguguuaacgcaaaacuugagcagccucagucuauccugauagaacacacugggacaaucauuggaaagcagaaugauaccugcggcucccggacgucauguugguuggacagcuucaaaucguucuuuuaugggcuaaagucuaugcugaguggaaucuucggcaacguguuucucgguauuuuccuguuucuugcccccuucgcguuacugcucuuuuucuuuuucuuuggguggcgcaucuuguucugcuucaaguguugcagaaggacucggggacuguuuaaauaccgacauauaaaggacgaugaggaagucggcuauaaaaagauuaucgagagacucaauaacaaaaagggcaagcaccgccugcuugacggggagaggcuggcugaucguaaaaucgccgaauuguucuccacaaagacccauauuggauga

SEQ ID NO: 10268 - RNA, 5085 nt, Artificial Sequence
  derived and/or modified CDS sequence (opt3) from CCHFV(UCCR4413)__KY484038.1__GP
augcugagauacauccucuaugcccuucuggcuagcgcaauuuugcaccagcauuuauacaaggugggcgccgacacccaaaaacccacagucaggacuaacacgacccacaagauauccccuacagcgacugcuaaucggaccacauaugagcaggccaccccaucuacuacaccgaaaucaaguaccaagcccacgacucauaucgcaaccgcccaccuggcugagagcgauggguccggagagacaacucuacuccugccuaccacagcaucucaguacaccacggaaggucagacuucgcuugagccaacagccgaagagaccggcucaaacacuauucccagcgacacaaccaguacguccccuaucaccgaaaauucugaaagcacagauacucaaaugaacguuuccgacucaaguagcucuccacuggcuacccagggggcccgcucccccgcgcgaaauuugcucucagugccuagcguagagccaggacagcagacaacuccgaaacaacccaccacaaagggcaccgugacuccuacgacaccacagcccaccaccaguucuccuacuccagcacccacauccgccacccugagcacuaacucgucuuccauuucaacaccgguccagacgaguagcccucugcagcccauggcuccaucccaugaaacccaacacgcccucuauacuacaucuaccgagagcacauuacguacucugucagcagagagaauccacccuaccaauaggagucggcgcaacuccgaaguggagauaauccuuacguugccccagggucugaagaaauacuauagcagacuacucaagcugcuucaucugaccauggaagaggauacagaaggguugcaggaguggugcguuagggugcucggacaaacuugugacgauucuuacuuccacaaacggcuggcugaguuuuucauuaccggcacaggcuuuuucaaugaagucuuacuguuucgcucaccaaguacucccaccacgaucaagccuagcccaacaggguccccgaccguggagcccuuccgaucuuacuaugccaaaggaucgcucacuauugacagcgguuacuuuuccgcgaagugcuauccuagaacaucaaacaguggccuucagcugaucaauuugacccagcauucuguagaaauagccaacacuccagggcccaagcacagcucccuaaaaaccauuaauuguaucaacauuaaggcaucaacagauaaagagcacaaugaaguugagaucaacgugcugcucccucaggucgcuaucaaccugagcaauugccaugugucuauuaggucccacgugugugacuacagucuugauacggacggaaagauacggcugccacaaaucagccaugagggcaccuucauucccgguacuuauaaaaucauaauugauaagaaaaacaaguugaaugaccguugcucucucaucacauccugugucaucaaggggcgcgaacugagaaaaggacagucaaccuuaaggcaguacaagacagagauuaaaaucggccagaccaguagcggcucgcggcgacugcuauccgaaucuagcgccucagggugcauuagucgcacucaaaugauaaaguccgagacggcugaaauccacgacgauauuuauggagguccgggcgagaaacucacaaucuguaacgggaccacuguuguggaccagagacugggaucugagcuuggcugcuacaccaucaauaggauuaagacauacaaguugugugaaaacagcguaaaagagaagacuugcgaaauagauuccgugccugucaaaugccggcagggucugugucucaagaucacccaggaggggcgcggccaugugaaacugucaagaggaagcgagauuguucuugacaucugcgauaguucuugugaacugaugauuccaaagggcacaggggacaucuugguggauugcuccggaggucaacagcacuuucuccaggacaaucuggucgauuuaggcugucccaacauaccucugcuagggaagguggccaucuauauuugcaggaugagcaaucaccccaaaacgaccauggcauuccucuuuugguucucguuuggauacguaaucacuuguauucugugcaagauccuuuucuauuugcugauaauuacaggcacccucgguaaaaagcugaaacaguaccgugaguuaaagccacaaacuuguacaaucugcgaaucaaccccuguuaacgccauugacgcugagaugcaugaucugaauuguucuuauaacaucugccccuacugcgcgagucggcuuacguccgacggguugauacgacacgugaaucucuguccaaagagaaaagaaaaggucgaggagacugaacuguaucuaaaccuggagaggaucccgugguucgugcgcaaacuccugcaggucagcgaaucuaccggcguggcacuuaagcggagcuccugguugcugauuuuaguuauccuccugacagugucaaugaguccuguacagagcgcccccauuaaucaacagagagcugucgaggccuaccaggcaagggaaggauacaccggcaucugccuuuuuauacuggggucuguguuguucaugacuuccuggcucacaaaaggacugauugacucaaucggugauagcuuuuucccaggccuauuuguuuguaagaccugcagcaucggguccauuaacggauucgagaucgagucucaucgcuguuauugcucgcugcucuguugccccuacugucgaacaugcagcgccgacaaagauucacaccagcugcaccuuuccauuuguaagaagaaaaaggcuggcaguaacgugauguuggccgucugcaaacggaugugcuuuaaggcaacuauagaagcgucuaaucgugugcuguuaaucagaagcauuaucaacaccacguucauuaucuguaugcucauacugguagugugcguuaucuccacaucagcugucgagauggaagaccuuccugccgguaccugggagagggaagaggaucugacuaauuuuugucaucaagagugccaggugaccgaaacagagugucuaugcccauaugaagcauucgugcuccgcaaaccccuguuuuugucuagcauugucaaggggaagaaaaaccuguuaaauagugccucccucgagacuagccugucuaucgaggcuccuuggggcgccauuaacgcacagucaaccuucaagccgacgaucuccacagcuaauauagcccuuaguuggagcucgguugaacaccggggaaacaaagugcuggugucuggcagauccgagagcauuaugaaguuggaagagaggaccgggaucucauggaaucucggaguagaagacgcgagugagucucgaaugcugacugucuccgugauggaucuaagccagauguaccugccaguuuuugaguaucuuucaggcgaccgccaaguggaagaguggcccaaagccacauguaccggugauugcccugaacggugugggugcacaaguagcacuugucuccauaaggaguggccacacuccagaaacuggaggugcaaucccaccuggugcuggggagucggcacggguuguacuugcuguggccuggacgugaaggauuuguucaccgacuacauguucguuaaauggaagguggaauauaucaaaacagaggcuauuguaugcgucgagcugaccucucaggaacgucaguguagcuuaauagaggcagggacacgcuuuaaccucggaccugugacuaucacccuguccgaaccgcggaauauucagcaaaagcugcccucagagaucgugacgcugcauccaaaaauugaagagggcuucuuugauuugaugcacguccagaagguucucucugccaguacagugugcaagcugcagucguguacucacgggguagcuggagaccuacaaguguaccaugucggcaaccugcuuaaaggugacaagaucaaugggcacagcauacauaaaaucgagccucaccucaacaccuccuggaugucuugggauggaugcgaccuggauuacuauuguaacaugggcgacuggcccucaugcacauacaccggugugacucagcauaaucacgccgcauucguuaacuuguuaaauauugaaaccgauuauacaaagagcuuucacuuccauuccaaaagagugacggcgcacggcgacacuccacagcuggaucucaaggccaggccuauguacggggcuggagagaucaccguccugguggaaguugccgacauggagcuucauaguaaaaacauugagaucucuggccugaaguuugcaaguuugacauguucagggugcuaugcuugcuccaguggaauaagcuguaaggugcgaauccacgucgaugaacccgacgagcuagccguacacgugaaaucugaugaccuggauguuguggcagccuccucaagccucauggcucggaagauugaguucggcaccgacucgacuuuuaaagcguucucuaguaugccaaaggagucccugugcuuuuacaucgucgaacgcgacuucuguaaaagcugcgccgcagaggauacacagaagugugugaaggcuaaacuugagcaaccgcagucaauuuuaaucgaacauaaggguaccauaauugggaaacagaaugacacgugcuccacuaagacaucuuguuggcuggagagcuuuaaaaguuucuucuauggacucaagaacauguuguccggcguauuugguagcgccaucaugggcauucuucucuuccuggccccuuuuauccuucugauauuguucuuuuucuuuggguggaggauucuauucugccugagauguugccggcgaaccagaggacucuuuaaguacaaacacaucaaggaugacgaagaggcuggcuacaaaaagaucauugaaaaauuaaauaacaagaaagggggaaccucuaagcugcuugauggcgagcgccuggcagacaggaagaucgccgaacucuucucaacuaaagcgcauauugguuga

SEQ ID NO: 10269 - RNA, 5076 nt, Artificial Sequence
  derived and/or modified CDS sequence (opt3) from CCHFV(SCT ex Afghanistan)__KC344856.1__GP
augcaccaugccuaccagaucauguauacccugcucgugugcgcuauucuuuguccccaaccuuggagccuggagggcacacacgucccauugaacgggacuaagcauaauggaacggguauaaccgcagccccgggcgggucccagggacccacaucuccugcgucaacugcuguuaguuuaaccccagaccccuucacaaccgaaccuacugccagcgcaguggagcuggaauccucuggcgagggucacacaucgcuaucaguaaccacgcaggggcucacuagcccagaaaccacacccggacugccuacugugaccgauacaggcgucaguuccaccucuaucuuuggcauugggaucagaguggccggagacacgccaacuagcacaacccauacuggucuuccguccucacccaguaugccuagcacagcucagggcccacaccacgcaguuagggggcuguugucuguguccucaacccggcccggagaggccagcacgauuaccgucccuggcgaggcugguacagaagccaacaguucuuccagcgcgaucucgaaaaagccagcacccucuccgacugccgaggcuauaaccgaagccaauaacuccucaaauccucgccaacccgagcucaguacacagccagcaaucccugggcuggugacuagcuccgcucagcccauucugcuccagucugccaccagcacagcggcccaagauaucuacccaucacccaccaaccgaaguaaacguaauuuagagauggaaauuauccugacucuuucccagggauugaagaaauauuacggcaagauacugagaauccuagaccucacgcuggaggaagauacagagggccuucuggaauggugcaagaggaacuuggggcucaccuguaaugacaacuucuuucaggagcggauugaggaguucuuucugacuggagagggucauuucaaugaaguauuacaguuuaaaaccccuagcacacugucuccaaccgagccgacucacacacgcacgcccaccguuaagccuuucaaaucauauuuugcaagaggcuuccucaguauugauagcggguacuuuuccgcuaagugcuauucuaaaacuucgaacagcggacuucaacugaucaauaucacacagcauccagccaggauugcugacacccccggcccuaagauaacaaacuugaaggccaucaauuguauuaaccuaaaagcauccguguucaaggaacaccgggagaucgagauaaacguccugcucccacagguggccgugaaucugucaaacugccacguccuuauuaaaagucauguuugugauuacucucuggacaucgauggugcugugcgcuugccccacguacaucacaaggggacuuuuaucccgggcaccuacaaaauugugaucgacaagcgaaauaaacaaaacgauagaugcacgcucgucaccaauugugugauuaagggaaaggaaauaaggaaaggccagagcgcgcugcggcaguaucguacagagauccgcauugggaaggcauccgccggaucaagaagguuacugagcgaagagucuggugacgacugcaucucccggacucagcuacuccgaaccgaaacagcugagguucauaacgauaauuacggcgggccuggagacaaaaucacuauuuguaacggcaguaccauaguggaucaacgccuggguagcgagcuugggugcuauacgaucaauagagucaagucuuucaaauugugcgaaaacuccgccacaggcaagucauguaagauugacaguaccccagugaaaugcaggcagggauucugucugaagaucacucaggagggccgggggcacguaaaacucagccgcggaucggaaguugugcuggaugcaugcgacuccucuugugagauuaugauccccaaggguacaggcgauauacuugucgacugcagcgggggacagcaacacuuucugaaagauaauuugaucgaccucggcuguccuaacauuccccuguuagguaagauggccaucuacauuugcagaaugucaaaucauccaaagaccacuauggcuuuccuguuuugguucaguuuuggguaugugaucaccuguauauucugcaaagucaucuuuuaccuacucauugugguuggcacacugggaaagaaauucaagcaguauagggagcuuaaaccucagacguguaccauuugcgaaacuacacccaccaacgccaucgaugcagagaugcacgacuugaauugcuccuacaacauauguccauacugcgcgucucgucugacaagcgacggccucgcucggcaugugacucaguguccgaagcgaaaggaaaaaguagaggaaaccgagcuguauuuaaaccuggagagaaucccuuggauugucaggaaacuuuugcaaguguccgaaucaacggggguugcccucaaacgcagcaguuggcugaucgugcuacugguccuccugacagugucucuuucccccguacagagcgcaccaauuggacacggcaagaccaucgagacuuaccagacccgggaagguuauauaucggugugcuuguuuguucuugggggaauuuuauucgucgugucaugucucaucaaaggccugguggauucugucgguaauagcuuuuuccccggccuuuccaucugcaagacauguagcauugggucuguuaacggauuugagaucgaaagccacaaaugcuacuguucccuguugugcuguccuuauugcagacauugcucaacugacagggagauucaccagcuccaucugaguauauguaagaagcgccgaaccggcgggaaugugaugcuagccgugugcaaacggauguguuuccgugcuacaauggagguaagcaacaagguccuguucaucagaaauauuaucaacacgaccuuugugauuugcauccucauacuggccguuuguguggucucuacuuccgcaguggaaauggagucacuuccagcuggaacaugggaaagggaggaagauuugaccaauuucugccaccaagagugucagguuacugagacagaaugccugugucccuacgaggccuuagugcuccgcaaaccucuguuucuuaacaguaucguaaagggcaugaaaaaucugcuaaacagcaccaaucucgaaacgucccugucuauugaggcgccguggggugccaucaacguccagucgacuuucaagccaaccgugagcacagcuaauauugcauugucaugguccaguguggagcaucgggggaacaagauccuggucucuggaagaagcgaauccauaaugaaauuagaggaaaggaccggcauuucaugggaccucgguguugaggaugccucugaaagcaagagucugacuguguccguaauggaccuuagccaaauguauucucccguguuugaguaccugucaggcgaucgacaggucgaggaauggccuaaagcuacaugcaccggggacuguccagagcgcugcggaugcacauccaguacuuguuugcacaaggaauggccccacagccggaauuggagaugcaacccuaccugguguuggggcguggggacgggaugcacauguugcggccucgauguuaaagaccuguucaccgauuacauguuugugaaguggaaggucgaguauaucaaaacugaagccaucguguguguugagcuaaccucgcaggagaggcagugcucucugauugaagcagguacacguuucaaccuugggccggugacuauaacccucuccgagccccgcaauauccaacagaagcugccaccugaaauuaucacguugcauccccggauugaggaaggauuuuucgaccugaugcacguccagaaaguauuaagcgcgucaacaguguguaagcuccagaguugcacccauggcguuccaggugaucugcaaguguaccacaucggcaaccuucugaaaggggacaaguugaauggacauaugauacacaagaucgagccucacuuuaacacuucuuggauguccugggacggcugugaucucgacuauuacugcaauaugggggauuggcccagcugcacauauaccggagucacucagcauaaccacgccgcuuucgugaaucugcuaaacauugagacagacuacaccaaaaauuuucauuuccacucaaagagaguaacggcccacggcgauacuccacagcuggaccuuaaagcaaggccgaccuauggugcuggggaaaucacagugcucgucgagguugccgauauggaacugcauaccaagaaaauugacaucaguggauugaaguucgcaaguuuaacaugugccggcugcuacgcuuguuccucuggcauaagcugcaaagugcggauucacguggaugagccugacgagcugacuguccaugugaaguccgaagaucccgacaucguugcggccucaaccucucucaucgcacgaaagcuggagcuugggacggauaguacauuuaaggcuuucucggccaugccaaagacuagccuguguuuuuacauuguagaacgcgaguauugcaaauccuguucuaaggaagacacccagaaaugcgugaacacaaaguuggagcacccccaaggaauccuaauagagcauaaggguaccauuaucggcaaacagaaugacacuuguaccgccaaggcugggugcuggcuggaaucagucaagagcuucuuuuacggacucaaaaacaugcuguccggcauuuucgguaauguguuuaucgggauauuccuguuuuuagcaccuuucguucugcucauuuuguuuuucauguucggauggagacugcucuuuuguuucaaaugcugcaggcggacacgaggccuguuuaaguauagacaccuuaaggaggaugaagagaguggcuaccgcaggaucaucgaacgucugaacaauaaaaaggggaaaaacaaguugcuagacggagagcggcuggccgauagaaggauugcggaacucuucucuacgaaaacucacaucgguuga

SEQ ID NO: 10270 - RNA, 5070 nt, Artificial Sequence
  derived and/or modified CDS sequence (opt3) from CCHFV(SPU 431/85)__KJ682812.1__GP
augcccgugaacaucauguacaccccucuggucugcgccguuauuugucuccagcuuuggaaucugggcgggacauuggugagcacuaacagaacgcaacacaaugagaccggaacaguagcuacuccagaagguaccuuaaggccgcggcugcccguguccacagcacuaccuaccaagucugaccgcccaucagucggccccgccgcgaguagcuccgggcucgagggaucuggcgaaccuaacacuucgccaucaauaacaaccaaaggucugacgcccccugagacuaccccagcccuuccgacagccacugauaccgacgcaagcaguacaggggugguugauguguccacccagaugacgaaggacauccccaugucuacugccuauacaaauccuccaagcacccccuccgcuccuucaacuccacagggaacacaucacaccgcacgaggccuguugagugucgccagcacgaaaucugaagagguguccaugucaaccagccccgcuaagacaaguacugagaccucuuccccgccucccgccacaagcgaaacuccaaccccuucgcccacaacccagguaccaacuggcaacaauaaccccaauacgucucgucaaccuacaccauccgcgcagccggcaaugucaaaccccgccaccaguccugcucagccaaaucucagccaguccgcucccccuacugcagaucaagggguucauccaucucccaccaacagaagcaaaaggaaucuggagauugaaaucauucugacacucucacagggauuacggaaguacuaugguaagauccugaaacuuuuggaccugacccuagaggaggauacugaaggccuccuggaguggugcaagcgcaaccuugggcugacaugugacgauaauuucuuucagaaaagaauagaagaguucuuuuugacgggagaaggcuacuucaacgaggugcuccaguuuaaggucccgaguacccuguccagcacugagccuacacacaccaggccacccacaguggaaccuuucaaaucuuauuuugcuaaggguuucuuaucaaugaacaguggguacuuuagcgccaagugcuauccccggacuuccaauucuggacugcaacucaucaacgugaccaaacauucggcgaagauugccgacacgccaggcccuaaaaucaccaaucuuaagacaauuaacuguaucaaucugcgcgcaagcgucuucaaagagcaccgagaaguugagauaaacguguugcuaccccagguagcugugaaucuguccaacugccacgcccagauuaagucacaugucugugauuacagucucgcuacugacggcauggugagacugccacacauccaucacgaagggaccuuuauuccgggaacauacaaaaucguuaucgauaagaagaauaaacaaaacgacaggugcacucuugugaccaauugugucauuaagggucgggaggugcguaaaggccagucugcccugcgccaguauaagacggagauaagaaucgggaaagcaagcuccggaucaaggcgguugcucagcgaagagucugacggcgauugcauuucccgaacacagcuguuacgcaccgaaacuacagagauccacagugacaacuacggugggccuggcgauaagauaaccauuuguaauggaagcacuaucguagaccaaagacugggcucugaacuagggugcuauaccaucaacaggguuaaguccuucaaacucugcgaaaauucagccacaggaaagaguugugagauugauagcacgcccgugaaaugccggcaggguuuuugucugaagaucacccaggaaggccgcgggcaugucaaacuuucgagaggauccgagauuguguuggacgcuugcgauucuaacugugaaauaaugaucccaaagggcacuggugacauucuggucgauugcagcgggggccagcaacacuuccucaaggacaaccugaucgaucuuggaugucccaauaucccucuguugggcaaaauggcgauuuacauaugcaggaugucaaaccauccaaagacaaccauggcauuccucuuuugguucaguuuuggguaugugaucacauguauucugugcaaaguuaucuucuacuuacugauuguggccggaacuguagguaagaaauuuaagcaguaucgugagcuacggccccagaccuguacgaucugcgagacaauaccugucaaugcuaucgacgccgaaaugcacgaccucaacugcuccuacaauauuuguccguacugcgcaucucgacugaccagcgauggccuugccagacaugugaugcaguguccaaagaggaaagagaagguugaagagacugaauuguaucugaaccucgagcgcauccccugggugguccggaaacuguuacaaguguccgagucaaccgggguagcucugaagagaagcaguuggcuuacaguguugcucguucugcuaauugucucucuguccccugugcagagcgccccaaucggacacggcaaaacuauagaaaccuaccaggcaagggaggguuauacaucguucugccucuuuauucuggggucaauccuuuucguggucucuuguuugguuaagggccugauugacagugugggaaauuccuuuuuccccggcuuaagcaucugcaaaacguguucuauagggagcaucaacggauuugaaauugagucccacaagugcuacuguucacucuucugcuguccuuauugccgccauugcccggcggaucgagaaauccacaagcugcaucuuaguauuuguaaaaagcggaaaaccggcagcaaugugaugcuggcuguaugcaagcguauguguuuuagagccacuaucgaggucucuaacagggcauugcucauacgcaauauuaucaacacaaccuucgugguuugcauccugacucuagccgugugugucguguccacaucagcuguugagauggaaagucugcccgccgguaccugggagaaagaagaggaccucacgaauuucugccaccaggaaugucaagugacugagaccgagugccuguguccauacgaagcacuuguauugcggaagccucuguuuuuagauagcauugucaaggggaggaaaaaccuccuuaauuccacaucucuugagaccucgcugagcaucgaagcucccuggggagccauuaacgugcagucaacuuucaagccaacaguguccgcggccaacauagcucuaaguuggucuagcgucgagcacagaggcaauaaaauccucguuuccggucgaucagagucuauuaugaagcuggaggagcgcaccggcaucagcugggacuuggggguggaagaugcaagugaguccaaacuguuaacaguaagcgugauggaccucucucagauguauucaccugucuuugaauaccuguccggagaucggcaaguggaggaguggcccaaggccacuugcaccggcgacuguccagaaagaugcgggugcacgaguagcacaugucuucauaaggaguggccgcacucgaggaacuggcguugcaauccuaccugguguuggggaguuggcacugguugcaccuguugcgggcuggaugugaaagacuuguucacagauuacauguuugucaaguggaaaguggaauauauuaagacugaggcuaucguuuguguggaacucaccucucaggagcgccagugcucccugauagaggccggaacgcgguucaaccuaggccccgucacaaucacccugagcgaaccaagaaauauucagcaaaaacuucccccugagaucauuacucuccauccaaggaucgaagagggcuuuuucgaccugaugcacguacagcgaguguugucagcaaguacaguuuguaagcugcagucuugcacccauggugugcccggggacuuacaggucuaccacauaggaaaccuccugaagggcgauaaagugaaugggcaccuuauucauaagaucgaaccucacuuuaacacuuccuggaugagcugggacggaugugaucuggacuauuacugcaauaugggcgauuggccgucaugcacauauaccgguguaacgcaacauaaccacgcggccuucgugaauuugcucaacaucgagacugacuacaccaaaaauuuucauuuccacaguaagcgggucacagcucacggggauaccccacagcuggaccuaaaagcccgccccacauauggagcaggcgagguuacugugcugguggaagucgcugauauggagcuucauaccaagaaaauugaaauaagcggucucaaguuugccucccugacguguacaggcugcuacgcauguucuagcgggaucuccugcaaggugaaaauucacguugacgagccugaugaguugacuguacaugugaagucagaagaccccgauaucgucgccgcuggaucuaguuuaauggcgagaaaacuggaguucggcgccgacucgaccuucaaggcauuuagcgcuaugccaaaaacaucccucuguuucuacauuguggaaagggaguauugcaagucuuguucacgggaagacacccgaaagugcguuaacacuaaacuggauagaccucagagcauccuuauagagcacaaggggaccaucauuggaaaacagaauaacacauguacggccaaggccuccugcuggcuggagagugugaaaucuuucuuuuacggcuugaagaacaugcuaagcgguaucuuugggaaugucuucauuggaaucuuucuguucauagcucccuuugugcuccugauucuuuucuuuauguucggcuggcgcaucuuauucuguuuuaagugcugcaggcguacucggggccuguucaaauauagacaccucaaggacgaugaagagaccggguacaggaaaaucauugaacgcuugaacaauaagaaaggaaagaacaagcugcucgacggugagcgacuggcagauagaaaaaucgccgaacuguuuucaacaaagucccauauaggcuga

SEQ ID NO: 10271 - RNA, 5070 nt, Artificial Sequence
  derived and/or modified CDS sequence (opt3) from CCHFV(SPU 556/87)__KJ682811.1__GP
augaccgugaacacagucugcacuccccugguuugugccguguucugccuccagcuuuggaaucugggcgggacguugguaccuaccaacagaacacaacacaauaagacuggaaccauggcuacaccagaggguaccuuaggcccgaggcugcccgugagcacugcacuaccuacaaaauccgaccggccaucugucgggcccgccgcgccuucaaguggacucgaaggcagcggugagccaaacaccucccccucuaucacgacuaaggggcuggcucugccugaaaccacaccagccccgcccacugcaaccgauacagacgccucgucaaccggagugguuaaugugagcacgcagaugacuaaagauauuccuaugaguacagcuuacaccaacccacccuccacuccuucugcaccaagcacaccccagggcacccaucacacggcccgcggccuguuguccgucgcuucaaccaagagugaggaagugagcaugucuacauccccggggaaaacuucaaccgagacaagcaguccucccccagccacuucugagaccccugcgcccuccccaacaacccaggcacccacuggaaauaacaauccuaacacgagccgacaaccaacaccgucggcccagcccgcuaugucuaauccuaccacuuccccagcccagcccaaccuccugcagaaugcaccuccaaccgcugaccaagguguacaucccggcccgacaaaccguucaaagagaaaucuggaaauggagauaauccucaccuuaagucaggggcugaggaaguauuacggaaaaauucuuaaguuuuuggaucugacucuagaagaggacacagagggccuccuggaaugguguaaacggaaccuuggucugacgugcgaugacaacuucuuucagaagcgcaucgaggaguucuuuuugaccggggaaggauauuucaaugaaguucuccaguuuaaagugccuagcacucuguccucuacagagccaacccacacaggcagccccacugucgagccuuucaagucauacuuugccaagggcuucuuaaguaugaacuccggguauuuuagcgcgaaauguuaccccagaaccucuaauucaggacugcaacucauuaacgugacgaagcauagugccaaaaucgcagauaccccagguccuaagauaacaaaucuuaaaacuaucaacugcauuaaucugagggcuagcguguucaaggaacaccgggaggucgaaaucaacguuuugcuaccccagguggccguaaaucuguccaacugucacgcucagauuaaaucucaugugugcgacuauucgcucgccaccgauggcaugguccgccugccacgaauccaccaugaggggacauuuauaccgggaacuuacaagauugugaucgacaagaaaaauaagcaaaacgauagauguacccuuguuacgaauugcgugauuaaaggcagggaaguccggaagggucagagcgcacugcgucaguacaaaacagagauccgcaucgggaaggccuccucaggcaguagaagguugcucucugaggaaagcgacggagacuguauuucccggacccagcuguuacgaacugagacagcugaaauacacucagauaacuauggcgggccuggagacaagaucaccauuugcaaugguagcacuaucguggaucaacgccugggcucugagcuagggugcuacaccauaaacagaguaaaauccuucaagcucugugaaaacagugcgacaggaaaaagcugcgagauugacucuacgcccguuaaguguaggcagggcuucugccugaaaaucacccaggagggucgggggcacgugaaacuuucccgcggcucagaaaucgucuuggaugcaugugacaguagcugcgagauuaugaucccaaagggaacuggcgauauucugguggacuguagcgggggacagcaacauuuucucaaagauaaucugauagaccuugguugccccaacaucccucuguugggcagaauggccauuuauaucuguaggauguccaaucacccaaagacaaccauggcuuuccucuuuugguucucuuuuggguacgucaucacaugcauucuguguaaagugauauucuauuuacugaucguugccggaacugugggcaagaaauuuaagcaguaccgugaacuacggccccagaccugcacgauuugcgagacaaccccuguaaacgcaaucgaugccgagaugcaugaccucaauuguagcuauaacauuugcccguacugugcuucacgacugaccagugacggucuugccagacacgucaugcagugcccaaagaggaaagaaaagaucgaggaaacugaguuguaccugaaucucgaacgcauacccugggugguucggaaacuguuacaaguguccgagucuacaggggucgcacugaagagaagcuccuggcuuacuguguugcucguacugcuaaucgugucacugagcccuguucagagugcgccaauuggccauggaaaaaccaucgagacauaucaggcuagggaaggcuacacgucuuucugucucuuuauucugggguccauccuuuucauagucagcugcuuggugaagggacugauugauucggugggcaacucauuuuuccccgguuuaucuaucuguaaaaccugcaguauuggguccgucaauggauuugagaucgaaagccacaaguguuauugcucucucuucuguugcccuuacugccgccacuguagcgccgaccgagagauacauaagcugcaccuuuccaucugcaaaaagcggaaaacuggcucaaacguuaugagugcaguguguaagcguaugugcuucagagccacaauugaagugagcaauagggcucuguugauccgcucuauuaucaacaccacuuuugccguauguauacucacacuggcagucugcgugguuuccaccucagcuguggagauggagagucuaccggccgguacgugggaacgggaggaagaucugacuaauuucugucaucaggagugccaagucaccgaaacagagugucucugccccuaugaggcgcuggugcuuagaaaaccauuguuucuggacagcauuguuaagggcaagaaaaacuuacucaauuccaccucucuggaaacuucgcuuagcaucgaggccccuuggggagcuaucaacgugcagucaacauucaagcccaccguauccgcagccaacauugcucugaguuggucuagcgucgaacacagggggaauaaaauccuaguguccggccgaucagagucuauuaugaagcucgaggaacgcacagggauaagcugggaucugggaguggaggacgccagugaauccaaauugcugacugucagcguuauggauuuaucucagauguacucaccaguguuugaguaucucuccggcgaccggcaaguagaagaguggccuaaggcaaccuguacgggugauugccccgagagaugcggguguacaaguucgaccugccugcacaaggaauggccacauucgaggaacuggcguuguaauccgacuuggugcuggggagugggcaccgguuguacaugcuguggccuugacgucaaagaucuguucacugacuacauguuugugaaguggaaaguugaguacaucaagaccgaagcgauugugugcgucgaguugacgucucaggaacgccaguguucccucaucgaggccgggacacgguucaaccugggaccugugaccauuacucuaagcgagcccagaaauauccagcaaaaacugccacccgaaauaaucacacuucacccuaggauugaggaaggcuuuuucgaucucaugcauguucagaaggugcugucagcuaguaccgucugcaaguugcagucuuguacucacgggguaccaggagaccuucagguguaucauaucggcaacuuacucaaaggugacaagguuaaugggcaccugauucacaaaaucgagccccauuuuaacacauccuggaugagcugggauggaugcgaccuugauuacuauugcaauaugggcgacuggccuucauguaccuacacgggugugacucaacacaaccaugccgcauucgucaaucuguugaacauagaaaccgauuauacaaagaauuuucacuuccauaguaaacgagugaccgcucacggcgacacaccgcagcucgaucugaaggcccggccaacuuacggggcaggagagguaaccgugcuagucgagguugccgacauggaacugcacacgaaaaagauugagaucagcggccuuaaguucgcuucccucucuugcacaggguguuaugcgugcagcuccggaaucucauguaaagugcgcauucauguggaugaacccgacgagcugacuguccacgugaagucugaggauccugacauaguugccgcaggcaguucguugauggcuagaaaauuagaauuuggugccgauagcaccuucaaggccuuuuccgcuaugcccaaaacaucucugugcuucuacaucguagagagggaauacuguaagucaugcagccgggaggacacccagaagugugugaacacuaaacucgaacgaccacaguccauucugaucgagcauaaggggaccauuaucggaaaacaaaaugacacaugcacggcaaaggccaguuguuggcuugagucugucaagagcuuuuucuauggccugaagucaauguuguccggcauauuugggaacguguucaucggaauuuuucuauucaucgcgccuuuuguucugcucauucuguucuucauguuugguuggagaauccuuuucugcuuuaagugcugucgcaggacucguggcuuauucaaauaccggcaccugaaggaugacgaagagaccggguauagaaaaauaauugaaaggcucaacaauaagaaaggaaagaacaaguugcuggauggcgagcgccucgcugaccgaaaaaucgccgaacuguuuaguacaaagagccacaucgguuga

SEQ ID NO: 10272 - RNA, 5070 nt, Artificial Sequence
  derived and/or modified CDS sequence (opt3) from CCHFV(SPU 18/88)__KJ682810.1__GP
augcccuucaacaucauguacaccccucugcucugcgccauucuuugucugcaguuguggagcuuagagggcauauaugggcuguccaauaagacacaacacaacgacacuucuacgaucaaagugccagaagagucacagaagaccagucuaccggcuaauacagcaagccccauuacuuccgauccuucuucggccaccucaacagcgcucgcuagcggaccagaagguaguggcgacaccuccacuucucccagcgucacaacccaggggccuacgcugcuugagacuaccccagaaccccauacaacuaucgauauugacgaguccucaaccgccaucgcagauauaaguacacagaccguuaaagacaucccuacgccaacuacacacaccagccugccgucuacucccuccgccccuacaauuccacaagaggcucaucacaccgcaagaggauugcucucagugacgagcaccaagcccggcgaaacaaguacuccuaccucuccaggugaggccuccacagaagcuagcucgccccagccgacuaucucugagaccccuagcccacccccuacaacccaggcccccacugagauuaacaauccaaacacgucaaggcagcccaugccuaguacacaaccagcggcaccgaauagcguaacucccccugugcagccaaccuuuucccagucugaugucagcaccguggcccaggacauccaucccucaccuacaaaccggaguaaacgcaaucuggaaauggagauaauucugacccucucccaaggguuaaagaaguacuauggaaaaguucugaaacuuuuggaucugacucuagaagaggacacagaaggccuccuggaguggugcaaacgaaaccuuggccugacgugugaugacaauuucuuucagaagcguaucgaggaguucuuuuugaccggggagggacacuucaacgaagugcuccaguuuaaaacuccaagcacacugucucccaccgagccggcuagagucgaaucaccuacaguggagccauucaagaguuacuuugccaaggguuucuuaagcauggauuccggcuauuuuucugcaaaaugcuaccccaagucgagcaauuccgggcugcaacucauuaacguaacucagcacucaaucaggaucaccgacacgccuggacccaaaauuaccagucuuaagacaauaaauuguaucaaccugaaggcuuugguuuucaaggagcaucgggaaauugagaucaacgugcuacugccacaggucgccgugaaucucucuaacugccacgugcugauaaaaagccaugcgugugacuauucccuugauauugacggcccuguccgccugcccagaauccaccacgaagguacuuuuaucccagggaccuacaagauuguuaucgauaagaaaaauaagcagaacgacaggugcacauuggugacuaauuguguaauuaaaggacgggagauacgcaagggccaaucagugcuccgacaguacagaaccgaaaucaaaauuggcaaggccagcucuggguccaggcggcuguuaagugaggagagcaacgaugacugccugucucguacgcagcuacuccgcacagaaaaugcagagauccauuccgauaacuauggagguccgggcgacaagaucaccauuuguaaugggucaacuauagucgaucagagacugggaagugaacuuggcugcuacacaaucaacagggugaaauccuucaaguugugcgaaaauucggcuaccgguaaauccugugagauugacucuacuccuguucggugccgacaaggguucugucugaagaucacccaggaaggccgcggacacgugaaacucagcagaggcucagaggucgugcuggaugccugcgacaguuccugugaaauuaugauccccaaggggacaggagacauacuuguagauugcucugguggccagcagcauuuucugaaggacaacuugguugaucucggguguccaaauaucccccuguuaggaaaaauggcuauuuauaucugcaggaugagcaaccacccuaagacgaccaugggcuuccuguuuugguucuccuuugguuacgugauuacuuguauccuaugcaaagucauauucuaucuccugauuguggucgggacacuuggcaagaaauuuaagcaauaccgggaguugaagccacagaccuguacaaucugcgaaacuaaucccgugaacgccauugacgcagagaugcaugaucugaacugcucauauaauaucuguccuuacugcgccagccgccucaccagugacggacuggcuagacacguuaugcaguguccgaaaaggaaggagaaaauagaagagacggaauuauaccugaaccuugagcguaucccaugggugguacggaaguugcuccaggucucugaauccacaggcguggcgcugaaacgaagcucguggcuaguuauucugcucgugcugcuuaccgucucauugucucccgugcaaagugcaccuaucucccacggggagacuguagagguguaucagaccagagaaggauacacaagcauuugccuguucguuuuagguucuauccucuuucuggucagcugucuuaugaagggccugguggauuccgugggaaauucauucaguccaggguugagcauaugcaaaacuuguucuauuggcuccaucaacgguuuugagaucgaaucacauaagugcuauuguagucucuucugcugucccuacugcaggcacugcagcgccgacauugagauccauaagcugcaccuauccauuuguaaaaagcgcaaaaccgggucuaaugucaugcuggcuguuugcaagcggauguguuuuagagccacaguggaagugucgaacaaagcacuccugauaaggaauaucauuaacacgaccuucguagucugcauccuuauuuuggccguguguguugugagcacuucagcugucgagauggagaaucugccugccggcacaugggaaaaggaggaagauuuaaccaacuucugccaccaggagugucaagugacugagacagaaugccucuguccguaugaggcacugguucuucgcaagccccuguuucuagacuccaucgugaaaggaaagaaaaaucuccugaacaguaccucuuuggaaacgagccuguccauagaggcgccauggggcgcuaucaauguacagucaacuuucaagccuaccgucucugccgcaaacauugccuuaagcuggaguuccguggaacaucgagggaauaaaauccucgugagcggacggucugagucaauuaugaagcuggaggaacguacaggcaucuccugggaucuuggugucgaggacgcuagugaaagcaagcuguugaccguuucggugauggaucucucucagauguacucccccguauuugaguaucugagcggggacagacagguggaagaguggccaaaagccacuugcacaggagacuguccugagaggugcggcugcaccucaaguacaugucuacacaaggaauggccccauucucgcaacuggcggugcaacccaacuugguguuggggugucggcaccgggugcacguguugcggacuggaugugaaagaccuuuucacagauuacauguuuguuaaguggaaaguggacuacauaaagaccgaggcaauugucuguguggaacucacuucccaagagagacagugcagccugaucgaagcuggcaccagguucaauuuggggccgguuacaaucacucugucagagccucgaaacauucagcagaaguuacccccagagauagugacccuccacccccgcaucgaagagggauuuuucgaucugaugcauauucaaaaaguccuuagugccagcacgguauguaagcugcaguccugcacacacggcgugccuggugacuugcagaucuaucacauugggaaucuccugaaaggagauaagguuaacggccaucuaauccacaaaauagaaccacauuuuaauaccucuuggaugagcugggacgguugugaucuggacuacuauugcaacaugggcgauuggcccuccugcucauacacuggggugacacagcacaaucaugcggccuucgucaacaugcuuaauaucgagaccgacuauacuaagaacuuucacuuccacucuaaacgggugacagcucauggagauaccccucaacucgaccugaaggcaagaccgacguacggcgccggggagauuacuguauugguggaagucgcugacauggaguuacacaccaagaaaaucgaaauuaguggacugaaguuugccucgcucacauguaccggcugcuaugcauguagcuccgguaucucuugcaaaguuaggauacauguggaugagccagacgaacugacagugcacgucaagucagaggaucccgacauuguggcggccagcuccagucuuauggcucguaaacuggaguucgggacugauucuaccuucaaggccuuuagcgcaaugccuaagacgucauuguguuucuacaucguugaacgcgaguacugcaaauccuguaguaaggaagacacacagaaaugcguaaauacuaagcuagagcagccccaaagcauccugauugaacacaaaggaaccaucauaggcaagcagaacgauacauguaccgguaaggcuggcugcuggcucgagucuauuaaauccuuuuucuaugggcugaagaauaugcuuucaggaaucuuuggcaacguguucauugggaucuuuuuauuccuggccccauuuauaaugcucauuuuguucuuuauguucggauggcggauccuguucuguuuuaaaugcugcagaaggacucgaggccucuucaaguaccggcaucugaaagacgaugaggaaaucgguuaucgcaagauuaucgagagacuuaagaauaaaaaggggaaaaacaagcuguuggacggagaaaggcuagcagaucggaaaauugccgagcuguuuagcaccaagacacacauaggcuga

SEQ ID NO: 10273 - RNA, 5070 nt, Artificial Sequence
  derived and/or modified CDS sequence (opt3) from CCHFV(SPU 497/88)__KJ682808.1__GP
augcccuucaacaucauguacaccccucugcucugcgccauucuuugucugcaguuguggagcuuagagggcauauaugggcuguccaauaagacacaacacaacgacacuucuacgaucaaagugccagaagagucacagaagaccagucuaccggcuaauauugcaagccccacaacuuccgauccuccaucugccaccucgacagcgucagcuagcggacccgaagguaguggcgacaccuccacuucuccuagcgucacaacccaggggccaacgccccucgagaucacuccugaaccacauaccacaauugauaucgacaaauccucaacuucuauagccgauaucagcaccagaacaguuaaggacauuccgacccccacgacucacacaucucugccuuccaccccaucagcacccacuaucccucaggaggugcaucacacagccaggggacuucugagcguaaccaguacgaaaccagaggaagcuaguaccuugacaucccccggcgaggcaagcacugaagccucgucuccgcaaccuaccauuuccgagacacccucaccaccucccacuacccaggcuccaacagagaucaacaaucccaacaccagucggcagccuaugccaagcacucagccggccgcgcccaauuccgugacgccuccaguccaacccacauuuucucagagcgaugugucaaccgcagcccaggacauacauccuaguccaacuaaccgcuccaagcgaaaucucgaaauggagauuauccugacccugagccagggucucaagaaauacuaugggaagguuuuaaaacugcuugauuugacacuggaagaggacaccgaaggacuacucgaguggugcaagcguaaccugggccuuacuugugaugacaauuucuuucaaaagagaauugaggaguucuuucugacaggcgaagggcacuucaacgaaguguugcaguuuaagacgcccucuacccucucaccgacugagccugcuagggucgaaaguccaacaguggagcccuucaagagcuacuuugccaaaggauuccuguccauggauucugguuauuuuucggcaaagugcuacccuaaaagcuccaauucaggcuuacagcugaucaacguaacccaacaccucauccggauuacagacacucccgggccaaagauaaccaaucuuaaaacgaucaacuguauuaaccugaaggcuuugguuuucaaagagcaucgcgaaaucgagauaaaugugcuacugccucaggucgccgugaaccucaguaauugccacgugcugauuaagucucaugucugugacuauagccuugauaucgacggacccguuagacugccaaggauccaccacgaaggcaccuuuauuccggguacauacaagaucgugauugauaaaaagacuaaacagaacgaccggugcaccuugguaacaaauugugugauaaaggggcgcgagauccgaaaaggacaguccguccucagacaauacaggacugaaauuaagaucggcaaggcgucaagcggcucucggcgucuguuauccgaggagaguaacgaugacugccugagccgcacccagcuacucagaacggaaaaugccgagauccauucugauaacuaugggggaccuggugacaaaauuacaauauguaauggcuccaccaucguggaucagaggcuggggucagaacuuggaugcuacacuauuaaccggguuaagaguuucaaauugugcgagaauagcgcaacaggcaagucgugugagaucgacuccacccccgugcgaugccgccaggguuucugucugaaaauuacucaagaagggaagggccacgucaagcucucuagaggaagcgaggugguacuggaugcuugcgacucaaguugugaaaucaugauaccaaaaggcaccggggacauccuuguugauugcuccggaggucagcagcauuuucugaaggacaacuugguggaucucggcugucccaauauuccucuguuagggaaaauggccaucuauauuugcaggaugucuaaccacccaaagacaacgauggucuuccuguuuugguucagcuuuggauacgugaucaccuguauacuaugcaaagucauuuucuaucuccugaucgugguuggcacucuugguaagaaguuuaaacaguaccgggaguugaagccccaaacauguaccauuugcgaaacaaauccugugaacgcuaucgacgccgagaugcaugaucugaacugcuccuauaauauauguccguacugcgcaucacgccucacuagcgacgggcuggccagacacguaaugcaguguccaaaaaggaaggagaaaaucgaagagaccgaauuauaccugaaccuugagcguauucccugggucgugcggaaguugcuccagguuagugaaucuacgggcguggcucugaaacgauccagcuggcuagucauccugcucgugcugcuuacaguaucguugucaccugugcagucugcgccaauuagucacggagagaccguugaggucuaucaaacuagagaaggcuacaccuccaucugccuguucguguuagggggaauacucuuucuggugagcugucuuaugaagggucuggucgauucuguuggcaauagcuucuuucccggguuguccauuugcaagacauguucaaucggaaguaucaacggcuucgagauugaaagccauaaaugcuauuguucucucuuuugcuguccuuacugcaggcacugcuccgcagacaucgagauucauaagcugcaccuaucaauauguaaaaagcgcaaaacuuggaguaaugugaugcuggccgugugcaagcggauguguuucagagcuaccguagaagucagcaacaaggcccuccugaucaggaauauuaucaacacaacguucgugguuugcauucuuaucuuggcaauauguguggucuccaccucugccguggagauggagaaucugccggcugguacuugggaaaaagaggaagauuuaacaaacuuuugccaccaggagugucagguuaccgagacugaaugccucugucccuaugaggcccuggugcuucgcaagccacuguuccuagacucgaucguaaaagggaugcgaaaucuccugaacagcacaucauuggaaaccucccugaguauugaggcaccuuggggcgcgaucaauguccaaucuacguuuaagcccacugugagcgcugccaacauugcauuauccuggucaucuguggaacaucggggaaauaaaauccucgucagcggccguagugaguccauaaugaagcuggaggaaagaaccgggauuagcugggaucuuggaguugaggacgccucugaaucaaagcuguugacaguguccguaauggaucucagucagauguacagcccaguguucgaguaucugucgggcgacaggcaggucgaagaguggccuaaagcuaccugcacuggugacugucccgagcgcugcgggugcacaucuuccaccugucuacacaaggaauggccacauagccggaacuggagaugcaacccgacaugguguuggggagugggcacugguugcaccuguugcggccuggauguuaaagaccuuuuuacggauuacauguucgugaaguggaaagucgacuacaucaagacagaggccaucguguguguugaacucaccucacaggagaggcaaugcagucugauugaagcagggacucgauuuaauuugggaccugugaccauaacacugucugagccccgcaacauccagcagaaguuaccacccgagauugucacucuccacccucggaucgaagagggcuucuuugaucugaugcauauucagaaaguacuuuccgcuagcaccguguguaagcugcaaucaugcacgcacgggguuccaggagacuugcagaucuaucacauaggcaaucuccugaaaggugauaaggugaacgggcaucuaauccacaaaauugaaccccauuucaauacaaguuggaugagcugggacggaugugaucuggacuacuauugcaacaugggcgauuggccuuccugcucuuacaccggugucacucagcacaaucaugccgcguuugugaacaugcuuaauaucgagacagacuauaccaagaacuuccacuuucacagcaaaagaguaacugcccauggcgauacaccgcagcucgaccugaaggcuaggccaaccuacggggcaggagagauuacgguguuggucgaaguugccgacauggaguuacacacuaagaaaaucgaaauauccggccugaaguucgcuucacucaccuguacagggugcuaugccuguucuaguggaauuucgugcaaagugcguauccauguggaugagcccgacgaacugaccguccacguuaagagcgaggauccugacaucguggcagcguccucuucacuuauggcccgcaaacuggaguucggcacagauagcacuuuuaaggcuuucuccgccaugcccaagaccaguuuguguuuuuacauuguagaacgggaguacugcaaaucuuguagcaaggaagacacgcaaaaaugcgugaauacaaagcuagagcagccacagucaauccugauagaacacaaagguacuauuaucgggaagcaaaacgauaccuguacagcaagagcuuccugcuggcucgagaguauuaagagcuucuuuuauggacugaaaaauaugcuuucuggcaucuucgguaacgucuuuauaggcauuuucuuauuuuucgccccuuuuaucaugcugauccucuucuucauguuuggguggaggauuuuguucuguuuuaagugcugccgacggacccgcggacuguucaaauacagacaucucaaggacgaugaggaagugggcuauaggaaaaucauugagcggcugaauaacaagaaggggaaaaacaaacuucuggacggagaacgauuggcagauagaaaaauagccgagcuauuuuccacuaagacccacaucggcuga

SEQ ID NO: 10274 - RNA, 5070 nt, Artificial Sequence
  derived and/or modified CDS sequence (opt3) from CCHFV(SPU 130/89)__KJ682807.1__GP
augcccuucaacaucauguacaccccucugcucugcgccauucuuugucugcaguuguggagcuuagagggcauauaugggcuguccaauaagacacaacacaacgacaauucuacuacgaaagcuccagaagagucacauaagaccagucuaccggcaaacacagccagccccaucacuuccgauccuccaucuaccacaucgaccacuucagcgagcggacccgaagguaguggcgacacauccaccucuccuccagugacgacucaggggcccgcuagcccugagaccacaccagaaccgcacacuaccauugauaucgacaaauccucaacagccauugcagauaucaguacccagacggucaaggacauacccacuccuacaacccauacuagccucccaucuacacuguccgcccccaccaucccucaggaggcucaccauacggcaagaggacuucugucaguuaccaggcacaaaccaggcgaggccagcaagcccacaaguccgggugaagcuaguacugaggccuccagcucgcaaccuaccauuucugaaacacccuccccaccucccacuacccaggcgccaacagagaucaauaaccccaauaccucacggcagccuaugccaaguacucagccggcagcccccagcuccgugacgcacccugcucaaccaacacccucucagagcgauguaccuaccgccgcacaggacauucauccaucacccacuaaccgcaguaagcgaaauuuggagauggaaaucauacucacccugucccaggggcugaaaaaguacuauggaaaagugcucaaguuacuggaucuuacauuggaggaagacaccgagggccugcuagaauggugcaaacguaaccucggccugacuugugaugacaacuuuuuccaaaagagaauugaggaguuuuuccuuacaggggaaggacacuuuaaugagguccugcaguucaagacgccgagcaccuugucuccuacugaaccagcuaggguggagucacccacaguugaaccuuuuaaaaguuacuucgccaaggguuuucucagcauggauuccggcuauuucucugcgaaaugcuaccccaagucgagcaauuccgggcugcaguuaaucaacgugacccaacaucugauucggaucacagacacuccaggaccuaaaaucaccaaucucaagacgauuaacuguauaaaccuuaaagcccuggucuuuaaggagcaccgcgagaucgaaauuaauguguugcuaccccagguagcaguuaaccugucaaauugccacgugcucaucaagagucaugucugugacuauucucuggauauagacggcccagugagacuuccgagcauucaccaugaggguaccuucaucccugggacauacaaaaucgugauugauaagaaaaacaagcagaaugacaggugcacucuggucaccaacuguguuaucaaaggacgggaaauucgcaagggccaguccguguugcgacaauacagaacagagauaaagaucggcaaggcuucaagcgggucuaggcggcuccuguccgaggaacccaauuaugauugcuuaagucguacucagcugcuacgcaccgagaacgccgaaauucacagcgacaauuacggagguccaggcgauaagaucacgaucuguaacgggucuacaauuguagaccagagacucggauccgagcugggcugcuauaccauaaauagggugaaaucauuuaaacuuugcgaaaacagugcuacugguaaaagcugugagaucgauucgacacccguccggugccgacagggguucuguuugaagauuacccaagagggccgcggacaugugaagcuguccagaggcucugaaguugugcucgacgccugcgauagcucaugugagaucaugauuccuaaagggacuggagacauccuggucgacugcagugguggccagcagcacuuccuuaaggauaaucugguggacuugggguguccaaacauaccccuccugggaaaaauggcaaucuacauuugcaggauguccaaucacccuaagaccacaauggccuuuuuauucugguuuucuuucggcuauguaaucacguguauucugugcaaaguuaucuuuuaccuacucauaguggucgguacccuggggaagaaguucaaacaguaucgggaacuuaagccgcaaacuuguacaauuugcgagaccaacccagugaacgcuaucgaugcggaaaugcaugacuugaauugcagcuacaacauuugucccuacugcgcaucccgccugacaucagauggccucgccagacacgucaugcaguguccuaaaaggaaggagaaaaucgaggaaacugagcuguauuuaaaucuggaacguauaccaugggugguucggaaacuucuucaggugagcgagaguaccggaguagcucucaaacgaucuuccuggcuggucgugcuacugguucuccugacggugagccuuucgcccguccagucagccccuaucucucauggcgaaacaguggagguauaccaaaccagagagggguauacuucuauuugcuuguuugugcugggauccaucuuauuccucguuagcugucugaugaagggucuugucgacucugugggcaacagcuuuuucccggggcuguccauuugcaagaccuguucaaucggaaguauaaauggcuuugaaauugagagccacaaaugcuacuguucuuuguucugcugucccuauugcaggcacugcuccgcagauaucgaaauccauaagcuccaccugucaauuuguaaaaagcgcaaaacagguaguaacgugaugcuagccgucugcaagcggauguguuuuagagcuacuguugaggugagcaauaaggcccugcucaucaggaacauuauaaauaccacauucgugguaugcauccugauucuugcagucugugugguuuccacgucugcgguggaaauggagaacuugccagcugggaccugggagaaagaagaggaccugacuaauuucugccaucaggaaugucaggucacagagaccgagugcuuauguccuuacgaagcccucgugcugcgcaagccccuuucgcuggauagcaucguuaaaggcaugaagaaccuacucaauucaacuucccuggagacaaguuugucuauugaagcaccauggggagccaucaacgugcaaagcaccuuuaaaccuacgguauccgcugccaauauagcacugucauggucuagcgucgagcaccgaggcaacaagaucuuagugagugggcgguccgaaagcauuaugaagcucgaggagcguacuggaaucucuugggaccugggcguggaagaugcuucagaguccaaacuucugaccgucaguguuauggacuugagccagauguauucgcccguguucgaauaccucucuggugauagacagguagaggaauggccaaaggccacaugcaccggggacuguccggagaggugcggaugcacuuccagcacaugucugcauaaagaguggccucacucacgcaacuggcggugcaaucccaccugguguuggggcguggguacaggcugcacuuguugcgggcuagacgucaaggaucuguuuaccgacuacauguucgugaaauggaagguugauuauauuaagacggaagcgaucgugugugucgagcuuacaagucaggaaagacaaugcucucucauagaggccggaaccagguuuaaccugggcccagugacuauuaccuuguccgaaccccgaaauauccagcagaaacugccuccagagaucguuacauuacacccccgcauugaggaaggguucuuugaccucaugcauauacagaaggugcugagcgcuucaacugucuguaaacuucaaaguugcacccacggaguaccuggcgaucugcagaucuaccauauugguaacuugcucaagggggacaaagugaauggacaccugauccauaagauugagccgcacuucaacacgagcuggauguccugggauggcugugaccuagauuauuacugcaauaugggugacuggccaucuugcagcuauacaggcguuacccagcacaaccaugcagccuuugugaauaugcugaacaucgaaacugauuacacaaagaauuuccacuuucauuccaagcgggucaccgcucacggggacacuccccagcuugaucucaaggccagaccuacauauggagcaggcgagauaaccgugcugguagagguggcggacauggaauugcacacgaaaaaggucgagaucucaggguuaaaauucgccucucugacuuguaccggaugcuacgcuuguaguucgggcauuagcugcaagguuaggauccauguggacgaacccgaugagcucacagugcacgucaaauccgaagacccagauauuguggccgcaucuucaagccugauggcucguaaacuugaguuugguaccgacuccacauucaaggccuucagugcaaugccuaagacuucucuguguuuuuacaucguugagcgcgaacauugcaagagcuguucaaaagaggauacccaacggugcguaaacacgaaguuggaacagccccaguccauacuaauugagcacaaagggacaaucaucggaaagcaaaaugacacuuguaccgccaaggcuaguugcuggcuggaaagcauuaaaucuuucuuuuauggccucaagaacaugcuguccgguaucuucggcaauguguuuauaggggucuucuuguuuuuagcgccauucauuauccugauucucuuuuucauguuuggauggagaaucuuguucuguuucaaaugcugcaggcgaacacggggccugcucaaguaccgccaucugaaagaugacgaggagauaggguauagaaagauuaucgaaaggcuuaacaacaagaaaggaaagaauaaacuguuggauggcgagcggcuagccgaccgaaagaucgcagaacuguuuucaaccaaaacucacauugguuga

SEQ ID NO: 10275 - RNA, 5070 nt, Artificial Sequence
  derived and/or modified CDS sequence (opt3) from CCHFV(SPU 383/87)__KJ682806.1__GP
augcccuucaacaucauguacaccccucugcucugcgccauucuuugucugcaguuguggagcuuagagggcauauaugggcuguccaauagaacacaacacaacgacacuucuacgaucaaggugccagaagagucacagaaaaccagucuaccggcuaauacagcaagccccauuacuuccgauccuccaucuaccacaucgaccgccucagcgagcggacccgaagguaguggcgacacuuccacaucuccuccagucaccacgcaggggcccacuccuccagagaccacaccggaaccccauacuaccaucgauauugacaagagcuccacagcuaucgccgauauaucaacccagacgguuaaagacaucccuacuccaacaacccacaccagucuccccagcacacugucugcaccuaccauuccacaagaggcccaucacacggcuaggggacuucuguccaucaccucaacaaagcccggcgaggcaagcacuccgauuaguccuggugaagccucuaccgaggcuuccagcccccagccaacaaucucggaaacuccuucucccccacccaccgcccaggcgccuacagagauaaacuccccaaauaccucacggcagccgaugcccaguacucaaccugcagccccaaacagcgugacgcaucccgcucagccuacaccaucccagucugauguacccaccgccgcacaggacauucacccgaauccuaucaaccgcagcaaacgaaauuuggagauggaaauuauccucacucugucacaagggcugaagaaguacuauggaaaagugcucaaguuacuggaucuuaccuuggaggaagacacagagggccugcuagaaaguugcaaacguaaccucggccugaccugugaugacaacuuuuuccagaagagaaucgaggaguuuuuccuuacuggggaaggacacuuuaaugagguccugcaguucaaaacaccauccacguugagccccaccgaaccugcuaggguggagucucccacuguugaaccauuuaagucauacuucgccaaggguuuucucaguauggauagcggcuauuucuccgcgaaaugcuacucuaagucgagcaauuccgggcugcaauuaauuaacgugacacagcaucugauacggaucaccgacacaccuggacccaaaauuacuaaucucaagaccaucaacuguauaaaccuuaaagcccuggucuuuaaggagcaccgcgagauugaaaucaauguguugcuaccacagguagcaguuaaccugucaaauugccaugugcucaucaaaagucacgucugugacuauucucuggauauugacggcccggugagacuuccuaggauccaccaugaggguacguucauucccgggaccuacaagauagugaucgauaagaacaauaaacagaacgaccggugcacacuggucacuaauuguguuauuaagggacgcgaaauccgaaaaggccaaagcguguugagacaguacaggaccgagaucaagauuggcaaggcuuccucagggagccggcgucuccugucugaagaguccaacgaugacugcuuaagucgcacacagcugcuaagaacugagaaugccgaaauacacagcgauaacuauggagguccaggcgacaagaucaccauuuguaaugggucuacgaucguagaucagaggcucggauccgagcugggcugcuacacaauuaaccgggugaagucauuuaaacuuugcgaaaauagugcuaccgguaagagcugugagaucgacucgacucccguccgaugccgccaaggguucuguuugaaaauaacacaggagggcagaggacaugugaagcuguccaggggcucugaaguugugcucgaugccugcgacagcucaugugagaucaugauuccuaaagggaccggagacauccuggucgauugcagugguggccagcagcacuuccuuaaggacaaccugguggauuugggguguccaaauauuccccuccugggaaagauggcaaucuauauaugccggauguccaaccauccuaaaacuaccauggccuuuuuauucugguuuucuuucggcuacguaauuacauguauccugugcaagguuaucuuuuaucuacucguggucguggguacgcuggggaaaaaguucaaacaauaccgcgaacuuaagccgcagaccuguacuauuugcgagacaaacccagucaaugcuauagacgcggaaaugcacgauuugaacugcagcuauaauaucugucccuacugcgcauccagacugaccucagacggccucgccaggcacgugauucaguguccuaagcguaaagagaagaucgaggaaacagagcuguacuuaaaccuggaacggauuccauggguugugcgaaaacuuuugcagguaagcgagaguacuggagucgcucucaagagaucuuccuggcuggugauccuacugguucuccugaccgugagccuuucgcccguccaaucagccccuauaucucauggcgaaacgguggagguauaucagacaagggagggguacaccaguauuugcuuguuugugcugggauccaucuuauuccucguuagcugucugaugaaaggucuugucgauucugugggcaauagcuuuuucccggggcuguccaucugcaagacuuguucaauuggaaguaucaacggcuuugaaauugagagccacaaaugcuauuguucuuuguucugcugucccuacugccgccauugcuccgcagacauagaaauccaccggcuccaccugucaauuuguaagaagagaaaaaccgguaguaaugugaugcuagccgucugcaagaggauguguuuucgcgcuacaguugaggugagcaacaaagcccugcucauccgaaauauuaucaacacuaccuucgugguaugcauacugauccuugcagucugugugguuuccacaucugcgguggaaauggagaauuugccagcugggacgugggagaaggaagaggaucugaccaacuucugccaucaggaaugucaagucacugagacagagugcuuauguccuuaugaagcccucgugcugcggaaaccccuuuuucuggacucgauuguuaagggcaugaagaaucuacucaacagcaccucacuggagacuuccuugaguaucgaagcaccauggggagccauuaaugugcagucuacauucaaaccuaccguaagcgcugccaacaucgcacuguccuggucaucugucgagcaccguggcaacaagauauuagugagcgggagaagugaauccauuaugaaacucgaggagaggacgggaaucagcugggaucugggcguggaagacgcuucugagucaaaacuucugacugucuccguuauggauuugagucagauguacagccccguguuugaauaucucucgggugaccgccagguagaggaauggccaaaagcgaccugcacaggggacuguccggagcggugcggaugcaccucuuccacuugucugcauaaggaguggccucacagcagaaauuggaggugcaaccccacaugguguuggggcguggguaccggcugcacauguugcgggcuagaugucaaggaccuguucacugauuacauguuugugaaauggaagguugacuacaucaaaaccgaagccauugugugugucgagcuuacgucacaagaacgacagugcagucucauagaggccggaacacgcuucaaucugggcccagugaccaucacuuugucugaaccccggaacauucagcagaagcugccuccagagaucguuaccuuacaucccagaauugaggaaggguuuuucgaucucaugcacauccaaaaagugcuguccgcuagcacagucuguaaacuucagucaugcacucacggaguaccuggcgaccugcagauauaucauaucgguaauuugcucaagggggauaaagugaacggacaccugauucauaagaucgagccgcacuuuaauaccaguuggaugagcugggacggcugugaucuagacuacuauugcaacaugggugauuggccauccugcucuuacacgggcguuacacagcauaaucacgcagccuucgugaacaugcugaauauugaaaccgacuauacuaaaaacuuucacuuccauagcaagagggucacagcucacggggauacuccccaacuugaccucaaagcccguccuacuuacggagcaggcgagaucacagugcugguagagguggcggacauggaauugcauaccaagaaaauagagauuuccggguuaaaguuugccucacugacguguacuggaugcuaugcuuguucuaguggcaucucgugcaagguccgcauccacguugaugaacccgacgagcucaccgugcacgugaaaagcgaagauccagacauugucgccgcauccucuucacugauggcucggaaacuugaguucgguacagauagcaccuucaaggccuuuuccgcaaugccuaagacaagucuguguuucuacaucguggagagagaauacugcaaaucuuguagcaaggaggacacucagaagugcguuaauaccaaauuggaacagccccaaucaauacuaauugagcauaaggggacgaucuuuggaaaacagaacgauacauguacugccaaggcuuccugcuggcuggaaaguguaaagagcuucuuuuauggccucaagaauaugcugucugguauuuucggcaacguguuuaucggggucuucuuauuucuugcgccauucauaaugcugauucucuuuuucauguucggauggaggaucuuguuuuguuucaagugcugccgacggacccgcggccuguuuaaauacagacaccucaaggacgaugaggagaucggguauaggaaaauuaucgaacggcugaacaauaagaaaggaaagaacaaacuucuggacggcgagcgauuggccgauagaaagauugcagaacuauucuccacaaagacccauauagguuga

SEQ ID NO: 10276 - RNA, 5070 nt, Artificial Sequence
  derived and/or modified CDS sequence (opt3) from CCHFV(SPU 44/08)__KJ682805.1__GP
augcccuucaacaucauguacaccccucugcucugcgccauucuuugucugcaguuguggagcuuagagggcauauaugggcuguccaauaacacacaacacaaugacacuucuacgaucaaggugccagaagagucacagaaaaccagucuaccggcuaacacagcaagccccauuacuuccgauccuccacccaccacaccuaccgccucugcgucgggaccagaagguucaggcgacacuagcacaagucccccugucaccacgcaggggccaacuccgcccgagaccacaccugaaccacauacuaccaucgauauugacaaguccucuacagcuaucgccgauauaagcacccagacgguuaaaaauauccccacuccuacagcacacaccucccucccaucaacucugagugcccccacaaugccgcaagaggcucaucacaccgcaagaggacuucugagcgugacgucuaccaagccuggcgaggccuccacacccacuucaccaggugaagcuagcaccgaggccaguucuccucagcccacaauuagggaaacuccaagucccccuccaaccacacagaccccgacugagaucaacaaucccaacacgagccggcagccuaugccaucgacacaacccgcggcaccuucuuccguaacccauccagcccagcccacuccgucacagagugacgugccuaccgcugcccaggauauucacccaagccccacaaaucgcuccaaacgaaacuuggagauggaaaucauacucacccugucucaagggcugaagaaguacuauggaaaaguccucaaguuacuggaccuuacuuuggaggaagauacagagggccugcuagaauggugcaaacguaaucucggccugacgugugacgauaacuuuuuccagaagagaauugaggaguuuuuccuuaccggggaaggacacuuuaaugaggugcugcaguucaaaacuccuagcacauugucacccaccgaaccagcaaggguugagaguccuacaguggaacccuuuaaguccuacuucgcuaaggguuuucuccugauggacagcggcuauuucucugccaaaugcuacccaaagucaaguaacagcggguuacaacugaucaaugucacucagcaucucauucggaucaccgauacgccgggaccuaaaaucaccaaccuuaagacaauuaacuguauaaaucugaaagcguugguguuuaaggagcaccgcgagaucgaaauuaacguacuacugccccagguugccgugaaucucuccaacugccauguccugaucaaaucucacgugugugacuauucgauagacauugauggcccagugagacuucccaggauccaccaugaggguacuuucaucccugggaccuacaagauugucaucgacaagaaaaauaagcagaacgaucggugcacacugguuacuaauugugugauuaaaggacgcgaaauacgaaagggccaaagcguauugagacaguacaggaccgagaucaaaauuggcaaggcauccucagggagucggcgucuccugucugaagagagcaacgacgauugcuuaucccgcacgcagcugcuaagaacagagaaugcugaaauccacucagacaacuauggagguccaggcgauaagaucaccauuuguaaugggagcacuauaguggaccagaggcucggaucugagcugggcugcuacacaaucaaccgggucaaauccuuuaaguugugcgaaaauagugccaccgguaaaagcugugagauugauucuacucccgugcgaugccgccaaggguucuguuugaagaucacccaggagggcagaggacauguuaaacuguccaggggcucagaagugguccucgacgcuugcgauaguagcugugagauuaugaucccuaaggggacaggagacauacugguggacugcucggguggccagcagcacuuccuuaaggauaaccugguagacuugggguguccgaauaucccacuccugggaaaaauggccauuuauaucugccggauguccaaccaucccaagacgaccauggcauuuuuauucugguuuucuuucggcuacguuauuacuuguauccugugcaaagccauauuuuaucuacucauuguggucgguacacuggggaagaaauucaagcaauaccgcgaacuuaagccucagaccuguacaaucugcgagacuaacccagugaaugcuauugaugcggaaaugcacgacuugaacugcagcuauaauaucugucccuacugcgcaucaagacugaccagugauggccucgccaggcacgucaugcaguguccuaaacguaaggagaaaauagaggaaacggagcuguacuuaaaccuggaacggaucccgugggugguucgaaaacuucuucagguguccgagucuacaggaguagcucucaagagaagcuccuggcuggucauucuacuggugcuccugaccguuucacuuagccccgugcaaagugccccaaucucucauggcgaaacugucgagguguaucagaccagggagggguacacauccauuugcuuguuuguacugggaagcaucuuauuccucgugucgugucugaugcgcggucuuguugacucagucucuaauuccuuuuucccuggccuguccauaugcaagacuuguagcauugggucuaucaacggauuugaaaucgagagccacaaaugcuauuguuccuuguucugcugucccuacugccggcauugcucagcagauauugaaauccacaagcuccaccugaguauuuguaagaaaagaaagaccggcagcaaugugaugcuagccgugugcaaaaggauguguuuucgcgcuacagucgagguuucuaacaaggcccugcucauacgaaauaucauuaacacgaccuucguggugugcauccugauucuugcaguaugugucguguccacuucagcgguugaaauggagaauuugccagcugguacaugggagaaagaagaggaccugaccaacuucugccaucaggaaugucaagugacugagacagagugcuuauguccuuaugaagcccucguccugcggaagccccuuuuucuggauaguaucgugaaggggaugaaaaaucuacucaacagcaccucccuggagacgucuuugucgauagaagcaccauggggcgccaucaauguucagagcacuuucaagccgaccgugucagcugccaacauugcacuguccuggaguucuguagagcaccguggaaacaaaaucuuagucagcggcagauccgaaucaauuaugaagcucgaggagaggacagggaucucuugggaccugggaguggaagaugcuagcgagaguaaacuucugaccguguccgucauggacuugagccagauguacucuccuguuuuugaauaucucucaggcgaucgccagguggaggaauggcccaaggccacuugcacaggugacuguccagagcggugcgggugcaccuccaguacaugucugcauaaggaguggccccacagcagaaauuggaggugcaacccuacuugguguuggggaguaggcaccgguugcacguguugcggccuagacgugaaagaucuguucacagacuacauguuugucaaguggaaaguggauuacauaaagaccgaagcgauuguuuguguggagcuuacuucgcaagaacgacagugcucucucaucgaggccgggacccgcuucaaucugggaccagucacaaucacuuuguccgaaccccggaacauucagcagaaacugccuccggagauagugaccuuacauccaagaaucgaggaaggcuuuuucgaccucaugcacauucaaaagguucugagcgcuucaacgguguguaaacuucagaguugcacacacgggguccccggagaucugcagaucuaucauauuggcaauuugcucaagggugacaagguaaacgggcaccugauccauaaaauagagccucacuuuaauaccucuuggauguccugggauggaugugaccuagauuacuauugcaacaugggcgacuggcccagcugcucauacacuggugugacacagcauaaucacgcagccuucguuaacaugcugaauaucgaaaccgauuauacuaagaacuuucacuuccauaguaaaagggugacagcucacggcgacaccccacaacuugaucucaaggcccguccuacguacggggcaggagagauuacuguccugguggagguagcggacauggaauugcauaccaaaaagaucgagauuagcggcuuaaaguuugccucccugacauguaccgggugcuaugcuuguucuagcggaaucuccugcaaagugcgcauacacgucgacgaacccgaugagcucacaguucacgugaagucagaagacccagauauuguggccgcaucuaguucgcugauggcucggaaacuugaguucggcacugacagcaccuucaaggccuuuuccgcaaugccuaaaacgucucuguguuucuacaucgucgagagagaauacugcaagucauguagcaaggaggauacacagaaaugcgugaauacuaaguuggaacagccgcaauccauccuaauugagcauaaagguaccaucauagggaagcagaacgacacauguaccgccaaagcuaguugcuggcuggaaucuauuaagagcuuuuucuauggacucaagaauaugcugucaggcaucuuugguaacguuuucauuggcaucuuucuuuucuuagcgcccuuuauaaugcugauucucuucuuuauguucggguggaggaucuuguucuguuuuaaaugcugccgacggacucgcggacuguucaaguacagacaccucaaagaugacgaggagaucggcuauaggaagauuaucgaacggcugaacaauaaaaaggggaagaacaaacuucuggauggagagcgauuggccgacagaaagauugcagaacuauuuuccaccaaaacacauauaggcuga

SEQ ID NO: 10277 - RNA, 5070 nt, Artificial Sequence
  derived and/or modified CDS sequence (opt3) from CCHFV(Matin)__AF467769.2__GP
augagcuucaacaucauguacacccugcuccuuugcgccauucuguguucccaguuguggucuucagagggcauacacggguuaaguaaugaaacacaacauggaaacgcuagcacuaucaaggcacccgaggugucccagggucugggccuaccugucucuacggccccaccgauuaccucggacccaccuucaaucacaagcgcggcuaguguuuccgggccagaaggaucuggcgauacuaauaccucacccccugugacaacccagggucucacucugccagagacaacccuugaacuguugacgacuaccaacacaggggccuccucaacuguaauuguggacgucaguacccagacagugaaagauacccccguuagcacggcacacacuucuccuccaggaacaccguccgcccccaccacuccucaaggcacacaucacaccgcuagaggccuccugucagugacgagcaccaagagugaggaggcaucuacacagacuaaucccaaaaagaccuccauggaaacaaacagccccgggccugccacuucggagaccccaucucccuccccgacaacccaggcuccuacugaaaauaacaaucccaacacgccaaggcagccuacacccccaacccaacccgccacuccuucaccagucaccaguccggcgcugcucgcaagcucccagggagacacaucuaccgccgugcaggauguacaucccagcccuacuaaucggucaaaacgcaacuuagagauggagaucauacugacacuuagucaggguuugaagaaguauuacggcaaaauccugaagcuacucgaccugacgcuugaagaggauaccgaagggcuguuggaguggugcaaacgaaaucucggacugguuugugacgauuccuuuuuccaaaagcguauugaagaguuuuucuuaacuggcgagggucacuuuaacgaagugcugcaguucaaaacaccaagcacccucucucccacagagccugcuagagccgggucaccaacugucgaacccuuuaagaguuauuucgcaaggggacuucugagcauggacuccggcuacuuuucugcuaagugcuauccgcgggccucgaauagcggcuugcagcuaaucaacauuacccaacacuccgcgcgcaucacggauaccccugggccaaaaauaacaaaccugaagacuauuaauuguaucaaccucaaagccucaaccuucaaggagcauagagaaauugagaucaaugugcugcuuccccagguggcagucaaccugaguucuugccacguuuugaucaaaagccaugugugugacuacucccucgauauugacggaccuguaaggcugccccggauacaccacgaggguacauuuaucccaggcacuuauaagauugugaucgacaaaaagaauaagcagaacgaucgcugcaccauagucacgaauugugugauuaaagggcgagaaaucagaaagggacagucaguuuuaaggcaauacaaaacagagaucaagauuggcaaagcuagcucugguucccggcgucugcuaagugaagagagcggggacgauugcaucucucgcacccagcuccugagaacugaaacagccgagauucauuccgacucauacggcggaccuggcgauaagauaaccaucuguaacgggaguacuguggucgaccagaggcuuggaagcgaguuggguugcuauaccauuaaucgggugaagucguucaaacugugcgaaaacuccgcuacaggcaagucuugugagaucgauagcacgcccguaaaaugccgacagggguuuugucucaagaucacccaagaaggacgcggccacguuaaacugucaagagguagugaggugguccuugacgccugcgauuccucuugugagauuaugauaccaaaggggacuggcgacauccugguggauugcagcggaggccagcagcauuucuugaaggacaaucucauugaccugggguguccgaacaucccuuuacugggaaaaauggcaauuuacaucugcaggauguccaaucaccccaagacaaccauggucuuccuauuuugguucucauuugguuaugugauaacauguauccucugcaaaguuauuuucuaccugcuuaucgugguaggcacuuuggggaagaaauuuaagcaguaucgggaacugaagccacaaaccuguacgauuugcgagacaacccccgucaacgccaucgaugcugaaaugcaugaccucaauugcagcuacaacauauguccuuauugcgcgagucgccugacuucugauggauuagcaagacacgugaugcaguguccaaaaaggaaggagaaaauugaagagaccgagcuguaccuuaacuuggaacguauccccuggguugugcggaagcuccugcaggucuccgagagcacaggcguggcccuaaaacgaucgucauggcugguagugcuccugguucuuuugacugucucucugaguccugugcaguccgcuccgauuggucacgggaagaccguggaaacauaccaaaucagagagggcuauacgagcgucugcuuauucguucucggaucuauacuguuuaucgugagcugucuuaugaaaggccugguggacuccgaugggaauagcuucuuuccaggauugaguauuugcaagaccuguagcaucggcucuauuaacgguuucgaaaucgagucccauaagugcuacuguucacucuuuugcugucccuauugcaggcacugcaguacugaccgcgagauacauaaacugcaccuaagcauuuguaagaaacggaagacaggguccaauguaaugcuggccgucugcaaaagaauguguuucagggcaaccguggaaguuucuaacaaggcccuccugauccgcucgaucauuaauacuacauuuguggucugcauccuuauuuuggcuguguguguugugagcaccucagccguagagauggaaucccugccugcaggaacgugggagcgagaagaggauuuaauaaacuucugccaccaggagugucaggucacugaaaccgagugccucuguccauacgaagcgcuggugcuucggaagccccuguuccuagacaguaucauuaaaggcaugaagaaucuccugaacucuaccagcuuggagacaucccugucaaucgaggcuccuuggggugccauuaaugugcaaucuacuuuuaaaccgacaaugagcgcagccaacaucgcuuuaaguugguccagcgucgaacaucguggcaauaagauacucguuucugggagaucagaguccaucaugaaacuggaagagaggaccggaauuaguugggaucuuggcguggaagacgccagcgagucgaagcuguugacaguaucugugauggaucucucccagauguauagccccgucuucgaguaccugucaggggaccgccagguggaagaguggccaaaggcaacuugcaccggagauuguccugaacggugcggcugcacgaguucuacaugucuacacaaagaguggccccauuccagaaacuggaggugcaauccaaccugguguugggguguugggacuggaugcaccuguugcggccuggacgugaaggaccuuuuuacagauuauauguucgucaaauggaagguggaauacaucaaaacugagguuauugugugugucgagcucaccagccaggaacgacaaugcucacugaucgaggcugguacgcgcuuuaacuugggcccuguaacaauaacccugagugaaccccggaauauucagcagaaguuaccaccggagaucgugacucuccacccuagaaucgaagagggguucuuugaccugaugcauguucagaaggugcuuagcgccuccacagucuguaaacugcaaucuugcacccacggagugcccggcgauuugcagguauaccacauugggaaccuccugaagggagacaaagugaacggccaucuaauacacaagaucgagccacauuucaauacuagcuggauguccugggaugguugugaccuggauuauuacugcaacaugggggacuggcccucaugcucuuauacaggagucacccagcacaaucaugcggccuuuguuaacaugcuuaguauugaaacggauuacacuaaaaauuuccacuuucacucgaagagggugaccgcucauggcgacacaccucagcucgaucugaaagcacguccaaccuauggugccggcgagaucacaguguuggucgaaguggcugacauggaguuacacacuaagaagauugagaucagcgggcugaaauucgccucccucaccuguacgggaugcuacgcauguucuucaggcauaagcugcaagguucgcauccauguagaugaacccgacgagcugacagugcacgucaaauccgaagacccugauauuguggcggccaguucuagccuuauggcucggaagcuggaguuugggacugacucaaccuucaaagccuucuccgcaaugccgaagacaaguuuguguuuuuauaucguugaaagagaguacugcaagagcuguucuaaagaggauacccaaaagugcgugaacacuaaacuagaacagccacaguccauucugaucgagcacaagggaaccauaauuggcaaacaaaaugacacauguacggcuaaggccucaugcuggcucgaaagcgucaagucguucuuuuacggucugaaaaacaugcuuucugggaucuucggaaauguguuuaucggcauuuucuuauuucuggcacccuucgcccucuugauccuguuuuucauguuuggcuggaggauacucuucuguuucaagugcugccgacggacucgcgggcuguuuaaauauagacaucuuaaggaugacgaggaaaccggauacaggaaaauuaucgagcggcugaacaauaagaaggguaaaaacaaguugcuagauggcgagcgacuggcugacagaaaaauugcggaacucuucaguacaaagacccacguaggguga

SEQ ID NO: 10278 - RNA, 5070 nt, Artificial Sequence
  derived and/or modified CDS sequence (opt3) from CCHFV(TADJ/HU8966)__AY179962.1__GP
augcccgugagcaucaugcacaugcugcucaugugcgccguccuuugucugcaguuguacggcuuagggggaacccugagauccaacaaugguacagagcauaacaagacuaauguucuaacgaccccuggcgacaaacucucuccagaaccgcccgugucaacagcucugccuguaacuccagauaguagcaccgugacacccaccacuccugcauccgggcuugagggaucuggcgaagucuauacaucgccacccauuaccacgaagggucugucaccuagcgaggccaccagugaaccaccggcgacuacagggaugggaauauccucugcuagcggcguggacuucuccacucaagccgcaagggauaccucaacauugaccguucucacgagucccccuaacagcccaaauacucccccuacaucucaggacacccaccauccagugcggucccugcugucagucacuagcccccgcccggaggagacaaccgccccuaguaaaucuggcaaggaaucccccgcugcaaacagcucgcacccagugacgucucgaccuuccucaccccucaucaccguacgugggccaacagagaauaguagccauaacacuaccggacaguuagaauccaugacacagucuacuacccugguucccauggccagcccuacacaaaccgugcuuucacagagugucacuuccauugcugugcaggaugcccacccaagcucuacgaauagaucaaaaaggaacuuggagauggagaucauucugacacuaccgcagggucucaagaaguacuauggcaaagugcugcggcuucugcaauugacccucgaagaggacacugaagggcuguuagaguggugcaagcgcaaucugggacucgauugugacgauaccuuuuuccagaaaagaaucgaagaguuuuucauaacaggcgagggucacuuuaacgaaguccuucaguucaggacccccgggacucugaguacaacggagagcacccaugcgggauccccuacugcagaaccauuuaagucuuacuucgccaaaggcuuuuugucgaucgacagcggcuauuucuccgcuaagugcuacucacggacaaguaauucugggcuacgccugauuaacguuacccgacacagcacaagaaucgccgauacucccggaccuaagauuaccaaucucaaaacgaucuccuguauaaaccugagggcaucaauuuuuaaggagcaucgggaaguggagaucaacguacuucugccacagguggcugucaauuugagcaacugccacguggccauuaaaucucacguuugugacuauucccucgauguggacgguaccguccgucugccccauauccaccauggcgggacauucaucccgggaacuuacaagauugugauagacaaaaagaauaaauuaaacgaucgcugcacccuguuuacaaauuguguaaucaagggcagagagguuaggaagggucaaaguauucuacggcaguacaaaacugaaauccgaauagggaaggcgagcaccggcucucgcagacuccuguccgaggaaucaggagacgauugcauuaguaggacgcagcuuuugcggacagagaccgccgaaauccacggcgacgauuaugggggaccuggugacaaaaucacuauuuguaacggcagcacaaucguggaucaacgccuggggucggagcucggaugcuacaccauuaauagagucaaguccuucaaacugugcgagaacucugcaacuggcaagaauugugaaauagacagcgugccagucaagugcaggcaggguuauugucuuaaaaucacccaggaggggcguggccaugugaagcugucacggggaagugaaguuguguuggaugcuugcgacuccucuugugagguaaugauucccaaaggcacaggggauaucagcgucgacugcuccggaggucagcaacacuuccucaaggacaaccugaucgauuuaggcuguccuaaaauuccccugcuagggaagauggccauauacaucugccgaaugucaaaucacccaaagacgaccauggcuuuucucuucugguuuagcuucggauaugugauuacuagaauccuguguaaagccaucuuuuaccuuuugauuauaguuggcacacuggguaagagguucaaacaguaucgcgagcucaagccucagaccugcacaaucugugaaacuacccccgcaaacgccauugacgcugagaugcaugaucugaauugcaguuacaacaucugcccauacugugcgucucgguuaacguccgacgggcuggcaagacacgugacacagugcccgaaaaggaaggaacgcgucgaggaaaccgagcuuuauuugaaucucgagcggauuccuuggaucgugcgaaagcugcuacaaguaagcgaaucgacuggcguggcccugaaacguucaucuuggcucauaguucugcuugucuuguuuaccgugagucugucccccgugcagagcgcuccaauuggauacggcaacacaaucgagacuuaucaggccagagaagaguacaccucuauuuguuuauucguccucgggagcauccuguuuauaguuuccugccuuaugaagggacugguggauucaaucggcaacauuuucuuucccgguuugacaaucuguaaaacgugcaguauugggagcaucaauggauucgaaauagagucucauaaguguuauugcucccuccuguguugcccuuacuguaggcacugcucagcagaccgcgagauucaccagcuacaucugaguaucugcaaaaagcggaaaaccggcagcaacgugaugcucgccguauguaagagaaugugcuuuagggcuacuauggaagucuccaauaaggcccugcuuauccgaucuauuaucaacacaaccuucgugguuuguauuuugauacuggcagugugcaucgucucgacuagcgcgguggagauggaaucauuaccagcugguacaugggagcgcgaagaggaucucaccaauuucugucaccaagagugccagguuacggaaacugagugucugugccccuaugaagcccuugugcugcggagaccucuauuucucgacuccauuguaaaaggcaugaagaacccgcugaauaguaccucuuuggagacaagccuguccaucgaggcaccauggggagccauuaacguccagucaaccuacaaacccacugugucuacagcuaauaucgccuuaagcuggaguuccauagaacauagggggaacaauauccucgugagcggccguucugagucaauuaugaagcuggaggaacgcaccgggaucuccggagaucuuggcgucgaagacgcaagugagagcaaacuguugacaguuucggugauggaucucucucagauguacuccccuguauucgaguaucugagcggugaccggcaaguggaagaguggccaaaggcuacuuguaccggggauugccccgaaagauguggaugcacgucaaguacaugccuacacaaggaguggccucauucuaggaacuggcgauguaauccgaccuggugcuggggcgucgguacuggcuguaccugcugugggcuggacgugaaagaccuuuuuauugauuacauguucguuaaguggaaaguggacuauaucaagacagaagccauagucugcguggagcucacuucccaggagcggcaguguagccugguugaagcgggaacccgcuuuaacuugggccccgugacgauuacacugucagagccaagaaauauccaacagaaauuaccucccgaaaucauuacccuccacccaaggauagaggaaggguucuuugaucugaugcacguccagaagguacuuagugccagcacugugugcaagcugcaguccuguacacauggaguuccuggcgacuugcaaguguaccacaucgguaaccuccugaaaggggauaaggagaacggacaucuaauucacaaaaucgagccccauuucaauaccucuuggaugagcugggacggcugcgaucuggacuauuacuguaacaugggugauuggccauccugcacuuauacaggcgucacccagcacaaucacgcuucauuugugaaccuucucaauauugaaacggacuacacuaagucuuuccauuuucacaguaaacggguaaccgcacauggggauacaccgcagcuggacuugaaggcccgaccuaccuacggagcuggcgagaucacaguguuagucgaaguugccgauauggagcugcacacuaagaaaauagagaucaccgggcucaaguucgcaucgcugacgugcacaggauguuaugcgugcagcuccggcauuucuuguaaagugagaauccacguggacgaacccgacgagcuuacuguccaugugaagucagaugacccagauguuguagccgcuagcuccagucugauggcccgcaaauuggaauuugguaccgacucuacauucaaggcauucagcgcuaugcccaaaaccucacuaugcuuuuacauuguggagagggaauaucguaaguccuguaguaaggaggauacucagaaaugcgucaacaccaagcuggagcaaccucagagcauccucauagaacacaaagggacaauuaucggaaagcagaauaacacguguacugccaaagcaucuugcuggcuggaguccgugaagucauucuuuuacggccuuaagaauauguuaagcggcaucuucgggaacguuuuugugggaauuuuccuguuucucgccccauucaucuugcugauacucuuuuucauguuugguuggcggauucugucguguuucaaaugcuguagaaggacccgcggccuucugaagcaucgacacuugaaagacgaugaagagacaggguauagacggaucauugaaaggcuaaauaacaagaaaggaaagaauaagcugcucgacggcgagcgcuuagcugaucguagaaucgcggagcuguucucuaccaaaacucauauagguuga

SEQ ID NO: 10279 - RNA, 5070 nt, Artificial Sequence
  derived and/or modified CDS sequence (opt3) from CCHFV(88166)__AB069675.1__GP
augagcuucuccgugauguacacuccccugcucugcgccguccuuugucugcaguuguggucuuuagagggcucacacgggcugaguaacaagacacaacauagcaauacuuccacgaccaaagcuccugaaguuucucaggagcuaggacucccagugucgacaguaucaacuaucaccagcgacccgcccaguauuacauccgcagugucugucagcgguuccgaaggcucaggggauaccaacacuucuccuagcgugacaacccagggaccaacgcugcccgagacuacccuugaaccucugacaacuaccgacacagaugccucuuccaccguuguggucgacgugucaacgcagacuguaaaggauacaccaauaagcaccacuuauacaaguuugcccucuaccccuuccgagccaacgaccccgcaaggcacacaccauacugcgagaggucuccugagcguuaccucgacaaaacccgaggaagcuaguacucaggccaauccugggaagaucuccauggagaccaacucaccaaggcuggcaauuagugaaacacccagcuuuuccccuaccacucaggccccaacggaaaauucuaaccccaucacaagcaaacagcucauguuaucagcucaaccggugaccccuaaucccaugaccaguccaguccagccugcacugucccagagcgacaccucuacagccauucaggauauccaccccucaccaaccggacggaguaagcgcaaccuugagauggaaauaaucuugacucugagccaaggccuaaagaaauacuauggcaagauucucaaacugcuugaccugacauuggaggaagauacggaggggcuccuggaauggugcaagcgaaauuuaggacuggugugugacgauaacuucuuucagaaacguaucgaggaguucuuucucaccgguaagggccauuucaaugaagugcuucaguuuaagacucccuccacacugucuccuaccgggccagcuagaacaggaucgccgacugucgagcccuucaaaagcuacuuugccaagggcuucuuguccauggacucagguuauuuuagugcgaaaugcuacccuagggcaucuaacagcgggcuacaacugauuaauguuacccagcacuccacgcggaucaccgauacaccaggacccaagauaacuaaccucaaaaccauuaauuguaucaaccugaaggccucaguguucaaagaacaccgcgagauugaaaucaacguacuucugccucagguggcugucaauuugagcucuugccaugugcucaucaagucccacguuugugacuauagucuggacauugauggcccagugagauuacccaggauacaucacgagggcacauuuaucccggggacuuacaagauugucaucgacaaaaagaacaaacagaaugaucggugcacccuggugacgaacuguguaauaaagggacgcgagauucgaaaaggucaaagcguucuaagacaguacaggacagaaaucaagaucggcaaggccucuuccgggucacggcgucuccugagugaggaaagcggagacgauugcauuucgcgcacccagcuuuugagaacugagacagcagaaauccacuccgacaauuauggcgguccuggggauaaaauuaccauauguaacggcucuacuguggucgaccagaggcugggaagcgagcucggcugcuacaccaucaaucgggugaagucauucaaacugugcgagaacagugcuacagggaaguccugugaaauugauucuacgccagucaaaugccgacaaggauucugucuuaagaucacccaggagggucgcggccaugugaagcugagcagaggguccgaaguuguguuggacgccugcgauucaagcugugagaucaugauucccaaaggaacuggcgacauacucguagacugcaguggugggcagcagcacuuucugaaggauaauuuaaucgaccugggcuguccuaacauuccccuacucggaaaaauggcgaucuauauuugcaggaugucuaaucauccaaagacaaccaugggcuuccuguuuugguucuccuuuggguacgucgugacauguauccuuugcaaaguuauauucuauuugcugaucguggucggaacucucgguaagaaguuuaaacaauaccgggagcugaagccucagaccuguacgauuugcgaaacaacccccgugaacgccaucgaugcagagaugcacgacuuaaauugcagcuauaacauuuguccauacugcgcuucgcgccugacuucagauggccuugccagacauguaaugcaguguccgaaaaggaaggagaaaaucgaggaaaccgaguuguaccucaaucuggagcguauaccuugggugguucggaagcuacugcaggucucugaaaguacagggguggcucucaaacgauccagcuggcuggugguccuuuugguucuguuaacugugucucucagccccgugcaauccgccccaauuggacacggcaagaccguagagacauaucagacgagagaagguuacaccucaaucugccuguucguccuugggaguauucuguuuaucgugagcuguuugaugaagggccucguugacucugugggaaacuccuucuuucccggccugucaauaugcaaaacuuguaguaucgggagcgucaacggauucgagauugaaucccacaagugcuauuguucucuauuuugcuguccuuacugcaggcauugcucggcagaucgcgagauccaccggcugcaucucagcauuuguaaaaagagaaaaacauggucaaaugugaugcuggccguuugcaagaggauguguuuccgcgcuaccguggagguauccaacaaggcgcuuuugauccgaaauauaauuaacacuacauucguccugugcaucuuaauccucgcaguguguguggucaguaccucugccguugaaauggagagccugccagcuggcacgugggaacgggaggaagaccuuacuaauuuuugccaccaggagugucaagugaccgagacagaaugccugugucccuaugaggcccuaguacuccguaaaccucuguucuccgauucaauugugaaggguaugaaaaacuuguuaaauucuaccagccuggaaacaagucucuccaucgaggcaccguggggagccauuaacguccagagcacuuuuaagccaaccaugucugcugccaauauagcacugucaugguccaguguggagcacagagggaacaaaauccuuguuagcggcaggucggaaucuauuaugaagcuggaggaacgcacagguaucuccuggaauuugggcguggaggacgcgagcgaaucaaagcuccugacugucagugugauggaucuaucucagauguacucccccguuuucgaguaucugagcggggaccgacagguggaggaauggccuaaagcuaccugcacgggagauuguccagagagaugcggcugcacaucaaguaccugucuucauaaggaauggccccacagcaggaacuggcgaugcaauccuacuugguguuggggagucgggaccggcugcacauguugcggucucgacguaaaagaccuguuuacugauuacauguucauuaaguggaaaguggaguacaucaagaccgaagccauaguuuguguggaguugacgucccaagagcgccagugcacacugaucgaagcagggacccgguuuaacuuaggaccggucacuauuacacucucugagcccagaaauauccagcagaagcugccaccugaaauugugacccuucaucccaggaucgaggaaggcuucuuugaccugaugcacguacaaaaaguguugagcgccuccacugucuguaagcuccagucaugcacacaugguguuccaggcgaucuacagguguaucacauagggaaccugcugaaaggagacaaggugaacggccaccuuauucauaaaaucgagccucacuucaauaccucuuggaugaguugggaugggugugaccucgauuacuauugcaacaugggagacuggcccucgugcacguacacuggcgucacccagcauaaucacgcugccuuugugaacaugcugaauaucgagacagauuauaccaagaacuuccauuuucacagcaaacguguuacagcacacggugacacuccacaauuggauuuaaaggcucgcccgaccuacggggccggagaaauuacgguacugguggaggucgcggacauggaacuccauacaaagaaaauagagaucuccggccugaaguucgccucucuuacuuguaccgguugcuaugcuuguucaagcggcauuuccugcaaagugcggauccacguugaugagccugacgaacugacagugcaugucaagagugaggaccccgauuugguggcagccucuagcucacuaauggcuagaaaacuggaguucgggaccgacuccacuuuuaaggccuucagugcaaugccaaagaccagccucuguuuuuacauuguagaaagggaauacugcaaaucuuguuccaaggaggauacacagaaaugcgucaauacgaagcuggagcagccccaaucaauccuuauagaacacaaaggaacuaucauuggcaagcagaacaauaccuguacagcgaaggccagcugcugguuagagucggugaaaucuuucuuuuaugggcugaagaacaugcucaguggaaucuucggcaauguuuuuauugguguguucuuguuuuucgcuccuuuuauccugcucauacuguucuucauguuuggguggcggauucuuuucuguuuuaaaugcugccggcgcaccagaggacuguucaaguacaggcacuugaaagacgaugaagagacuggcuaucggaagaucaucgaacgacuaaacaauaagaaaggcaagaacaaacugcucgacggggagagauuagccgaucgcaagauugcagagcuguuuuccacaaaaacccauaucggauga

SEQ ID NO: 10280 - RNA, 5070 nt, Artificial Sequence
  derived and/or modified CDS sequence (opt3) from CCHFV(8402)__AB069674.1__GP
augagcuucuccgugauguacacuccccugcucugcgccguccuuugucugcaguuguggucuuuagagggcucacacgggcugaguaacaagacacaacauagcaauacuuccacgaccaaagcuccugaaguuucucaggagcuaggacucccagugucgacaguaucaacuaucaccagcgacccgcccaguauuacauccgcagugucugucagcgguuccgaaggcucaggggauaccaacaccaguccuagcgugacaacccagggaccaacgcugcccgagacuacccuugaaccucugacaacuaccgacacagaugccucuuccaccguuguggucgacgugucaacgcagacuguaaaggauacaccaauaagcaccacuuauacaaguuugcccucuaccccuuccgagccaacgaccccgcaaggcacacaccauacugcgagaggucuccugagcguuaccucgacaaaacccgaggaagccucuacucaggccaauccugggaagaucuccauggagaccaacggaccaaggcuggcaauuucagaaacacccaguuuuagcccuaccacucaggccccaacggaaaauuccaaccccaucacaucuaaacagcucauguuaagcgcucaaccggugaccccuaaucccaugacuucaccaguccagccugcacugagucaguccgacaccagcacagccauucaggaugugcaccccucuccaaccggccggucaaagcgcaaccuugagauggaaaucauauugacucugagucaaggccuaaagaaauacuaugggaagauccucaaacugcuugaccugacauuggaggaagauacggagggacuccuggaauggugcaagcgaaauuuaggucuggugugugacgauaacuucuuucagaaacguauugaggaguucuuucucaccggcaaggggcauuucaaugaaguccuucaguuuaagacucccagcacacuguccccuaccggaccagcuagaacaggcucuccgacuguugagcccuucaaaucguacuuugccaaggguuucuugagcauggacuccggguauuuuucagcgaaaugcuacccuagggcaaguaacucuggacuacaacugaucaaugugacccagcacagcacgcggauuaccgauacaccaggccccaagaucacuaaccucaaaaccauaaauuguauuaaccugaaggccuccguauucaaagaacaccgcgagaucgaaauuaacgugcuucugccucaggucgcugugaauuugucaagcugccauguucucaucaagucucacgugugugacuauucccuggacaucgauggcccagucagauuacccaggauucaucacgaggggacauuuauaccgggaacuuacaagaucgugauugacaaaaagaacaaacagaaugaucggugcacccugguaacgaacuguguuaucaagggucgcgagauacgaaaaggccaaagugugcuaagacaguacaggacagaaauuaagaucgggaaggccagcucuggaucccggcgucuccugucagaggaaaguggcgacgauugcaucagccgcacccagcuuuugagaacugagacagcagaaauucacaaugacaacuauggugggccuggcgauaaaaucaccauuuguaauggaucgacugucguggaccagaggcugggcuccgagcucgggugcuacaccauaaaccgggucaagucuuucaaacugugcgagaauagcgcuacaggaaagucaugugaaaucgauaguacgccagugaaaugccgacaagguuucugucuuaagauuacccaggagggccgcgggcauguuaagcuguccagaggaucugaagugguauuggacgccugcgauagcuccugugagaucaugauccccaaaggcacuggugacauucucgucgacugcucagggggccagcagcacuuucugaaggauaacuuaauagaccugggauguccuaauaucccccuacucggcaaaauggcgauuuauaucugcaggaugagcaaccauccaaagacaaccauggccuuccuguuuugguucaguuuuggguacgugguuacauguauucuuugcaaagugaucuucuauuugcugauagucgugggaacucucgguaagaaguuuaaacaauaccgggagcugaagccucagaccuguacgaucugcgaaacaacccccguaaaugcaauugaugcugagaugcacgacuuaaacugcucuuauaauaucuguccauacugcgccucccgccugacuagcgauggccuugcuagacaugugaugcaguguccgaaaaggaaggagaaaauugaggaaaccgaguuguaccucaaccuggagcguaucccuuggguuguccggaagcuacuacaggugucggaaucaacagggguggcccucaaacgaucuaguuggcuggucguucuuuuggugcuguuaacugugucccucagccccguacaaucugcaccaauaggacacggcaagaccgucgagacauaucagacgagagaagguuacaccagcauuugccuguucgugcuuggguccauccuguuuauuguuucauguuugaugaagggccucguggacagugucggaaacagcuucuuucccggccugucuaucugcaaaacuuguuccauagggucagugaauggauucgagaucgaaagucacaagugcuauuguagccuauuuugcuguccuuacugcaggcauugcuccgccgaucgcgagauucaccggcugcaucucucuaucuguaaaaagagaaaaacaggcucgaacguuaugcuggcugugugcaagaggauguguuuccgcgcgaccguagaggucagcaauaaggcacuuuugauucgaaacaucauaaauacuacauucgugcugugcauuuuaauccucgccgugugugucguuucaaccuccgcuguggaaauggagagucugccagccgguacgugggaacgggaggaagaccuuacuaacuuuugccaccaggagugucaaguaaccgagacagaaugccugugucccuaugaggcacuggugcuccguaaaccucuguucucugauagcaucgucaaggggaugaaaaauuugcugaacuccaccucauuagaaacuucucucagcauugaggccccguggggagcuaucaaugugcagaguacauuuaagccaaccguuuccgccgcaaacauugcgcugagcuggucuucaguggagcacagaggcaauaaaauacuugucuccgguaggagugaaagcaucaugaagcuggaggaacgcacaggcauuucgugggacuuggggguggaggaugcuucugaauccaagcuccugacuguuagcgugauggaccuaucacagauguacagucccgucuucgaguaucugucuggagaucggcagguagaggaauggccuaaagcuaccugcacgggcgacuguccagagagaugcgggugcacauccagcaccugucuucauaaggaauggccccacucaaggaacuggcgaugcaauccuacuugguguuggggagugggcaccgguugcacauguugcgggcucgacguuaaagaucuguuuacugacuacauguucaucaaguggaaaguggaguacauuaagaccgaagcaaucgucuguguggaguugacgagucaagagcgccagugcacacugauagaagccggaacccgguuuaacuuaggcccgguaacuaucacacucagcgagcccagaaauauucagcagaagcugccaccugaaaucgugacccuucaucccaggauugaggaagguuucuuugaucugaugcacguccaaaaaguuuuguccgcuucuacuguguguaagcuccagagcugcacacauggcgugccaggggaccugcaggucuaucacaucggaaaccuacugaaaggcgauaaggugaacgggcaccuuauacauaaaauugagccucacuucaauaccuccuggaugucaugggacggaugugaucucgacuacuauugcaacaugggcgauuggcccucuugcacguacacugguguuacccagcauaaucacgccgcauuuguaaacaugcugaauaucgagacagacuauaccaagaacuuccauuuucacaguaaacgugugacagcucacggggauacuccacaauuggacuuaaaggcccgcccgaccuacggagcgggcgaaaucacgguccugguggagguugccgauauggaacuccauacaaagaaaauugagauaucgggucugaaguucgcuagccuuacuuguaccggcugcuaugcauguuccucugggaucucaugcaaagugcggauucacgucgacgagccugacgaacugacagugcauguaaagagcgaggaucccgacaucgucgccgcuuccaguucuuugauggccagaaaacuagaguucggaaccgauagcacuuuuaaggcauucucagcgaugccaaagaccucccuguguuuuuacauuguggaaagggaauacugcaaaaguuguagcaaggaggacacacagaaaugcguuaauacgaagcucgagcagccccaaucuauccugauagaacacaaaggcacuaucauugggaagcaguccaacaccuguacagccaaggcuucaugcuggcuugagagcgugaaaucguucuuuuauggauuaaagaauaugcugucuggcaucuucgguaacgucuuuauugggguguuccucuuuuucgccccuuuuaucuugcugauacucuucuucauguuuggauggcggauucuguucuguuuuaaaugcugccgacgcaccagaggccuuuucaaguacaggcaccugaaagaugacgaagagacuggcuaucggaagaucaucgaacgauugaauaacaagaaagggaagaauaaacuacuggauggagagagacucgcagaccgcaagauugcugaguuauuuaguacaaaaacccauaucgguuga

SEQ ID NO: 10281 - RNA, 5070 nt, Artificial Sequence
  derived and/or modified CDS sequence (opt3) from CCHFV(7803)__AB069672.1__GP
augcccgugagcaucaugcacauuucccugaugugcgccguccucugucuucagcuguacggcuugggggagacccauggaucuucaaacgaaacagagcacaauaagacuaacguugugacgaccccuggugacagucaaagcccagaaccguuaguauccacaacucugcccgugacccuagauucuucgacagucaccccuacuacaccagcuucagagcccgaaggcagcggggagguguauaccaguccuccaauaacgacugagggacucucccccucugaagcaaccagcgagcugccuguuacaacuggcaucgguauuuccucagccagugacguggauagcucuacccaggcggcuggggacacauccaccccaacggucagaacuucaccgcccaauagcccuaguacaccacccaccucucaggauacucaucacccuaugaggaaccuucuguccgugacaagccuaaaaucggaagagaccucugccccauccaagucaggaaaagagagucccgcagccagcuccccgcauccuguagcuucucggcccccaacgcacccuaucaccgcacagggccccacagaaaauaacagccacaauacuaccggccaacucgagucaguuacacagagugccacucuggggccaauggcuucccccacccagacagugcugagccagaacgucaccucuauugccauccaagacacucauccuucaccaacgaaucgcaguaagcgaaaccucgaaauggagauaaucuuaacacugccgcagggacuuaaaaaguacuaugguaagguguugcgucugcuacagcucacccuggaagaggauacugagggccuucuggaauggugcaaaagaaauuuggggcucgacugugaugacaccuucuuucagaagaggauugaggaguucuuuaucacaggagaaggccacuucaacgaagugcugcaauuucggacccccgguacuuuaagcacaacggaguccacccaugcggagucuccuacugcagaaccauucaaaucguacuuugccaagggguuccugagcauugauuccggauauuuuucagcuaaaugcuacagucgcacaucugacagcggccuccagcuuaucaaugucaccagacacuccacaaggauagccgauacucccggcccuaagauuaccaaccugaagacgaucucauguauuaauuugaaagcaagcguuuucaaggagcaccgggaaguggagaucaacguacuacugccacagguggcugucaaccucucuaauugccaugugaccaucaaaucccacguuugugacuauagucuggacauugaugggacagugcgccuuccccauauacaccaugaaggaacuuuuaucccggguaccuacaagauugucaucgacaaaaagaacaaacugaaugaucgaugcacauuguucacuaacugugugauaaagggcagagagguaaggaaggggcaaagcguucuccggcaguacaaaaccgagauucguaucggaaaggccucuacgggcucccgcagacuguuaucagaagagaguggugacgauugcaucagcaggacacagcugcuacggaccgaaacugcggagauucacggggacaauuauggcggaccuggcgauaaaaucacaauuuguaacgggucgaccauaguggaccagcgacucggauccgagauggguugcuacacuaucaaucgcgucaagucuuuuaaacugugcgaaaacagcgccaccggcaagucaugugagauugauaguaucccagugaagugcagacaaggguauugucuuaaaaucacacaggaaggaaggggccacgucaaguugucccgggguucugaggugauucuggacgcaugcgauagcuccugugaaguuaugauacccaaagggacgggcgacauccucguggacugcucaggaggccagcagcauuuccugaaggauaaucuuauugaccugggguguccuagcauccccuugcucggaaaaauggcuauuuacaucugccgcaugaguaaccacccaaagaccacuauggccuuccuguuuugguucucuuuugguuauguaauaacauguaucuuaugcaaggcuauuuucuaccugcuaaucauugucggcacccucgggaaaagauuuaagcaauauagggagcugaaaccucagacauguacuaucugcgagaccacgcccgccaaugcaauagaugccgaaaugcaugaccuuaacugcuccuacaauauuuguccauacugcgcuagccguuugacaucggauggacuggcgcggcacgugacccaguguccgaagcgaaaagagaagguugaagagacugaacucuaucugaacuuagagagaaucccuuggguggucaggaagcugcuucaggugucagagucuaccggcguagcauugaaacgcaguuccuggcucauugugcugcuaguucuguucgccaucagccucucucccguccaaagcgcuccaauaucccacgguaagacaaucgaaacuuaccaggcccgggaggaauauaccucaauuugccuguuugugcuugggaguaucuuguucauugugagcugucugaugaaaggcuuagucgacucuaucggaaauauauuuuuccccggccucuccauuugcaagacauguucaaucgggaguaucaacggauuugagauugaaagccauaaaugcuacuguucccugcuuugcuguccuuauugcagacacugcucugcagauagggagauccaucagcugcacuugucgauuuguaagaaacgcaagacgggcagcaacguuaugcucgccgcuugcaagcgaauguguuuccgggccaccauggaggugucaaauaaagcacugcuaauacguuccaucauuaacacuacauuugugguauacauccugauucucgcggucugcgugguuaguaccucugcuguggaaauggagagccugccagccgguacuugggaaagagaggaggaccuuacaaauuucugucaucaggaaugccaagucaccgagacggaauguuugugccccuaugaggcacugguguuaaggcgcccucucuuccuggauuccaucguucgggggaugaagaacccgcuuaauucaacuucucuggaaaccagccuaaguauagaggccccauggggagcuaucaacgugcaguccacauacaaacccaccguaagcacugccaauauugcacucucuuggucauccgucgagcacagaggcaacaagauccuggugagugguaggagcgaaucgauuaugaaauuggaggaacgaacaggcaucucuugggaccuggggguggaggaugcuuccgaaagcaaguuacucaccgucucaguuauggaccugagucagauguacucuccuguguuugaguaucuuuccggagaucgccaaguagaggaauggccaaaggccacauguacuggcgacugccccgagcggugugggugcaccacgagcacaugccugcacaaagaauggccucauucaagaaauuggagguguaacccgaccuggugcuggggagugggcacugguuguaccugcuguggguuggacgucaaggaucucuucacagacuacaugauagugaaauggaagguugaguauauuaaaacucguggaaucgugugcgucgaacugaccagucaggagcgccaguguagccuaaucgaggcgggcacgcgguuuaaucuggguuccgugacaauuacccuuucugaacccagaaacauacagcaaaagcucccaccugagaucauuacucugcaccccaggaucgaagagggcuucuuugauuugaugcauguucagaaggugcugagcgccuccacagucugcaaauuacagucauguacccacgggguaccaggagaccuccagguguaccauguuggcaaucugcuuaagggggauaaagugaacggacaccugauucacaagaucgagccucauuugaauacuucuuggaugaguugggacggcugcgaucucgacuauuacuguaacaugggugauuggcccucgugcacauauaccggggucacgcaacacaaccaugcuagcuucgugaaucugcuaaacauagaaacugacuacaccaaauccuuucacuuccacucuaagcgaguaacagcacauggagauaccccacagcuggaccuuaaggcccggccgacauacggcgcuggugagaucacugugcucgucgaaguugccgauauggaguuuaccccuaaaaagauugaaaucucaggccugaaauucgcgagcuugacgugcacaggguguuaugcaugcuccaguggaauuucuuguaaggugcgcauccacguggacgagcccgacgaguuaacuguccaugugaaaagcgaugacccagauguuguagccgcuucauccagucugauggccagaaagcucgaauuuggcaccgacagcacauucaaagcauuuucugcuaugcccaagaccucccugugcuucuacauaguggagagggaauauuguaagucaugcagcaaagaggauacucagaagugugucaauaccaaacuugaacagccucaaucgauucugaucgagcacaaggggacaaucauuggaaaacagaacaauacgugcacugccaaggcaucuuguugguuggagagugugaaguccuucuuuuacggcuugaaaaacaugcugagcgguaucuucgggaacuuuuucaugggaauauuucucuuccuggccccauuuauucuuuuaauccuguucuuuauguucggcuggcggauucucuuuugcuucaaguguugccgaagaacccgcggcuuguucaaauauaggcaucugaaggacgaugaagagacaggguaccgucggaucauagaaagacucaauaauaaaaagggaaagaacaaacugcuugacggugagaggcuggcugaucgccgaauugcggaauuguuuucaaccaagacucacaucggcuga

SEQ ID NO: 10282 - RNA, 5070 nt, Artificial Sequence
  derived and/or modified CDS sequence (opt3) from CCHFV(75024)__AB069671.1__GP
augcccgugagcaucaugcacauuucccugaugugcgccguccucugucuucagcuguacggcuugggggagacccauggaucuucaaacgaaacagagcacaauaagacuaacguugugacgaccccuggugacagucaaagcccagaaccguuaguauccacaacucugcccgugacccuagauucuucgacagucaccccuacuacaccagcuucaggccccgaggggagcggagaaguguauaccaguccuccaauaacgacugagggccucucccccucugaggcaaccagcgaacugccugccacaacugguaucgggauuuccucagcgagugacguugauagcucuacccaggcugccggagacacauccaccccaacggugagaacuucaccgcccaauagcaguucuacaccuccaaccucccaggauacucaucaccccaugaggaaccuucugagcgucacaucguugaaaccugaggaaaccucugcaccauccaagucaggcaaagagagucccgccgcuagcuccccgcauccuguggcaucucggcccccaacgccucccaccacagcccagggcccaaucgagaauaacagccacaauacuaccgggcaacucgaaucaguaacacagagugcuacucugggacccauggccuccccuacccagacaguucugagccagaacgugaccucuauugcgauccaagacacucacccaucaccgacgaaucgcaguaagcgaaaccucgagauggaaauaaucuuaacacugccccagggucuuaaaaaguacuauggcaaggucuugcgucugcuacagcucacccuggaggaagauacugaggggcuucuggaguggugcaaaagaaauuugggacucgacugugaugacaccuucuuucagaagaggauugaagaguucuuuaucacaggcgaaggucauuucaacgaggugcugcaauuucggaccccugggacuuuaagcacaacggaauccacccacgcagagucuccaacugccgagcccuucaaaucguacuuugcuaagggauuccugagcauugauuccggcuauuuuucagccaaaugcuacagucgcacaucuaauagcggccuccagcuuaucaacgugaccagacauuccacaaggauagcagacacuccugggccaaagauuaccaaucugaagacgaucucauguauuaacuugaaagcuagcgucuucaaggaacaccgggagguugaaaucaacgugcuacugccccagguagccgugaaucucucuaacugccacgucaccaucaaaucccaugugugugauuauagucuggacauugacggaacaguucgccuuccgcacauacaucacgaggguacuuuuaucccuggcaccuacaagauugugaucgauaaaaagaauaaacugaacgaccgaugcacauuguucacuaauugugucauaaaggggagagaagugaggaagggacaaagcguacuccggcaguacaaaaccgagauucguaucggcaaggcgucuacggguucccgcagacuguuaucagaggaaaguggggaugacugcaucagcaggacacagcugcuacggaccgagacugccgaaauucauggcgauaacuauggaggcccaggggacaaaaucacaauuuguaauggaucgaccauaguugaucagcgacucgguuccgagaugggcugcuacacuaucaaccgcgugaagucuuuuaaacugugcgagaauagcgcaaccgggaagucaugugaaauugacaguauccccgucaagugcagacaaggauauugucuuaaaaucacacaggagggcaggggucacgugaaguugucccgggggucugaagucgugcuggaugcuugcgacagcuccugugagguuaugauuccuaaaggcacgggagauauacucguggacugcucaggcgggcagcagcacuuccugaaggacaaccuuaucgaucugggaugucccagcauuccauugcucgguaaaauggccaucuacauuugccgcaugaguaaucauccuaagaccacuauggcuuuccuguuuugguucucuuuuggcuauguaaucacauguauauuaugcaaggccaucuucuaccugcuaauuaucgucgggacccucggaaaaagauuuaagcaauauagggaacugaaaccccagacauguacuauuugcgagaccacgccagcaaacgccaucgacgcugagaugcacgaucuuaauugcuccuacaacauauguccguacugcgcgagccguuugacaucggacggccuggcacggcaugugacccaguguccuaagcgaaaagaaaagguugaggaaacugagcucuaucugaauuuagaaaggauucccuggguggucagaaagcugcuucaggugucagagucuaccgguguagccuugaaacgcaguuccuggcucaucgugcugcuaguucuguucgcuauuagccucucuccaguccaaagcgcccccaucgggcacggcaagacaauagagacuuaccaggcacgggaagaguauaccuccaucugccuguuugugcuuggaucaauuuuguucaucgugaguugucugaugaaaggcuuagucgauagcauugggaacaucuuuuucccuggacucucuauaugcaagacauguuccauuggcucaaucaacgguuuugaaaucgagagucacaaaugcuacuguagccugcuuugcuguccauauugcagacauugcuccgccgacagggaaauucaccagcugcauuugucuaucuguaagaaacgcaagacggggucgaauguuaugcucgcugugugcaagcgaauguguuuccgggccaccauggaggugagcaacaaagcacugcuaauucguucaauaaucaauacuacauuuguagucugcauucugauccucgcgguguguguuguguccaccagugcugucgagauggaaucucugcccgccggaacuugggagagagaagaggaucuuacaaacuucugccaccaggagugucaagugaccgaaacggagugcuuguguccuuacgaagcacugguuuuaaggcgcccgcuauuccuggacagcauugugcggggcaugaagaaucagcuuaacuccacuucacuggagaccucucuaagcaucgaagccccauggggugcuauaaauguacagaguacauauaaacccaccgucuccacugccaacaucgcacucagcuggucuucaguggagcauagaggcaauaagauucugguguccgggaggagugagagcaucaugaaauuggaggaacgaacaggaauuucgugggaucugggcgucgaagacgcuucugaguccaaguuacucaccguuagcgugauggaucugucacaaauguacaguccuguauuugaauaccuuucuggggaccgccagguggaggaguggccaaaggccacaugcacuggagauugucccgaacggugcggcugcaccacguccacaugucugcacaaagaguggccucacagcagaaacuggaggugcaauccgaccugguguuggggugucgggacuggaugcaccuguugcggcuuggacgugaaggaccucuucacagauuauaugaucguuaaauggaagguggaauacauaaaaacugaggcgauugucuguguggaacugaccucacaggagcgucagugcagucuaaucgaggccgguacgcgcuuuaaccugggcagcguuacaaucacccuuuccgaaccccggaauauucaacagaagcucccaccugagauaaucacucugcaucccagaauugaagagggguucuuugacuugaugcacgugcagaagguccugucugcuagcacaguauguaaauuacaguccugcacccauggagugccaggcgaucuccaaguuuaucacguggggaaccugcuuaagggagacaaagucaauggccaucugauccacaagauugagccucacuugaacacuucauggaugucuugggaugguugugaccucgauuacuauugcaacaugggggacuggcccaguugcacauacaccggagugacgcagcauaaucacgcaucguucguaaaccugcuaaauaucgaaacugauuauaccaagagcuuucauuuccacuccaaaagggugacagcccacggcgacaccccacagcuggaucuuaaggcucgaccgacauacggugccggcgagauaacuguccucguugaaguggcagacauggaguuuaccccuaaaaagaucgaaauuucugggcugaaauucgcgucauugacguguacaggaugcuacgccuguagcuccggcaucaguugcaaggugcggauucaugucgaugagcccgacgaguuaacugugcacguuaaaucugacgauccagacguaguggcugccagcucaucccugauggcacgcaagcucgaauuugggaccgauaguacauucaaggcuuuuagcgccaugcccaaaaccucucuguguuucuauaucgucgagagagaauacugcaaguccuguucaaaagaggacacucagaagugcgugaacaccaaacuugaacaaccucagagcauacugauugagcauaagggaacaaucaucggcaaacagaauaacacguguacugcaaaggccucgugcugguuggagucuguuaagaguuucuuuuauggucucaaaaauaugcuguccgggauuuucggaaaccucuuuaugggcaucuuccuguuucuugcuccauucauauuacugauucucuuuuucauguuuggcuggaggaucuuguucuguuuuaagugcugccggcgaaccagagggcuguucaaauaccgccaccucaaggaugacgaagagacaggauauaggcguauuaucgaacggcugaauaacaaaaaggguaagaauaaacuucuggauggcgagagauuggcggacaggcgcauagccgaacuauucagcaccaagacucauauuggguga

SEQ ID NO: 10283 - RNA, 5070 nt, Artificial Sequence
  derived and/or modified CDS sequence (opt3) from CCHFV(66019)__AB069669.1__GP
augcccgccaacaucauguacacccugcucgugugcgcuguccuuuguccucagcuguggagcuuggagggcacacacguuccacauaaugaaacuaagcacaacgggacgggaauuaccgcagccccgggugagucccaaggccccaugucuccugcgucaacagcugugccauuaacucccgaaccuccaaauaccaaacccgccgcaagugccagcgagcuggaauccucuggggagggacauacaucgcuacucgcuaccacucagggccugacaucaccugaggcaaccccagaacuuccgacgacuaccgacacagguguaagcaguacuuccguggucgauauagggacccagauggccaaggacacacccaccucuacggcucacacuagccugccuuccaacccaucagcccccaguacagcgcagggaacccaucacacuaucagaggcuugcucagcgugacaucuaccaaaccugaggaagcauccacgccaaccgaucccggcaaggccggggcugagacaggaucaccgaggccugccauuagccggaaacccacucugaguccaaccgcagaggcuccuacagaaaucaauaacucuuccacucccaagcaaccagagcccagcauucagccugccaccccaucgcugguuaucucuccggcgcagcccgccuucccucaguccgcaacaucaaccgcugcccaagacauauauaguagcccaacuaaucgcuccaagcgaaaccucaaaauggaaaucauuuuaacgcugucucagggucuuaagaaauacuauggcaagauccagaaaacauuggggcugacccuagaggaagauacugagggacuccuggaguggugcaagcguaaucuuggccugaccugugacgauaacuuuuuccagaagagaauugaagaguuuuucuugacaggugaaggguacuuuaaugaggugcuccaauucaaaacccccagcacuccuggaucaacagaaccaacgcacaccgaggcucccacugucaagccguuuaaaaguuauuucgccaggggcuuucugacaaucgacuccggcuacuucagcgcaaagugcuauucucggaccucaaacaguggguuacagcugauaaaugugacacagcauccugcccgcauugcugauacuccaggacccaaaaucaccaaccucaagacgauuaauuguaucaaccuuaaagcgagcguauuuaaggagcacagagaaaucgagauuaacguucuguugccucaaguggcagucaaucuauccaacugccaugugcugauaaagucucacgugugugacuacucgcucgauaucgacgguaccauuaggcugccccggaucuaccacgaaggcacauucauaccagggacuuauaaaauugucaucgauaagcgcgacaaacagaaugaccgaugcacccuuguuacaaacugugugaucaagggaagagagguaaggcggggccagagcgcccugcgucaguaccgcacugaaauuagaaucgguaaagcuagcgccgggucaaggcgguugcucagugaggagucuggcgaugacugcauuagccgaacccaacuguuacgcacggaaacagcagaggugcauggagauaauuauggcgggccuggagacaagauaaccaucuguaacgguuccacuauugucgaucagagacugggcucagaacuagggugcuacacaaucaauagggugaaguccuuuaaacucugcgagaacucuggaaccggcaaguccuguaaaaucgacaauacucccguuaagugccggcaggguuucugucugaaaauuacccaggaggggcgcggccacgugaaacuuaguagaggaagcgaagucguguuggaugccugcgacucuuccugugagauaaugaucccaaagggcacaggggauauucugguagacugcucaggaggucaacagcauuuccucaaagauaaccugguugaccuuggcuguccgaauaucccucuguuggggaagauggcuauuuauaucugcaggaugaguaaccaccccaaaacgaccauggccuuucucuucugguuuagcuucggauacgugauaacuuguaucuuuugcaagauuaucuucuaucuguuaauugucgugggcacacuggguaaaaaguuuaagcaguaccgugaacuaaaaccacagaccuguacaaucugcgagacuacccccacgaaugcaauagacgcggaaaugcaugaucucaagugcucguacaacauuuguccuuauugcgcuucccggcugacaucugacgggcuugcccgacacgucacccaauguccaaaaagaaaggagaaaguggaggaaacugaguuguaccugaaucucgaaaggauccccuggauuguucgcaagcuguuacaggugagcgagucaaccggcguagcacugaaacggaguuccuggcuuaucgucuugcucgugcugcuaacaguuucucugagcccugugcaguccgccccgauaggacacggcaagacuaucgaagcauaucagaccagagagggguacacaucagucugccucuucaugcugggaggcauucuuuuugugguaagcuguuugaugaagggucugguggauaguguuucuaacuccuucuuuccaggguuaagcaucugcaaaacguguucgauuggaucagucaacggcuucgagaucgaaucucauaagugcuauuguagucuccugugcugucuuuacugcaggcacugcuccgccgaccgcgagauacaucaacugcacuugagcauuuguaaaaagcgacgggcugguggcaaugugaugcucgcugugugcaaacguaugugucugagagccaccauggaagucucuaacaagguucuauuuaucaggagcaucauuaauacuacauucgugaucugcauucuggugcucgcgguauguauagucuccaccucagccguggagauggaaagucugcccgcugggacuugggagcgcgaggaagaucuuacaaacuucugccaccaggagugucagguuaccgaaacggagugcuuguguccuuaugaggcacugguguuacggaagccacucuuuagcgacucuaucgucaaaggaaugaagaaucugcuuaacuccacuucacuggaaaccagucuaagcauugaggcccccuggggcgcuaucaaugugcaauccacauucaaaccuaccguuucuacugccaacauugcacucucguggagcucaguggaacauagagggaauaagauccugguauccggaaggagugagucuauaaugaaauuggaggaacgaacaggcaucagcugggaucugggugucgaggacgcguccgaaucaaaguuacucaccgugucugugauggaucugagccagauguacaguccggucuuugaguaccuuuccggggaccgccagguugaagaguggcccaaggccacaugcacuggaaacuguccagaucggugcggcugcaccagcucuacgugucugcacaaagaauggccucauucaagaaauuggaggugcaaccccacaugguguuggggugugggcaccgggugcacuuguugcggauuggacguaaaggaucucuucaccgacuauauguuugugaaauggaaggucgaguacauuaaaacagaggcuaucguguguguugaacuaaauucccaggagcgucaaugcagucugauugaagccggcacucgcuucaaccuggggccagugaccaucacgcuuagcgagccucggaauauacagcagaagcuccccucggaaauuaucacacugcacccaagaaucgaggagggauuuuucgacuugaugcauguccagaaggugcugucugcauccaccguuuguaaauuacaaagcugcacucacggcgugccgggugaucuccagauuuaucacauagggaaccugcuuaagggagacagggucaacggccaucugauccacaaaauugaaccucauuuuaauacaucauggaugaguugggaugguugugacuuggauuacuauugcaacaugggcgacuggcccucuugcaccuacacugggguaacacagcacaaucaugcugccuucgugaaccuccugaauaucgagaccgauuauacgaagaacuuucacuuccacuccaaacgaguuacugcacauggagacaccccacagcuagaucugaaggcccggcccacauacggcgcuggggaaauuaccgugcuugucgagguggcggacauggagcuccacacaaagaagaucgccauaagcggacugaaguuugcaucauugacuuguaccggcugcuacgcuuguaguagcgguaucuccugcaaaguacgcauucauguggaugaaccugacgaguuaacgguccacguuaagucugaagauccagacaucguggccgccagcuccucacugauggcuagaaaacucgaguucgggacagacucuacuuucaaggcauuuagugccaugcccaaaaccucgcuguguuucuauauuguggaaagggaguacugcgagagcuguuccaaggaagauacacaaaagugcgucaauaccaaacuugagcagccucagucuauccugauagaacacaagggaacuauuaucggcaaacaaaacgacaccuguacagcgaaggcuucaugcugguuggagagcgugaaauccuuuuucuauggccuaaagaauaugcugagugggaucuuuggaaacguuuucauugguaucuuucucuuccuggccccguuuauacuuuuaauucuguucuuuauguucggcuggcggauccucuucuguuuuaagugcugccgaagaacgcgcggguuguucaaauacagguaucugaaggaugacgaagagucuggauaccgucggauuaucgagagacucaauaacaaaaagggcaaaaauaagcugcuugauggugaaaggcuggcagaccgccgaauagccgaguuguuuagcacuaagacccauauuggguga

SEQ ID NO: 10284 - RNA, 5070 nt, Artificial Sequence
  derived and/or modified CDS sequence (opt3) from CCHFV(BA8402)__AF350449.1__GP
augagcuucuccgugauguacacaccccugcucugcgccguccuuugucugcaguuguggucuuuagagggcucacacgggcugaguaacaagacacaacauagcaauacuuccacgaccaaagcuccugaaguuucucaggagcuaggacucccagugucgacaguaucaacuaucaccagcgaaccgcccaguauuacauccgcagugucugucagcgguuccgagggcucaggggacaccaacacuagcccuagcgugacaacccagggaccaacgcugcccgaaacuacccuugagccucugacaacuaccgauacagacgccucuuccaccguuguggucgaugugucaacgcagacuguaaaggacacaccaauaagcaccacuuauacaaguuugcccucuaccccuuccgagccaacgaccccgcaaggcacacaccauacugcgagaggucuccugagcguuaccucgacaaaacccgaagaggcuucuccucaggccaauccagggaagaucuccauggaaacuaacggacccaggcuggcaauuucagagaccccuaguuuuagcccaacaacccaggcccccacugaaaauuccaacccgaucacgucuaaacagcucauguuaagcgcucaaccugugacacccaauccaaugaccucaccuguccagcccgcacugagucaguccgauacuagcaccgccauucaggacgugcacccaucucccacaggccggucaaagcgcaaccuugaaauggagaucauauugacccugagucaaggccuaaagaaauacuaugggaagauccucaaacugcuugaucugacuuuggaagaggacacagaaggacuccuggaguggugcaagcgaaauuuaggucuggugugugaugacaacuucuuucagaaacguauugaggaguucuuucucacgggcaaggggcauuucaaugagguccuucaguuuaagaccccuagcacucuguccccaacaggaccggcuagaaccggcucucccacaguugaaccuuucaaaucguacuuugccaaggguuucuugagcauggauuccggguauuuuucagcgaaaugcuacccaagggcaaguaacucuggacuacaacugaucaaugugacucagcacagcacccggauuacggacacccccggcccuaagaucacaaaccucaaaacuauaaauuguauuaaccugaaggccuccguauucaaagagcaccgcgaaaucgagauuaacgugcuucugccacaggucgcugugaauuugucaagcugccauguucucaucaagucucacgugugugauuauucccuggacaucgacggccccgucagauuaccgaggauucaucacgaggggaccuuuauaccuggaacauacaagaucgugauugauaaaaagaacaaacagaaugaccggugcacucugguaaccaacuguguuaucaagggucgcgaaauacgaaaaggccaaagugugcuaagacaguacaggacggagauuaagaucgggaaggccagcucuggaucccggcgucuccugucagaagagaguggcgaugacugcaucagccgcacacagcuuuugagaaccgaaacugcagagauucacaaugauaacuauggugggccaggcgacaaaaucacaauuuguaauggaucgaccgucguggaucagaggcugggcuccgagcucgggugcuacacuauaaaccgggucaauucuuucaaccugugcgaaaauaccgcuacaggaaagagcugugagaucgacucaacgcccgugaaaugccgacaagguuucugucuuaagauuacccaggaaggccgcgggcauguuaaacugaguagaggauccgaggugguauuggaugccugcgagucuagcugugaaaucaugaucccuaagggcacuggugacauucucgucgauugcuccgggggccagcagcacuuucugaaggacaacuuaauagaccugggaugucccaauaucccacuacucggcaaaauggcgauuuauaucugcaggaugucaaaccauccuaagacaaccauggccuuccuguuuugguucagcuuuggguacgugguuacauguauucuuugcaaagugaucuucuauuugcugauagucgugggaacucucgguaagaaauuuaagcaauaccgggagcugaagccccagaccuguacgaucugcgaaacaaccccaguaaaugcaauugaugcugagaugcacgacuuaaacugcaguuauaacaucuguccguacugcgccucucgcccuacuuccgauggccuggcuagacaugugaugcagugucccaaaaggaaggaaaagauugaggagaccgcccuuuacuugaaucucgaacguaucccauggguuguccggaagcugcuacaggugagcgagucgacagggguggcacugaaacgaucaucuuggcucgucguucugcuuguguugcugacugugaguuuaucccccguacaaagcgccccuauaggacacggcaagaccgucgaaacauaucagacgagagaggguuacaccucuauuugccucuucgugcuggggagcauccuuuuuauuguuuccugucugaugaaaggcuugguggacucagucggaaacaguuucuuuccaggccucagcaucugcaagacuuguucuauaggguccgugaauggauucgaaaucgagucacacaagugcuauuguagucuguuuugcugucccuacugcaggcauugcagcgcugaucgcgagauucaccggcuacaucuguccaucuguaaaaagagaaaaacaggcucuaacguuaugcucgcggugugcaagaggauguguuuccgcgcaaccguagaagucucgaauaaagcccugcuuauucgaaacaucauaaauacuacauucguguugugcauucugaucuuagcugugugugucguuagcaccucagccguggagauggaaucccucccugcagguacgugggagcgggaagaggaccugacuaacuuuugccaccaggagugucaaguaaccgaaacagagugccuuuguccguaugaagcccuggugcuacguaagccacucuucagugauucuaucgucaaggggaugaaaaaucuguugaacagcaccucccuggagacuucauuaucuauugaggcucccuggggagccaucaaugugcagagcacauuuaagccuaccguuagugcagcgaacauugcucucuccuggagcucuguggaacacagaggcaauaaaauacuggucucagguagguccgagaguaucaugaaacuugaggaacgcacaggcauuagcugggaccuggggguggaagaugccucggagucuaaauugcucacuguuuccgugauggaccugagccagauguacucaccagucuucgaguaucuaaguggagaucggcagguagaagaguggcccaaggcaaccugcacgggcgacuguccugaaagaugcgggugcacaucuuccaccugucugcauaaggaguggccgcacagcaggaacuggcgaugcaaucccacuugguguuggggagugggcaccgguugcacauguugcgggcuugauguuaaagaccucuuuacugacuacauguucaucaaguggaaaguggaauacauuaagaccgaggccaucgucuguguggagcugacgucacaagaacgccagugcacauugauagaggcuggaacccgguuuaaccugggcccaguaacuaucacauuaagugaaccuagaaacauucagcagaaacugcccccagagaucgugacccuccauccuaggauugaagaggguuucuuugaucuuaugcacguccaaaagguucugagcgccuccacuguguguaaguugcagucuugcacacauggcgugcccggggaccuccaggucuaucacaucggaaaucugcuaaaaggcgauaaggugaacgggcaccugauacauaaaauugagccacacuucaauaccagcuggauguccugggacggaugugaucuucauuacuauugcaacaugggcgacuggccgucaugcacguacacugguguuacccagcacaaucaugcagcuuuuguaaacaugcucaauaucgaaacagauuauaccaagaacuuccacuuucacucuaaacgugugacagcccauggggacacuccucaacuggauuugaaggcgcgccccaccuacggagccggcgagaucacggucuuaguggaaguugcugacauggagcugcacaccaaaaagauugagauaaguggucucaaguucgcaucgcugacuuguaccggcugcuaugccuguagcuccgggaucucuugcaaagugcggauucaugucgaugaaccagacgagcuuacagugcacguaaagucagaagaucccgacaucgucgcugccagcuccagucugauggcaagaaaauuggaguucggaaccgacucuacuuuuaaggcguucagcgccaugccuaaaaccucacuauguuuuuacauuguggaaagggaguacugcgaguccuguaguaaggaagauacacagaagugcguuaauacgaaacuggagcagccacaaagcauccucauagaacacaagggcacuaucauugggaaacagucuaacaccuguacagcuaaggccuccugcuggcuggagucagugaaaaguuucuuuuauggacuuaagaauauguuaucgggcaucuucgguaacgucuuuauugggguguuccuguuuuucgcacccuuuauccucuugauacuguucuucauguuuggauggcggauucucuucuguuuuaagugcugccgacgcaccagaggccuguucaaauacaggcaucuuaaggacgaugaagagacuggcuaucggaaaaucaucgagcgacugaauaacaagaaagggaagaauaaguugcuagacggagaaagacuggcugaucgcaaaauugccgagcucuuuucuacaaagacccacaucgguuga

SEQ ID NO: 10285 - RNA, 5070 nt, Artificial Sequence
  derived and/or modified CDS sequence (opt3) from CCHFV(BA66019)__AF350448.1__GP
augcccgccaacaucauguacacccugcucgugugcgcuguccuuuguccucagcuguggagcuuggagggcacacacguuccacauaaugaaacuaagcacaacgggacgggaauuaccgcagccccgggugagucccaaggccccaugucuccugcgucaacagcugugccauuaacucccgaaccuccaaauaccaaacccgccgcaagugccagcgagcuggaauccucuggggagggacauacaucgcuacucgcuaccacucagggccugacaucaccugaggcaaccccagaacuuccgacgacuaccgacacagguguaagcaguacuuccguggucgauauagggacccagauggccaaggacacacccaccucuacggcucacacuagccugccuuccaacccaucagcccccaguacagcgcagggaacccaucacacuaucagaggcuugcucagcgugacaucuaccaaaccugaggaagcauccacgccaaccgaucccggcaaggccggggcugagacaggaucaccgaggccugccauuagccggaaacccacucugaguccaaccgcagaggcuccuacagaaaucaauaacucuuccacucccaagcaaccagagcccagcauucagccugccaccccaucgcugguuaucucuccggcgcagcccgccuucccucaguccgcaacaucaaccgcugcccaagacauauauaguagcccaacuaaucgcuccaagcgaaaccucaaaauggaaaucauuuuaacgcugucucagggucuuaagaaauacuauggcaagauccagaaaacauuggggcugacccuagaggaagauacugagggacuccuggaguggugcaagcguaaucuuggccugaccugugacgauaacuuuuuccagaagagaauugaagaguuuuucuugacaggugaaggguacuuuaaugaggugcuccaauucaaaacccccagcacuccuggaucaacagaaccaacgcacgcugaggcccccaccgucaagccguuuaaaaguuauuucgcaaggggcuuucugacuaucaacuccggcuacuucagcgccaagugcuauucuuggacaucaaauaguggguuacagcugauaaacgugacccagcauccugcucggauugcggacacaccaggacccaaaaucacuaaucucaagaccauuaacuguaucaaccuuaaagcaagcguauuuaaggagcaccgcgaaaucgagauuaauguucuguugccucaaguggccgucaaccuauccaauugccaugugcugauaaagucucacgugugugauuacucgcucgacaucgaugguacgauuagacugcccaggaucuaccacgaaggcaccuucauaccagggacauauaaaauugucaucgacaagcgggauaaacagaacgaccgcugcacucuuguuaccaauugugugaucaagggacgagagguaagaaaaggccagagcgcucugaggcaguaccggacagaaauucguaucgguaaggccuccgcagggucacgcagauugcucagugaggagucuggcgacgauugcauuagcaggacucaacuguuacggaccgaaacggccgaggugcauggagacaacuauggcgggccuggagauaagauaacaaucuguaaugguuccaccauugucgaccagcgacugggcucagaacuagggugcuacacuaucaaccgcgugaaaucuuuuaagcucugcgagaauagcggaacaggcaaauccuguaagaucgauaaacaccccguuaagugcagacaggguuucugucugaagauuacccaggaggggaggggccaugugaaacuuagucggggaagcgaagucguguuggacgcuugcgauucuuccugugagauaaugaucccaaagggcacuggggacauucugguagauugcucaggaggucaacagcacuuccucaaagacaaccugguugaucuuggcuguccgaauaucccucuguuggggaagauggccauuuauaucugccgcaugaguaaccaucccaaaaccacaauggcauuucucuucugguuuagcuucggauacgugauaacguguaucuuuugcaagauuaucuucuaucuguuaauugucgugggcacccuggguaagaaauuuaagcaguacagagaacuaaaaccacagacuuguacaaucugcgagaccacacccacuaaugcgauagacgcugaaaugcacgaccucaagugcucguacaacauuuguccuuauugcgccuccaggcugaccucugaugggcuugcacgucacgucacgcaauguccaaaacggaaggagaaaguggaggaaacagaguuguaccugaaucucgaacgaauccccuggauuguuagaaagcuguuacaggugagcgagucaaccggcguagcccugaagaggaguuccuggcuuaucgucuugcucgugcugcuaacuguuucucugagcccugugcaguccgcuccgauaggacauggcaaaaccaucgaagccuaucagacacgcgagggguacacuucagucugccucuucaugcugggaggcauucuuuuugugguaagcuguuugaugaagggucugguggacaguguuucuaacuccuucuuuccaggguuaagcaucugcaaaaccuguucgauuggaucagucaacggcuucgagaucgaaucucacaagugcuauuguagucuccugugcugucuuuacugccggcauugcuccgcagauagagagauacaccaacugcacuugagcauuuguaaaaagaggcgcgcugguggcaaugugaugcucgccgugugcaagcgaaugugucugcgggcgacaauggaagucucuaacaaaguucuauuuauccguagcaucauuaauacgaccuucgugaucugcauucuggugcucgccguauguauagucuccacuucagcuguggagauggaaagucugcccgcagggacaugggagagagaggaagaccuuaccaacuucugccaucaggagugucagguuacugaaacagagugcuuguguccuuaugaggcccugguguuaaggaagccacucuuuagcgauucuaucgucaaaggaaugaagaaucugcuuaacuccaccucacuggaaacgagucuaagcauugaggcucccuggggcgccaucaaugugcaauccacuuucaaaccuaccguuucuacagcaaacauugcgcucucguggagcucaguggaacaccgcgggaauaagauccugguauccggacggagugagucuauaaugaaguuggaagagagaaccggcaucagcugggaccugggugucgaggaugccuccgaaucaaaauuacucacugugucugugauggaccugagccagauguacaguccggucuuugaguaccuuuccggggauaggcagguugaagaguggcccaaggcuacaugcaccggagacuguccagaucgaugcggcugcacaagcucuacuugucugcauaaagaauggccucacucacgcaacuggcggugcaaucccaccugguguuggggugugggcacggggugcacauguugcggauuggacguaaaggaucucuucaccgacuauauguuugugaaauggaaggucgaguacauuaagacugaggccaucguguguguugaacugaacucccaggagagacaaugcagucuaauugaagcaggcaccagguucaaucuggggccagugacaaucacucuuagcgagccucguaacauacagcagaaacuacccccagaaauuaucacccugcauccgcgcaucgaggagggauuuuucgacuugaugcacguccagaaggugcugucggcuucuacgguuuguaaauuacaauccugcacacacggcgugccuggugaucuccagauuuaucauauagggaaucugcuuaagggagaccgggucaacggccaccugauccauaaaauugaaccccacuuuaacaccagcuggaugucaugggaugguugugacuuggauuacuauugcaauaugggcgacuggccaaguugcacuuacacagggguaacccagcauaaccacgccgcauucgugaaucuccugaacaucgagacugauuauacaaagaauuuucacuuccauucuaaaagaguuaccgcccacggagacacgccccagcuagaucugaaggcuaggccuacuuacggcgcgggggaaauuaccgugcuugucgagguggccgacauggagcuccauacaaagaaaaucgcaauauccggacugaaguuugcuagcuugaccuguacaggcugcuacgccuguucaagugguaucagcugcaaaguacggauucacguggaugaaccagacgaguuaacuguccacguuaaguccgaagaucccgacaucguggccgcuucuagcucccugauggcacgaaaacucgaguucgggaccgacucaacguucaaggccuuuucugcgaugccuaagacaagucuguguuucuauauuguggaacgcgaguacugcgagucguguagcaaagaagauacucaaaagugcgucaacaccaaacuugagcagccgcaguccauccugauagaacauaagggaacaauuaucggcaaacaaaaugacaccuguacugcuaaggccucuugcugguuggagucaguuaagagcuuuuucuauggccucaaaaacaugcuguccgggaucuuuggaaauguguucauugguaucuuucucuuccuggcaccauuuauacuuuuaauucuguucuuuauguucggcuggagaauccucuucuguuuuaagugcugcaggcggacccgaggguuguucaaauacagauaucugaaggaugacgaagagaguggauaccgcaggauuaucgagcgucucaacaauaaaaagggcaagaacaaacugcuugauggugaacggcuggccgacagaaggauagcugaguuguuuucuacaaagacgcacauuggguga

SEQ ID NO: 10286 - RNA, 5070 nt, Artificial Sequence
  derived and/or modified CDS sequence (opt3) from CCHFV(BA88166)__AF338470.1__GP
augagcuucuccgugauguacacuccccugcucugcgccguccuuugucugcaguuguggucuuuagagggcucacacgggcugaguaacaagacacaacauagcaauacuuccacgaccaaagcuccugaaguuucucaggagcuaggacucccagugucgacaguaucaacuaucaccagcgacccgcccaguauuacauccgcagugucugucagcgguuccgaaggcucaggggauaccaacaccaguccuagcgugacaacccagggaccaacgcugcccgagacuacccuugaaccucugacaacuaccgacacagaugccucuuccaccguuguggucgacgugucaacgcagacuguaaaggauacaccaauaagcaccacuuauacaaguuugcccucuaccccuuccgagccaacgaccccgcaaggcacacaccauacugcgagaggucuccugagcguuaccucgacaaaacccgaggaggcuucuacucaggccaauccugggaagaucuccauggagaccaacucaccaaggcuggcaauuagugaaacacccagcuuuuccccuaccacucaggccccaacggaaaauucuaaccccaucacaagcaaacagcucauguuaucagcucaaccggugaccccuaaucccaugaccaguccaguccagccugcacugucccagagcgacacuucuacagccauucaggauauccaccccucaccaaccggacggaguaagcgcaaccuugagauggaaauaaucuugacucugagccaaggccuaaagaaauacuauggcaagauucucaaacugcuugaccugacauuggaggaagauacggaggggcuccuggaauggugcaagcgaaauuuaggacuggugugugacgauaacuucuuucagaaacguaucgaggaguucuuucucaccgguaagggccauuucaaugaagugcuucaguuuaagacucccuccacacugucuccuaccgggccagcuagaacaggaucgccgacugucgagcccuucaaaagcuacuuugccaagggcuucuuguccauggacucagguuauuuuagugcgaaaugcuacccuagggcaucuaacagcgggcuacaacugauuaauguuacccagcacuccacgcggaucaccgauacaccaggacccaagauaacuaaccucaaaaccauuaauuguaucaaccugaaggccucaguguucaaagaacaccgcgagauugaaaucaacguacuucugccucagguggcugucaauuugagcucuugccaugugcucaucaagucccacguuugugacuauagucuggacauugauggcccagugagauuacccaggauacaucacgagggcacauuuaucccggggacuuacaagauugucaucgacaaaaagaacaaacagaaugaucggugcacccuggugacgaacuguguaauaaagggacgcgagauucgaaaaggucaaagcguucuaagacaguacaggacagaaaucaagaucggcaaggccucuuccgggucacggcgucuccugagugaggaaagcggagacgauugcauuucgcgcacccagcuuuugagaacugagacagcagaaauccacuccgacaauuauggcgguccuggggauaaaauuaccauauguaacggcucuacuguggucgaccagaggcugggaagcgagcucggcugcuacaccaucaaucgggugaagucauucaaacugugcgagaacagugcuacagggaaguccugugaaauugauucuacgccagucaaaugccgacaaggauucugucuuaagaucacccaggagggucgcggccaugugaagcugagcagaggguccgaaguuguguuggacgccugcgauucaagcugugagaucaugauucccaaaggaacuggcgacauacucguagacugcaguggugggcagcagcacuuucugaaggauaauuuaaucgaccugggcuguccuaacauuccccuacucggaaaaauggcgaucuauauuugcaggaugucuaaucauccaaagacaaccaugggcuuccuguuuugguucuccuuuggguacgucgugacauguauccuuugcaaaggaauauucuauuugcugaucguuguggguacucucggcaagaaguuuaaacaauaccgggagcugaagccucagaccuguacgauuugcgaaacaacccccgucaacgccaucgaugcagagaugcacgacuuaaauugcagcuauaacauuuguccauacugcgcuucgcgccugacuucagaugggcuugccagacaugugaugcaguguccgaaaaggaaggaaaagaucgaggaaaccgaguuguaccucaaucuggagcguauaccuuggguagugcggaagcuacugcagguuucugaaaguacaggagucgcucucaaacgauccagcuggcugguggugcuuuugguccuguuaacuguuucucucagccccgugcaauccgccccaauuggccacgguaagaccguggagacauaucagacgagagaaggguacaccucaaucugccuguucguacuuggcaguauucuguuuaucgucagcuguuugaugaagggacucguggacucuguuggcaacuccuucuuucccgggcugucaauaugcaaaacuuguaguaucggaagcgugaacggcuucgagauugaaucccacaagugcuauuguucucuauuuugcuguccuuacugcaggcauugcucggcagaucgcgagauccaccggcugcaucucagcauuuguaaaaagagaaaaacauggucaaaugucaugcuggccgugugcaagaggauguguuuccgcgcuaccguugagguguccaacaaggcgcuuuugauccgaaauauaauuaacacuacauucguacugugcaucuuaauccucgcagucuguguggugaguaccucugccgucgaaauggagagccugccagcugguacgugggaacgggaggaagaccuuacuaauuuuugccaccaggagugucaaguuaccgagacagaaugccugugucccuaugaggcccuagugcuccguaaaccucuguacuuggauuccauuguaaaggggaugaaaaaccuguuaaauucaaccucucucgaaacuagccugaguaucgaggcaccguggggagccauuaacgugcaguccacauucaagccaaccaugagcgcugccaauauagcacuuucuuggucauccgucgagcacagaggcaacaaaauccuggugagugguaggagcgaaucgauuaugaaguuggaggaacgcacaggcaucucuuggaaucucgggguugaggacgcguccgaaagcaagcugcuaacugugucagucauggaucugagucagauguauucucccguguuugaguaccuuuccggagaccggcagguugaggaauggccuaaagcuaccugcacgggcgauuguccagagagaugcgggugcacaagcucaaccugucuccauaaggaauggccccacaguaggaacuggcgaugcaauccuacuugguguuggggagugggcaccgguugcacauguugcgggcuggacgucaaagacuuguucacugauuacauguuuauuaaguggaaaguagaguauaucaagaccgaagccauaguguguguugagcugacgagccaagagcgccagugcacauuaaucgaagcaggaacccgguucaaccucggcccggugauuaucacucuguccgagcccagaaauauucagcagaaacuuccaccugaaaucgucacacugcaucccaggauagaggaaggcuuuuucgacuugaugcacgugcaaaaaguacucucugccagcaccguguguaagcugcaguccugcacucauggugucccaggggaucuacagguuuaccacauuggaaaccugcuuaaaggcgacaaggugaacgggcaccucauccauaaaaucgagccucacuuuaauacaucauggaugucuugggauggaugugaccuggauuauuacugcaacaugggcgacuggcccaguugcaccuauacgggugugacucagcauaaucacgcugccuucgucaacauguugaauauugagaccgauuacacaaagaacuuucauuuccacucgaaacgugugaccgcacacggggacacaccacaauuagaucugaaggcucgcccgacuuauggagccggcgaaauaaccguucucguagagguggcggacauggaacugcauacgaagaaaaucgagauuagcggucuuaaguuugccucccugacauguacuggcugcuacgcuuguucuucagggaucagcugcaaaguccggauucacguggaugagccugacgaauugaccguucaugugaaguccgaggaccccgauaucgucgcagccaguucuagccuaauggcuagaaaacuggaguucggaacagacucaaccuucaaggccuuuuccgcaaugccaaagaccagucucuguuucuacauaguggaaagggaauauugcaaaagcuguucuaaggaggauacucagaaaugcguaaauacaaagcuggagcagccccaauccauccuuauugaacacaaaggcacgaucauugggaagcagaacaauacuuguaccgcgaaggccucaugcugguuagagagcgucaaaucguuuuucuacggacugaagaacaugcucucuggcaucuuugguaauguguucauagggguuuuucuuuucuuugcuccuuucauucugcucauccuguuuuucauguucggauggcgaaucuuguuuuguuucaaaugcugccggcgcacaagaggccuguuuaaguauaggcacuugaaagacgaugaagagaccggcuaccggaagauuaucgaacgacuaaacaauaagaaagggaagaacaaacugcucgacggagagagauuagccgaucgcaagauagcagagcuguucaguacuaaaacacauauugguuga

SEQ ID NO: 10287 - RNA, 5070 nt, Artificial Sequence
  derived and/or modified CDS sequence (opt3) from CCHFV(UCCR4459)__KY484032.1__GP
augagcuucuccaucauguacacuccccugcucugcgccgugcuuugucugcaguuguggucuuuagagggcucacacgggcugaguaacaagacacaacauagcaauacuuccacgaccaaagcuccugaagucucucaggaguuuggacuaccaguuucgacagugucaacuauuaccagcgacccgcccaguauaacauccgcaguaucugugagcgguuccgaaggcucaggggauaccaacacuucaccuagcgucacaacccagggacucacgcugccagagacuacccuugaacuguugacaacuaccgacacagaugccucuuccaccgugguuguggacgucucaacgcagacugugaaggauacacccaucagcaccacucacacaagucucccuucuaccccauccgcgacgaccacaccccaaggcacucaucacaccgcuagaggucugcugagcguaacaucgacuaaaccugagggggccucuacccaggcaaauccagagaagauuuccauggaaacaaacucaccgaggcucgccaucagugagacccccagcuucuccccuacuacgcaggcuccaacagaaaauucuaaccccauuaccagcaaacaguuaaucuuuucagcacaaccuguuacuccaaaucccgugaccccgccuguccagcccgcccugagucaguccgacacaagcaccgcuauacaggauauccauccaucuccuacuucacggaguaagcgcaaccuugagauggagauuaucuugacacugagccaaggacuaaagaaauauuacggcaagauucucaaacugcuugaccugacguuggaagaggauaccgaaggccuccuggaguggugcaagcgaaauuuagggcuggugugugacgaugacuucuuucagaaacguaucgaagaguucuuucucacuggagagggucacuucaacgaagugcuucaguuuaagacacccuccacccugucuccaacaggccccgccagaacugggucgccuaccgucgagccauucaagagcuauuuugcgaaaggauucuuguccauggauucaggcuacuuuagugcaaagugcuauccgagggccucuaauagcggucuacaacugauaaacguuacgcagcacuccacccggauuacagacacucccgggccuaaagugaccaaucucaagacaaucaacuguauuaaucugaaagcuaguguauucaaggaacaucgcgagaucgaaaucaacgugcuucugccacaggucgccgugaacuugagcucuugccacguucucauuaaaucccaugugugugacuacagucuggauauagacggacccgucagauuaccuaggauccaccacgagggcacuuucauuccaggcaccuauaagcuggugaucgauaagaaaaauaagcagaacgaccggugcacgcuaauaacaaauuguguaauuaaagggcgcgagauccgaaagggacaaagcguucucagacaguacaggaccgaaaucaaaauugguaaggcaucuuccggcucacggcgucugcuuagugaggaaagcggggaugacugcaucucgcgcacucaguuguccagaacagagaccgcugaaauucauucugauaacuacggaggccccggugacaagauaacuaucuguaaugggagcaccauuguggaucagaggcugggcucagagcucggaugcuauacaaucaaccgggucaaaaguuuuaagcugugcgaaaauuccgccacgggcaaaucuugugaaaucgacagcaccccgauuaagugccgacaaggguucugucuuaaaauaacucaggagggacgcggucacgugaagcuguccagaggcucagaagucguguuggaugcgugcgacagcaguugugagaucaugauuccuaaggggacaggagacauccucguugauugcucuggcggucagcagcauuuucugaaagacaacuuaauugaucugggguguccaaauaucccccuacucggcaagauggccauauacaucugcaggauguccaaccacccuaaaaccacaauggcauuccuguuuugguucagcuuuggauaugugauuacuuguauccuuugcaagguaauuuucuacuugcugaucgucgugggcacccucgggaaaaaguuuaagcaauaucgggagcugaaaccccagacguguacaauaugcgaaaccacuccaguuaaugcuauugacgccgagaugcaugauuuaaacugcucguacaauaucuguccuuauugcgcuucacgccugaccucugacggacuugccagacacgugaugcagugucccaagaggaaagaaaaggucgaggaaacagaguuguaccucaaccuggagcguauuccaugggugguacggaaacuacuucaggugagugaauccacugguguugcacucaagcgaagcucuuggcuggucgugcuuuuggugcuguuaaccgucagccucuccccgguucaaucagccccuaucggccacgggaaaacaguggagacguaccagaccagagaaggauauaccaguauaugccuguucgugcuuggcagcauccuguuuauuguaucuuguuugaugaagggucucgucgauuccgugggcaauucauucuuucccgggcugaguaucugcaagacauguagcauuggauccaucaacggcuucgagauagaaucucauaaaugcuacuguucgcuauucugcuguccauauugcaggcacugcagcgcugaccgcgagauucauaagcugcaccucucaaucuguaaaaagcggaaaaccggguccaacguuaugcuggcggugugcaagagaauguguuuuagggcaacugucgaggugaguaauaaggcccuuuugauccgcaacauuaucaauacaaccuucguugugugcauucugauauuagcuguaugugucgugucuacgagcgccguggaaauggagucccuccccgcaggaacuugggaacgagaggaagaucugaccaacuuuugccaccaggagugucaagucacagagaccgaaugccuuuguccuuacgaggcccugguucuacggaaaccacucuucucagacucuaucgugaagggcaugaaaaaucuguugaacagcacaagucuggaaacuuccuuaagcauugaggcucccuggggugccaucaauguacagucuaccuuuaagccuacagugucagcagcgaacauugcucucuccuggaguagcgucgagcaucgugggaauaaaauccuggugucgggaagaucugaauccauaaugaagcuggaggaaaggacuggcaucagcugggaucuggguguugaggacgccucagaaaguaaguugcucaccgugucuauuauggaucugucccagauguauagcccggucuucgaguaccuaucaggcgaccgccagguggaggaauggccaaaagcaacgugcacaggggacugucccgagcggugcggaugcaccaguagcacuugucugcacaaggaauggccucauuccagaaacuggaggugcaauccaaccugguguuggggcguugggacaggaugcacuuguugcggccuugaugugaaagaccucuuuaccgauuauauguucgucaaguggaaaguagaguacaucaagacggaagccauuguguguguugagcugacaucucaagagcgacagugcagcuugaucgaagcugguacccgcuuuaaccuggggcccgugacuauaacauuauccgagccucggaauauucagcagaagcucccgcccgaaaucgucacccugcacccaagaaucgaggaaggauucuuugaccuuaugcaugugaaaaagguacugucagccucuacuguguguaaauugcaaaguugcacacacggcgucccuggugaucuccagguuuaccacauuggcaaccugcuaaagggggacaaagugaauggacaucugauacacaagaucgagccccauuucaacaccucguggaugagcugggauggcugugaccuugauuauuacugcaacaugggggacuggccauccugcucuuauacgggagugacucagcacaaucaugcagcuuuugucaacaugcucaauauugagaccgauuacacaaaaaucuuccacuuccacucaaagagggugaccgcccauggcgacacaccucagcuggauuugaaggcgcgucccacuuauggugccggggaaauuaccguuuuaguagagguggcugacauggaacugcacacgaaaaagaucgagauaagcggacucaaauuugcaucccugacauguacuggcugcuacgccuguaguucugguaucagcugcaagguccgcauucauguggacgagccagaugaacuuaccguucacgugaaaucagaggacccggauaucgucgcugccuccaguagccugauggcacggaaguuggaguucggcacagacucuaccuuuaaggcguucuccgccaugccuaaaacuucacuauguuuuuauauuguggagagagaauacugcaagagcuguucgaaagaggauacccaaaagugcguaaacacaaaacuggagcagccccagucuauccucauagaacacaaggggacgauuaucggaaagcaaaaugacacuuguaccaguaaagcuggcugcuggcuggaguccgucaagagcuucuuuuacgggcuuaaaaacauguuaucaggaaucuucggcaauguguuuauugguaucuuccuguuucucgccccauucauauugcugauucucuucuuuauguucggguggaggauccuguuuuguuucaagugcugccgacggacacgcggacuuuuuaaauauagacaucugaaggaugacgaagagaccggcuacaggaagauuaucgaacgguugaacaauaaaaagggcaaaaacaagcuacuggauggggagcgacucgcagacagaaaaauagcugaguuauucuccacuaagacacacauuggauga

SEQ ID NO: 10288 - RNA, 5070 nt, Artificial Sequence
  derived and/or modified CDS sequence (opt3) from CCHFV(K168_125)__KX013460.1__GP
augcccaucagcaccaugcacauuucccugaugugcgccgugcucugucuucagcuguacggccucgggggaacacaugguuuacacaacggcacugagcauaauaagacgaacgcugucaccacaucuucaaauagucaaagcuccgaaucuccugcaagaacugccccaccgguuacccccgacucgccuacagugaccccaacuacacccgcgucagcuccugaggggagcggagaagcccacaguuccccacccaacaauaccgagggcccuucucugccagaaagcacguccgagccgcccgcagccacuucaaccgguauaccuagugcuagcgauguaaacucuuccacacaggcagccagggacacuucaaccccaacagugcggaccagucccccuaauagcccaucuacgcccccgacuccucaggagacacaucaccccguccgcaaccuacucuccgugaccagccacaaaccagaagagacuucggcuccuucugaauccgggaaggagucacccgccgcgaauaguccacaucccguugcaagccgaccuccaacaccguccaccacggcccagggacccaccgagaacaauaacuauaauacaacuggccaacuggaaucucuuacccagagcacaacucugggcccuaugaccucauugacacagaccgaucucccacagagugugacuuccaucgcuguccaagacacgcaccccagcccuacaaaccguucuaaaagaaaucuggagauggaaauuauccugacccucccacagggguuaaagaaauacuauggaaaggugcugaggcuuuugcagcugacucuagaggaagauaccgagggucuccuggaguggugcaagcggaaccuuggccuggacugugaugacacauucuuucagaaacgcauugaagaguucuuuaucaccggggaaggacauuucaacgagguauugcaauuuagaacucccggcacacucucaacgaccgaaaguacucacgccggucugccgacagcagagccuuucaagagcuacuuugcuaaaggguucuuauccauagauucuggauauuuuucggccaagugcuacagcaggaccuccaauucaggccugcagcucaucaacguuacacggcacaguacucgcauugcggacaccccaggccuuaaaaucacgaaucugaagaccauuucuuguaucaacuugaaggccagcguguucaaagagcaucgagaagucgagauaaaugugcuacugccccagguggcagucaaccucuccaauugccacguuacaauuaagucacaugugugugauuauagccuggacaucgaugggacuguaagacuuccucacauucaucacgacggaaccuuuauccccgguacauacaaaaucgugauugacaggaagaacaaacugaaugaucggugcacuuuguucaccaacugugucauaaagggccgugaagugcgcaaagggcaaucuguucucagacaguacaagacggagaucaggauuggaaaggcuuccacaggcagucggcgacuguuaagcgacgaaucuggugaugacugcaucucccgcacccagcugcuaagaacugagacagccgagauacacggggauaauuauggcggaccaggcgacaaaauuaccaucuguaacgggucaacuaucguggaucagaggcucggaagugaacuggguugcuacaccauuaaucgggucaagagcuuuaaacuuugcgagaacucggcuacaggcaaguccugugaaguggacucuaucccuguaaaaugccgccaaggguauuguuugaagauuacgcaggagggaagaggccauguuaagcugagcagggguucagaggugguccucgaugccugcgacaguuccugugaagugaugauacccaaagggaccggcgauauccuggucgacugcucuggaggccagcagcacuuccuuaaggacaaucugauugauuugggguguccaaaagugccgcuccugggaaagauggcaaucuacaucugccguaugagcaaccauccuaaaacuacaauggccuucuuauuuugguucuccuuugguuauguuauuaccuguauagugugcaaggcuaucuucuaccugcuaauuaucguaggcacacucgggaagcgguuuaaacaauaucgagagcugaagccccagacuuguaccauuugcgaaacgacaccaaccaacgcgaucgacgcagagaugcacgaucuuaauugcucauacaacauaugucccuacugcgccagcagauugaccagugacggacuggcuaggcacgucacccauuguccuaaacgcaaggaaaaaguggaggagacagaacucuaucugaauuuagagcggaucccauggguugugagaaagcugcuucaggucucugaauccacuggcguggccuugaagaggagcucguggcucauuguacugcuagugcuguucgcaguuucacucucucccguccagagugccccuaucggucacgggaaaaccauugagacauaccaagugcgcgaagaguauacguccaucugccuguuugugcuuggcagcauauuguucauugucucuugucugaugaagggauuaguuaacagcgugggcaauaucuuuuucccggggcucuccauuugcaaaaccuguucaaucggaaguauaaacggcuuugagaucgaaagccauaagugcuacuguucucugcuuugcuguccauauugccgacacugcuccgcugaucgggagauucaucagcugcacuugucaaucuguaaaaagcguaaaacugguaguaaugugaugcucgccguaugcaagagaauguguuucagggcaacagucgaagugagcaacaaggcgcuguccauucgcucuaucauaaauaccacuuuuguugugugcauucuaauccuggcugucugugugguuucgacaagcgccguggagauggaaucacuccccgcagggaccugggagcgggaggaagaccugacgaacuucugccaccaggagugucagguaacugaaaccgagugccuuuguccuuacgaggccuugguccugagaaggccauuauuccucgauuccaucgugaaaggaaagaaaaaucugcuuaacaguacaucucuggaaaccagccuauccauugaggcucccuggggcgccaucaaugugcaaucaacuuauaagccuacagucucugcagcuaacauugcccucagcuggaguuccguugaacaucgagguaauaaaauacuggugagcggccgcucugagucaaucaugaaguuggaagaacggaccgggauuuccugggaccugggaguagaggaugcgagugaaagcaaguuacucacagugucggucauggaccugucucagauguacuccccgguguuugaguaccuuagcggcgauagacagguugaagaguggcccaaagccacuugcaccggggacuguccagaaaggugcggaugcacgucaaguacaugucugcacaaggaguggccucauucucguaacuggcgcugcaaccccaccugguguuggggcguggguacugggugcaccuguugcggauuggaugucaaagaccucuucacagacuauauguuugugaaguggaaaguugaguacaucaagacugaagcuauugugugugucgagcugaccucccaagaacggcagugcagccuaaucgaggcaggcacgagauucaaucuggguccaguaacaauaacccuuucagaaccuaggaacauccagcagaaguugcccccagagauuaucacucugcacccgcgaauugaggaaggcuuuuucgauuugaugcaugugcaaaaaguucugagugccagcacaguguguaaguuacaguccugcacccacggggucccuggagaccuccagguguaucacaucggcaaucugcuuaaaggggauaagguaaacggacaucugauacacaaaauugagccccauuuuaauacuucuuggaugagcugggacggcugugauuuggacuacuauugcaacaugggugauuggccauccugcacauacaccggggugacgcagcacaaucacgcuucauucaucaaccuccugaauaucgaaacugacuauaccaagucuuuucauuuccacaguaagcgggucacagcccauggagauacuccccaacuagaccugaaagcacgcccuaacuacggcgcgggugagauuacaguucuuguggagguggccgauauggaacuccacacuaagaaaauagagaucucgggccugaaguuugcuagcuugaccuguacggggugcuacgccuguuccucuggaauuucaugcaaagucagaauccauguggacgaaccagaugaguuaacaguucacguaaagagcgacgaccccgauguggucgcagcuuccaguucucugauggccaggaaacucgaguucggcacugacagcaccuuuaaggcauucucagccaugccuaagacaucccuguguuucuauauuguggagcgggaguacugcaaaaguuguagcaaggaagauacccagaaaugcguuaauacuaaacuugagcacccgcagucuauccugauagaacauaaggggaccaucauuggaaagcagaacaauacauguacggcuaagacuuccugcugguuggagucagugaaaucguuuuucuauggccuaaagaacaugcugagcgguaucuuugggaaugucuucgugggaauuuuucucuuccuggcgccauuuauccuuuuaauacuguucuuuauguucggcuggcgaauccucuuuuguuucaaaugcugcagacgcaccaggggcuuguuccguuacaagcaccuggaagacgaugaggagacaggguaucggagaauuaucgaaaggcucaacaacaaaaagggaaagaauaaacugcuugacggugagcgccuggccgaucgaagaauugcagaauuguuuucuaccaagacucauaucggcuga

SEQ ID NO: 10289 - RNA, 5070 nt, Artificial Sequence
  derived and/or modified CDS sequence (opt3) from CCHFV(K168_40)__KX013457.1__GP
augcccaucagcaccaugcacauuucccugaugugcgccgugcucugucuucagcuguacggcuugggagggacacaugguuuacacaacggcacugagcauaauaagacgaacgcugucaccacaucuucaaauagucaaagcuccgaaucuccugcaagaacugccccaccgguuacccccgacucgccuacagugaccccaacuacacccgcgucagcuccugaggggagcggagaagcccacaguuccccacccaacaauaccgagggcccuucucugccagaaagcacguccgagccgcccgcagccacuucaaccgguauaccuagugcuagcgauguaaacucuuccacacaggcagccagggacacuucaaccccaacagugcggaccagucccccuaauaguccaucuacgcccccgacuccucaggagacacaucaccccguccgcaaccuacucuccgugaccagccacaaaccagaagagacuucggcuccuucugaauccgggaaggagucacccgccgcgaauaguccacaucccguugcaagccgaccuccaacaccguccaccacggcccagggacccaccgagaacaauaacuauaauacaacuggccaacuggaaucucuuacccagagcacaacucugggcccuaugaccucauugacacagaccgaucucccacagagugugacuuccaucgcuguccaagacacgcaccccagcccuacaaaccguucuaaaagaaaucuggagauggaaauuauccugacccucccacagggguuaaagaaauacuauggaaaggugcugaggcuuuugcagcugacucuagaggaagauaccgagggucuccuggaguggugcaagcggaaccuuggccuggacugugaugacacauucuuucagaaacgcauugaagaguucuuuaucaccggggaaggacauuucaacgagguauugcaauuuagaacucccggcacacucucaacgaccgaaaguacucacgccggucugccgacagcagagccuuucaagagcuacuuugcuaaaggguucuuauccauagauucuggauauuuuucggccaagugcuacagcaggaccuccaauucaggccugcagcucaucaacguuacacggcacaguacucgcauugcggacaccccaggccccaaaaucacgaaucuuaagaccauuucuuguaucaaccugaaggccagcguguucaaagagcaucgagaagucgagauaaauguguugcuaccucagguggcagucaaccuguccaauugccacguuacaauuaagucacaugugugugauuauagccucgacaucgaugggacuguaagacugccccacauucaucacgacggaaccuuuaucccagguacauacaaaaucgugauugacaggaagaacaaacuuaaugaucggugcacucuguucaccaacugugucauaaagggccgugaagugcgcaaagggcaaucuguuuugagacaguacaagacggagaucaggauuggaaaggcuuccacaggcagucggcgacuccugagcgacgaaucuggugaugacugcaucucccgcacccaguuacugagaacugagacagccgagauacacggggauaauuauggcggaccuggcgacaaaauuaccaucuguaacgggucaacuaucguggaucagaggcuaggaagugaacucgguugcuacaccauuaaucgggucaagagcuuuaaacugugcgagaacucggcuacaggcaaguccugugaaguggacucuauccccguaaaaugccgccaaggguauugucuuaagauuacgcaggagggaagaggccauguuaaguugagcagggguucagaggugguccuggaugccugcgacaguuccugugaagugaugauaccaaaagggaccggcgauauccucgucgacugcucuggaggccagcagcacuuccugaaggacaaucuuauugaucugggguguccgaaaaucccuuugcucggaaagauggcaaucuacauuugccguaugagcaaccaucccaaaacuacaauggccuuccuguuuugguucuccuuugguuaugugauaaccuguaucguuugcaaggcuauuuucuacuuacugaucauugugggcacacuagggaagcgguuuaaacaauaucgagagcucaagccacagacuuguaccaucugcgaaacgacacccaccaacgcgauagacgcagagaugcacgaucugaauugcucauacaacaucuguccuuacugcgccagcagacuuacuagcgacggauuggcuaggcacguaacccauuguccaaaacgcaaggaaaaagucgaggagacagaacuguaucucaaucuggagcggauucccugggugguuagaaaguuacuucaggugucugaauccacuggcgucgcccuuaagaggagcucgugguugaucgugcuccugguacuauucgcagugucacugucuccuguucagagugccccgauuggucacgggaaaaccaucgagacauaccaaguccgcgaagaguauacguccauaugccucuuugugcugggcagcauucuuuucaucgugucuuguuugaugaagggacuggucaacagcguuggcaauauuuucuucccaggguuauccaucugcaaaaccuguucaauaggaaguaucaacggcuuugagauugaaagccauaagugcuacuguucucuccugugcugucccuauugccgacacugcuccgcugaucgggagauccaucagcuucaccugucaauuuguaaaaagcguaaaacugguaguaaugugauguuggccgugugcaagagaauguguuucagggcaacaguagaagucagcaacaaggcgcucuccauccgcucuauaauuaauaccacuuuugugguuugcauccugauccuagcugugugugucgugucgacaagcgccguugagauggaaucacugccugcagggaccugggagcgggaggaagaccucacgaacuucugccaccaggagugucaggugacugaaaccgagugccuguguccauacgaggcccuuguauugagaaggccccuguucuuagauggaauugucaaaggcaugaagaaucuccugaacuccacaagucuugaaaccucucugagcaucgaggcuccuuggggugccauuaaugugcaauccacuuauaaaccgacagugucagcagcuaacauagcccuaucuuggagcagugucgaacaucgaggcaauaagauccucguuuccgggcgcagcgagucuauuaugaaacuggaggaacggaccggaaucucaugggacuugggcguggaggaugcguccgaaaguaagcuguuaacaguaagcgugauggaccucucgcagauguacucucccgucuuugaguaccuguccggggauagacagguggaagaguggccaaaggccacuugcaccggagacuguccugaaaggugcggcugcacgagcucaacaugucuucacaaagaguggccccauagucguaacuggcgcugcaacccaaccugguguugggguguugggacuggaugcaccuguugcggccuggaugugaaggacuuguucacagacuauauguuugucaaauggaagguggaguacauuaaaacugaagcuaucguuuguguggagcucaccucucaagaacggcagugcucccugauagaggcagguacgagauucaaucuaggcccugucacaaucacccugagcgaacccaggaacauucagcagaagcugccaccggagaucauuacucuccacccucgaaucgaggaaggguuuuucgaucugaugcauguacaaaagguguugucagccaguacaguuuguaaacugcagagcugcacccacggagugcccggcgacuuacaggucuaucacauagggaaucuccugaagggagauaaagugaacggccaucuuauucacaagaucgagccacauuuuaauacuuccuggaugucuugggacgguugugaucuggacuacuauugcaacaugggggauuggcccagcugcacauacaccggaguaacgcagcacaaucacgcuuccuucaucaacuugcucaauauugaaacugacuauaccaaaucauuucauuuccacucuaagcgggugacagcccauggcgauaccccucaacuggaccuaaaggcacgcccaaacuacggugcgggcgagauaacaguccugguugagguggccgauauggaacuucacacuaaaaagaucgagauuagugggcucaaauuugcuucgcugaccuguacgggaugcuacgccuguagcuccggcaucucuugcaaggugaggauucaugucgacgaacccgaugaguugacagugcacguuaaaucagacgacccugauguaguggcagcuagcuccaguuuaauggccagaaagcuggaauuugggacugacucuaccuuuaaagcauucagcgccaugccgaagacaucacucuguuucuauaucgucgagcgggaguacugcaaguccuguaguaaagaagauacccagaagugcgugaauacuaaacuggagcacccacagagcauacuuaucgaacauaagggaaccauuaucggcaaacagaacaauacauguacggcuaagacuucuugcuggcuggaguccguuaagucauuuuucuaugguuugaaaaacaugcuaagcgggauuuuuggaaauguguucgucggcaucuuucuguuccucgcgcccuuuauacugcuuauuuuauucuuuauguucggcuggcgaauccuguuuuguuucaagugcugcagacgcaccaggggacucuuccguuacaaacacuuggaagacgaugaggagacaggguaucggagaaucauugaaaggcugaacaacaagaaagguaagaauaagcuccuggacggcgagcgccuugccgaucgaagaaucgcagaacuguuuucgaccaaaacucauauaggguga

SEQ ID NO: 10290 - RNA, 5070 nt, Artificial Sequence
  derived and/or modified CDS sequence (opt3) from CCHFV(K128_76)__KX013454.1__GP
augcccaucagcgugaugcacauuucccugaugugcgccguccucugucuucagcuguacggccuagggggaacccaugguucucacaacgagacagaacauaauaagacuaacgcuguuacgaccucaagugacagccaauccccugagccaccgacaagaacuaccuuacccgugacaccugauucuccaaccguaacucccacaaccccugcaucggccccagaaggcucaggggaggugcacacgagucccccuaauacuaccgaaggaccaagucugccggaguccacacccgagccuccaacugcgaccucuacaggcauacccagcgcuuccgacgucaacucaaguacccaggccgcaagggauacgagcacuccuacagugcauaccucuccacccaauuccccgucaacuccucccacacuacaggaaacccaccacccaaugcggaaccuccugagcguuacgagucauaaaccugaggaaaccucugcccccuccgagagcgguaaggagucgccagcugcaaauucuccccacccuguggccgaccgcccauccacaucaaguacuaccgcucaggggccgacagaaaacaauagcuauaacacuaccgagcaacuugaaucccugacacagucuaccacuuugggacccaugacgagccucacacagaccguccugucacagagugugacuuccaucgccguacaagauacccaucugagcccuacaaaucgaucuaaacguaaccucgagauggaaauuaucuuaacccugccacagggccuuaagaaauacuauggcaagguuuugagacugcuacagcucacucuggaggaggacacagaagggcuucuggaguggugcaagaggaauuuggaucucgacugugaugacacguucuuucagaaacggauugaagaguucuuuaucaccggagaagguuacuucaacgaggugcugcaauuucgcacucccggcacauuaucaaccacagagaguacucacgcggggcugccuaccgcagaaccauucaagagcuauuuugccaaaggauuccucuccauagauucuggcuacuuuucggcuaagugcuauagcagaacguccaauucaggucuucagcugaucaacgucaccaggcacaguacacggauugccgacacucccgggccgaaaaucaccaacuugaagacaauuucuuguaucaaucuaaaggcaagcguguucaaagagcaucgcgaaguggagauaaacguccugcucccucagguugcugugaaucuguccaacugccacguaacuauuaagucacaugugugugauuacagccuugacaucgacggaaccgucaaacugccacacauucaucacgauggcacguuuauccccggcacauacaagaucgugauugaccgaaagaauaaguugaacgauagaugcacccucuucacuaauuguguuauaaaagggagggaagugcggaagggacaaucuguccugcgucaguauaagacagagauccgcauugguaaagccuccaccggcaguagaagguuacugagcgacgagucuggggaugacugcaucucccggacucagcuacuccgaaccgaaacagcggagauacacggagauaacuacggcgguccuggggacaagauuacgaucuguaauggcucaaccaucguggaucagcgccugggaagugaacuuggcugcuauacuauuaacagaguaaagagcuuuaaauugugcgaaaauucggccacagggaaauccugugagaucgacucuauucccguuaagugcaggcaaggauacugucugaagauaacccaggagggucggggccaugugaaacucagccgcgggucagaggucgugcuggaugcaugcgacaguuccugugaagucaugaucccaaagggaacaggcgacauucuuguggauugcucuggugggcagcagcacuuccugaaagacaacuugaucgaucucggcuguccuaagaucccccuguuaggaaaaauggcuauuuauauaugcagaaugagcaaucauccaaagacuaccauggccuuccuguuuugguucuccuuuggcuacguuaucacguguauugugugcaaggcuaucuucuaucuacucauuaucguagggacacugggaaaaagguuuaagcaauaccgugagcuuaaaccgcagaccuguacuauaugcgaaaccacaccuacuaacgccaucgacgcagagaugcacgauuugaauugcucauacaacauuugucccuauugcgccagccggcugaccagugacggucucgcucgacacgucacacauuguccaaagagaaaagagaagguggaagagacggaacuguacuuaaaccuggagaggauccccuggguugugcgcaaacuuuugcaggucucugaauccaccggcguggcgcucaaacggagcucguggcugauuguacuacugguucucuucgcagugucacugucuccuguccagagugccccaaucucccacgggaagacuauagagacauaucaagugagagaggaauacaccagcauuugccuuuuuguguugggaucuauccuguucauugucagcuguuuaaugaaaggccucguuaauuccguggguaacaucuuuuuccccgggcugucaauaugcaagacuuguaguaucggcagcauuaauggauuugagaucgaaucucauaaaugcuauuguucccuucugugcuguccuuacugcaggcacugcucagcugaucgcgagauucaucaguugcaccucaguaucuguaagaaacgaaagacaggcagcaacgugaugcuggccguaugcaagcggauguguuuccgugcaaccauggaagucuccaauaaagcccuauuuauaagaucuauuaucaacacgacuuucgugguuugcauccugauucucgcugugugugucgugucgaccagcgccguugagauggagucacugccggcagggacaugggaaagggaggaagaccuuaccaauuucugccaccaggagugucaggugacugagacagaaugcuuguguccauaugaggcgcugguauuacgccggccccucuuucaagauuccaucgucaagggaaugaaaaaccugcuuaauaguaccucucuggaaacaagccuauccauugaggcuccuuggggcgccauaaacgugcagucaacuuacaagccagcagugucugccgcuaauaucgcccucagcuggaguuccgucgaacauagagguagcaaaauucugguuucugggaggucagaguccaucaugaaguuggaggaacgaaccggaauuaguugggaccugggcguggaggaugcaagcgaaucgaaguuacucacgguaucugugauggaccugucccagauguacagccccgucuucgaguaucuuucaggugaucgccaaguggaagaguggccuaaagcuacaugcaccggcgacuguccggagcggugcgggugcacuagcucuaccugucugcacaaggaauggccccauuccagaaacuggaggugcaauccaacaugguguuggggaguuggcacugggugcaccuguugcggauuggacgugaaagaucucuuuacggacuacauguucgucaaguggaaaguggaguauaucaagacagaagccauaguuuguguggagcugaccagccaggaacgucagugcucacuaaucgaggcgggcacucgcuuuaaccuggguccugucacaauuacccuuagugagccccggaauauccagcaaaagcucccaccugaaauuaucacucugcaccccagaauagaggaaggguucuuugauuugaugcauguacagaaagugcugagcgccuccacaguuuguaaguuacagucuugcacccacggagugccaggcgaccuccaggucuaccacauugguaaccugcuuaaaggcgauagggugaacgggcaucugauccacaagaucgagccgcauuucaauacgagcuggauguccugggacggaugugauuuggacuauuacugcaacaugggcgauuggccuucaugcacuuauaccgggguaacacaacacaaucacgcuucuuuugugaaccuccugaauauugagaccgacuacacaaaaaguuuccauuuucacucgaagcgagucacugcacauggagauacaccccagcuagaccugaaggcccggccaaacuacggcgcuggugaaauaacgguucuuguggagguggccgauauggaacuccacaccaaaaagaucgagauuagcgggcugaaauucgcauccuugacuuguaccggaugcuaugcguguucuucaggcaucagcugcaagguccgcauucauguggacgaacccgacgaguuaacaguucacguaaaauccgaugacccugauguggucgccgcuaguucuagccugauggccagaaagcucgaguuugguaccgacucaacuuucaaagcauucuccgcuaugccaaagaccagucuguguuuuuacaucguggaaagggaguauugcaagagcuguucuaaagaagauacacagaagugcguuaauacgaaacuugagcagccccaauccauacugaucgaacacaagggcacuauuaucgggaaacagaacaauaccuguacagccaagaccucaugcugguuggagagcgugaagucguucuuuuacggauugaaaaacaugcugucuggcauuuucgggaaugucuuugugggaaucuuccucuuucuggcaccuuucauacuuuuaauucuguuuuucauguuuggcuggcggauccucuucuguuucaagugcugccgaagaacucgcgguuuguuuagguauaaacaucuggagaacgacgaagagacaggguaccgucggaucauugaaagacucaauaacaagaaaggaaagaauaagcugcuugauggcgagaggcuggccgaccgccgaaucgcugaauuguucaguaccaaaacgcacauaggcuga

SEQ ID NO: 10291 - RNA, 5070 nt, Artificial Sequence
  derived and/or modified CDS sequence (opt3) from CCHFV(Hodzha)__KX013448.1__GP
augcccgugagcaucaugcacauucugcucaugugcgccguccuuugucugcagcaauacggcuugggggagacccauagaccuaacaauggaacagaacacaacaagacuaauguuuuaacgaccccauccgacaaacugucuccggagcccccugugucaacagcucuaaguguaacuccagauagcuccaccgugacacccaccacuccugucucuggucucgaaggcucgggggagguguauacaucaccacccguuaccacgaagggacugagcccuaguaaagcaacuuccgaacuuccagccaccacaggcauagacacuucuagcgcguccgauguggacucaaguacccaggcugccagggauacaagcacccugacgguccggacuucuccgcccuccucaccuagcacaccacccaccagucaggacacuuaccauuuggugcgcaaccuccugucuguaacauccccucgaccagaggagaccacggcacccagcaagucggguaaagaaucuccgguugccaauuccccucaccccgugaccucacguccaaguagcccucccaucacaguccaggggccaacugagaacuccucucauaauaccacaggacaacuggaaagcauggcucagucaacuacccucgugcccauggcaaguccuacacagaccguguuaucccagagcgucacuucucuggccguucaagaugcucacccaucaccgacgaacagaaguaagaggaaucuugagauggagauuaucuugacacugccccagggccuaaagaaauauuacggcaaggugcuccggcugcuucagcugaccuuggaagaggacacugaagggcuccuggaguggugcaaacgcaacuuaggacuggauugugacgauaccuucuuucagaagagaauugaagaguucuuuaucacaggugagggccacuucaaugaaguacuccaauuuaaaaccccuagcacucuuuccacaacggagucuacccaugccgugucgccaacugcggaacccuucaagagcuauuuugcaaagggguuccuguccauagacucaggauacuuuagugccaaaugcuauucuaagacaagcaacuccggcuugcagcuaaucaaugucaccaggcacucaacacggauugcugauacuccugguccaaaaaucaccaaccugaagacgauuagcuguaucaaucucaaagccucuguguucaaggagcaucgcgaaguugagauaaacgugcugcuuccccaggucgcagugaaccuguccaauugccacguaaccauuaaaagucacguuugugacuacagcuuggacguggaugggacaguccgacucccgcauauccaccauggaggcacuuuuauuccuggcaccuacaagaucgugaucgacaagaaaaacaagcugaaugauagaugcacauuauauacuaacugugucauuaaagggagggaggugcggaagggacaaucuauacugcgucaguacaaaaccgaaauccgcauugguaaggcuuccacgggcucaagaaggcuacucagugaggaaagcggggacgauugcaucucgcggacacagcugcuucgaaccgagacugccgaaauacacggagacgauuauggcgguccaggggacaagauuacaaucuguaauggcuccaccaucguugaucagcgcuugggaucugagcugggcugcuacacuauuaacagagugaaaucauucaagcucugcgagaauagcgcgaccgggaaaaguugugaaaucgacuccacacccguaaagugcaggcaaggauauugucugaaaauuacgcaggagggucggggccaugucaaacuuucucgcgggagcgaagugguucuggaugccugcgacuccucaugugaggugaugauaccuaagggaaccggcgacaucuuggucgauugcagcggugggcagcagcacuuucucaaggacaaccugauugauuuaggcugucccagaaucccacugcuaggaaagauggcaaucuacauuugcaggaugaguaaucacccugagacuacaauggcuuuccucuucugguuuucuuucggcuaugugauaaccuguauccugugcaaagccaucuuuuaccuuuugauuauuguagggacacugggaaagcguuucaaacaauaccgggaacucaagccccagacuuguaccaucugcgagacgacaccagcuaacgccauagacgcagaaaugcaugaucugaauugcuccuauaacaucuguccguacugcgccagccgauuaaccucggacggucuggcuagacacgugacucaguguccuaagaggaaagagaagguugaagagaccgagcuuuauuugaaucucgaacgcauucccuggaucguccggaaacugcuacaggugucagagucuacaggcguggcgcugaagagaaguuccuggcucauuguccugcuuguuuuguuugcagugagccugucuccagugcaaagcgcccccaucgggcauggaaaaacuauagaaaccuaccaggcuagggaggaauauacauccauuugcuuauucguacucggcucaauccuguuuauugucaguugucuuaugaagggucugguggauagcaucgggaacauauucuuuccuggcuugacgaucugcaaaaccuguucuauuggauccaucaauggcuucgagauugagucacacaagugcuacuguagucuccugugcuguccauauugccgccacugccccgccgaccgagaaauccaucagcuacaccugagcauauguaagaaacggaagacuggguccaacguuaugcucgcagugugcaaacguauguguuuuagagccacaauggaggucucuaacaaggcucugcuuauuaggucgaucaucaauaccacuuucgugguuugcauuuugauccuggccguguguguagucagcacaucagcaguggaaauggaguccuuaccugcgggaaccugggaacgcgaggaggaucucacgaacuuuugccaucaggaaugucaagugacugagaccgaaugccuguguccguacgaggcucuuguccugcggagaccacuauuccucgacaguauuguuaaaggcaagaagaaucuguugaacucuacaagccuggagaccuccuuaucaauagaagcccccuggggugcaaucaaugugcagucuacuuacaaaccuacaguaagcaccgccaacauugcucucaguugguccagcguggagcacagggggaauaagauccuggucucuggacgaucagaauccauuaugaaacuugaggaacgcacaggcaucaguugggaucuggguguggaggacgccagcgagucgaaguugcucacuguuucugugauggaucugucccagauguauagcccagucuucgaauaccuaucaggcgaccggcaaguggaggaauggcccaaagcaaccugcacgggggacuguagugagagaugcggaugcacaucuuccaccugucugcauaaggaauggccucacagcaggaacuggcguugcaauccgacuugguguuggggcguugggaccggaugcacauguugcggccuugaugugaaggaccucuuuacugauuauauguucgucaaauggaagguagacuacauaaaaaccgaggcuaucguguguguugagcugacgucacaggaacgccagugcaguuugguggaggccgguacacgguuuaaccuggggcccgucaccauuacuuuaagcgaaccaagaaauauccagcaaaagcucccucccgagauuaucacacugcacccaaggauagaagagggauucuuugaucuuaugcaugugcagaaaguacuguccgcgucuaccguguguaaguugcagagcugcacucacggcgucccuggugaccuccagguuuaucauauuggcaaccugcuaaagggggauaaagugaauggacaccugauccauaagaucgagccccacuucaacacauccuggaugucaugggacggcugugaucuugacuacuauugcaauaugggggauuggccaucuugcaccuacacgggagugacucaacacaaccaugccaguuuugucaaccuccugaauauugaaaccgacuacacaaaaucguuccacuuucauagcaagcgagugaccgcucacggcgauacaccgcaguuggacuuaaaagcacggccuacuuauggugccggggagauaaccguucugguagaaguggcugacauggagcuccacacgaagaaaaucgagauuacaggacugaaguucgccucccuuacuuguaccggcugcuacgcauguucuucagguaucagcugcaagguccgcauucauguggaugaacccgacgagcugacaguucacgugaaauccgaugacccagaugucguggcggccaguucuagcuugauggcuagaaagcuagaauuuggcaccgacucaacuuucaaagccuuuuccgcaaugcccaagaccagucuguguuucuauaucguagagagggaauacugcaaaagcuguucuaaggaggauacacagaagugcgucaacacgaaacucgagcagccucaauccauacugaucgaacagaaggggacuauuaucggaaaacagaauaacaccuguacagcuaaggccucaugcuggcuugagagcgugaaaucguucuuuuauggcuuaaagaauaugcugucugggauuuucggaaacguuuuugugggcaucuuccucuuuuuggcaccauucauacugcucauucuguuuuucauguuugguuggcggauccuuuucuguuuuaagugcugccgaagaacccgcgggcuguucaaauacaagcauuugaaagacgaugaagagacuggauauaggcguaucauugaacggcuaaauaacaagaaaggcaagaauaagcugcucgacggcgagagauuagccgauaggcgcaucgcugagcuguucaguacaaaaacccacauaggguga

SEQ ID NO: 10292 - RNA, 5070 nt, Artificial Sequence
  derived and/or modified CDS sequence (opt3) from CCHFV(Hy13)__AY900145.1__GP
augagcuucuccaucauguacacuccccugcucugcgccgugcuuugucugcaguuguggucuuuagagggcucacacgggcugaguaacaagacacaacauagcaauacuuccacgaccaaagcuccugaagucucucaggaguuuggacuaccaguuucgacagugucaacuauuaccagcgacccgcccaguauaacauccgcaguaucugugagcgguuccgaaggcucaggggauaccaacacuucaccuagcgucacaacccagggacucacgcugccagagacuacccuugaacuguugacaacuaccgacacagaugccucuuccaccgugguuguggacgucucaacgcagacugugaaggauacacccaucagcaccacucacacaagucucccuucuaccccauccgcgacgaccacaccccaaggcacucaucacaccgcuagaggucugcugagcguaacaucgacuaaaccugagggggccucuacccaggcaaauccagagaagauuuccauggaaacaaacucaccgaggcucgccaucagugagacccccagcuucuccccuacuacgcaggcuccaacagaaaauucuaaccccauuaccagcaaacaguuaaucuuuucagcacaaccuguuacuccaaaucccgugaccccgccuguccagcccgcccugagucaguccgacacaagcaccgcuauacaggauauccauccaucuccuacuucacggaguaagcgcaaccuugagauggagauuaucuugacacugagccaaggacuaaagaaauauuacggcaagauucucaaacugcuugaccugacguuggaagaggauaccgaaggccuccuggaguggugcaagcgaaauuuagggcuggugugugacgccgauuucuuucagaaacguaucgaagaguucuuucucacuggagagggucacuucaacgaagugcuucaguuuaagacacccuccacccugucuccaacaggccccgcgagaacugggucgccuaccgucgagccauucaagagcuauuuugcaaaaggauucuuguccauggacucaggcuacuuuagugccaagugcuauccgagggcuucuaauagcggucuacaacugauaaacguuacgcagcacuccacccggauuacagauacucccgggccuaaagugaccaaucucaagacaaucaacuguauuaaucugaaagccucaguauucaaggaacaucgcgagaucgaaaucaacgugcuucugccacaggucgcagugaacuugagcucuugccacguucucauuaaaucccaugugugugacuacagucuggacauagauggacccgucagauuaccuaggauccaccacgagggcacuuucauuccaggcaccuauaagcuggugaucgacaagaaaaauaagcagaacgaucggugcacgcuaauaacaaauuguguaauuaaagggcgcgagauccgaaagggacaaagcguucucagacaguacaggaccgaaaucaaaauugguaaggcuucuuccggcucacggcgucugcuuagugaggaaagcggggacgauugcaucucgcgcacucaguuguccagaacagagaccgccgaaauucauucugacaacuacggaggccccggugauaagauaacuaucuguaaugggagcaccauuguggaccagaggcugggcucagagcucggaugcuauacaaucaaccgggucaaaaguuuuaagcugugcgaaaauuccgcgacgggcaaaucuugugaaaucgauagcaccccgauuaagugccgacaaggguucugucuuaaaauaacucaggagggacgcggucacgugaagcuguccagaggcucagaagucguguuggacgccugcgauagcaguugugagaucaugauuccuaaggggacaggagacauccucguugacugcucuggcggucagcagcauuuucugaaagauaacuuaauugaccugggguguccaaauaucccccuacucggcaagauggcaauauacaucugcaggauguccaaccacccuaaaaccacaauggcuuuccuguuuugguucagcuuuggauaugugauuacuuguauccuuugcaagguaauuuucuacuugcugaucgucgugggcacccucgggaaaaaguuuaagcaauaucgggagcugaaaccccagacguguacaauaugcgaaaccacuccaguuaaugccauugaugcugagaugcaugacuuaaacugcucguacaauaucuguccuuauugcgccucacgccugaccucugauggacuugcaagacacgugaugcagugucccaagaggaaagaaaaggucgaggaaacagaguuguaccucaaccuggagcguauuccaugggugguacggaaacuacuccaggugagugaauccacugguguugcccucaagcgaagcucuuggcuggucgugcuuuuggugcuguuaaccgucagccucuccccgguucaaucagcuccuaucggccacgggaaaacaguggagacguaccagaccagagaaggauauaccaguauaugccuguucgugcuuggcagcauccuguuuauuguaucuuguuugaugaagggucucgucgacuccguggggaauaguuucuuucccggcaguagcaucugcaagacauguuccauuggaucuaucaacggcuucgagauagaaucgcauaaaugcuacuguagccuguucugcuguccauauugcaggcacugcucagcggaucgcgagauucauaagcuacaccuguccaucuguaaaaagcggaaaaccgggaguaacguuaugcucgcagugugcaagagaauguguuuuagggccacugucgaggugucuaauaaggcucugcuuauccgcaacauuaucaauacaaccuucguugugugcauuuugauacuggccguaugugucgugagcacguccgcaguggaaauggagucauuacccgccggaacuugggaacgagaggaagaccucaccaacuuuugccaccaggagugucaagcuacagagaccgaaugccuguguccuuacgaggcccuuguccugcggaaaccacuauucucugauagcaucguuaagggcaugaaaaaucuccugaacaguacuuccuuggaaacaagccugucuauugaggcacccuggggugcgaucaaugugcagucaaccuuuaagccuacaguauccgcugccaacauugcauuaaguuggagcucgguggagcaucgugggaauaaaauccucgucucuggaagauccgaaagcauaaugaagcuggaggaaaggacuggcaucucaugggaccuugguguggaggaugccagugaaucuaagcuguugaccguuuccauuauggaccucagccagauguauucaccgguguucgaguaccugaguggcgaucgccaggucgaggaauggccaaaagcuacgugcacaggggacugucccgagcggugcggaugcaccagcuccacuugucuacacaaggaauggccucauucuagaaacuggaggugcaauccaaccugguguuggggcguggggacaggaugcacuuguugcggccuggacguuaaagaucuuuuuaccgaccacauguucgugaaguggaaagucgaguauaucaagacggaagccauuguauguguggagcucacaagccaagagcgacagugcucccugaucgaagcagguacccgcuuuaacuuggggcccguuacuauaacacugucagagccucggaauauucagcagaaguuaccgcccgaaaucgugacccuccauccaagaaucgaggaaggauucuuugaucugaugcacgucaaaaaggugcuuucugcuaguacuguauguaaacugcaaucgugcacacacggcgugccuggugacuugcaggucuaccauauuggcaaccuccugaagggggauaaaguuaauggacaccuaauacauaagaucgagccccacuucaacaccagcuggauguccugggacggcugugaucuggacuacuauugcaacaugggggauuggccaucuugcucauacacgggagugacucagcauaaucacgccgcguuugugaacaugcuuaauauugagaccgacuauacaaaaaucuuccacuuccauagcaagagggucaccgcccacggcgauacaccucagcucgaccugaaggcucgucccacuuacggugcaggggaaauuaccguguugguugagguagccgauauggaauuacauacgaaaaagaucgagauauccggacugaaauuugcuagucucacauguacuggcugcuaugccuguucuagcgguaucucaugcaaggugcgcauucacgucgacgagccagacgaacugaccgugcacguuaaauccgaggauccggacaucguggcagcgaguagcucucuuauggcccggaagcuggaguucggcacagauuccaccuuuaaggcuuucucagccaugccuaaaacuagcuuguguuuuuacauugucgagagagaauauugcaagucguguucuaaagaggacacccaaaagugcgugaacacaaaacuagagcagccccagaguauccugauagaacauaaggggacgauuaucggaaagcaaaaugauacuuguaccuccaaagcaggcugcuggcucgagagcguaaagucauucuuuuacgggcugaaaaacaugcuuuccggaaucuucggcaaugucuuuauugguaucuucuuauuucuggcuccauucauacucuugauucuguucuuuauguucggguggaggauccucuuuuguuucaagugcugccgacggacacgcggacuguuuaaauacagacaccuuaaggacgaugaagagaccggcuauaggaagauuaucgaacggcugaacaauaaaaagggcaaaaacaaguugcuagacggggagcgacuggccgauagaaaaauagcagagcuguucucuacuaagacacauauuggauga

SEQ ID NO: 10293 - RNA, 5070 nt, Artificial Sequence
  derived and/or modified CDS sequence (opt3) from CCHFV(SPU415/85)__DQ211635.1__GP
augcccgugaacaucauguacaccccucuggucugcgccguuauuugucuccagcuuuggaaucugggcgggacauugguguucauaaacagaacucaacacaaugagacgggaaccguagcuacaccagaagguacuuuaaggccgcggcugcccgugagcaccgcacuaccuacaaaguccgaccgcccaucugucggccccgccgcgucaaguagcgggcucgagggauccggcgaaccuaacaccucuccaucgaucacuacaaaaggucugacucccccugagacgacuccagcccuuccgaccgccacagauacugacgcaucaagcaccggggugguugaugugaguacacagaugaccaaggacauucccauguccacggccuauacuaauccuccaucuacacccagcgcuccuuccaccccacagggaacucaucacacagcacgaggccuguugucagucgccaguaccaaaagcgaagaggugucuauguccacgucacccgcuaagaccagcacagagaccaguucuccgccucccgccaccuccgaaacaccaacuccuagccccaccacacagguaccaaccggcaacaauaaccccaauacuucgcgucaaccuacgccaucugcgcagccggcaauguccaaccccgccacaaguccugcucagccaaaucucucacagagcgcucccccuaccgcagaucaagggguucauccaucccccacuaacagaucuaaaaggaaucuggagaucgaaauuauccugacccucagccagggauuacggaaguacuaugguaagauacugaaacuuuuggaccugacacuagaggaggauaccgaaggccuccuggaguggugcaagcgcaaccuugggcugacuugugacgauaacuuuuuccagaaaagaaucgaagaguuuuucuugacaggagaaggcuacuuuaaugaggugcuccaguucaaggucccgucaacgcugaguuccaccgagccuacucacacaaggccacccaccguggaaccuuuuaaaagcuauuucgcuaagggguuuuuaucuaugaacucagguuacuucagugccaagugcuauccccggacaagcaauuccggacugcaacucauuaacgugacuaaacauucugcgaagaucgccgacaccccaggcccuaaaauuacgaaucuuaagaccaucaacuguauaaaucugcgcgcaucggucuuuaaagagcaccgagaaguugagauuaacguguugcuaccccagguagcugugaaucugagcaacugccacgcccagaucaagucccaugucugugauuacucacucgcuacagacggcauggugagacugccacacauucaucacgaagggacuuucaucccgggaaccuacaaaaucguuauugauaagaagaauaaacaaaacgacaggugcacacuugugacuaauugugucauaaagggucgggaggugcguaaaggccagagugcccugcgccaguauaagaccgagaucagaauugggaaagcaucuagcggauccaggcgguugcucucagaagagagcgacggcgauugcaucucucgaacgcagcuguuacgcacagaaaccacugagauacacuccgacaacuacggugggccuggcgauaagauuacaaucuguaauggaaguaccaucguagaccaaagacugggcagcgaacuagggugcuauacuauuaacaggguuaagucuuuuaaacucugcgaaaauuccgccaccggaaagucaugugagaucgauaguacacccgugaaaugccggcaggguuucugucugaagauuacgcaggaaggccgcgggcaugucaaacuuagcagaggaucggagauaguguuggacgcuugcgauuccaacugugaaaucaugauuccaaagggcaccggugacauccuggucgauugcucugggggccagcaacacuuccucaaggacaaccugaucgaucuuggaugucccaauauuccucuguugggcaaaauggcgauauacaucugcaggaugagcaaccauccaaagacuacaauggcauuucucuucugguuuucauucggguaugugauuaccuguauccugugcaaaguuaucuuuuacuuacugauuguggccggaacaguagguaagaaauucaagcaguaucgugagcuacggccccagacuuguaccauaugcgagacgaucccugucaaugcuauugacgccgaaaugcacgaccucaacugcaguuacaauaucuguccguacugcgcaucccgacugacaucugauggccuugccagacaugugaugcaguguccaaagaggaaagagaagguugaagagaccgaauuguaucugaaccucgagcgcauucccugggugguccggaaacuguuacaagugagcgaguccacugggguagcucugaagagaucaagcuggcuuaccguguugcucguucugcuaaucgucagucugucuccugugcaguccgccccaauaggacacggcaaaacaauugaaacuuaccaggcaagggaggguuauaccagcuuuugccucuucauccuggggucgauucuuuuuguggucucauguuugguuaagggccugaucgacucugugggaaauaguuucuuucccggcuuauccauaugcaaaacauguagcaucgggucuauuaacggauucgaaaucgagagccacaagugcuacuguucccucuuuugcuguccuuauugccgccauugcucagcggaucgagaaauucacaagcugcaucuuaguaucuguaaaaagcggaaaacgggcagcaaugugaugcuggcuguaugcaagcguauguguuucagagccaccauagaggucucuaacagggcauugcucauucgcaauaucaucaacacuacauucgugguuugcauucugacccuagccgugugugucguguccacuucagcuguugagauggaaagucugccggccgguacaugggagaaagaagaggaccucaccaauuuuugccaccaggaaugucaagugacggagacugagugccugugucccuacgaagcacuuguauugcggaagccacuguucuuagauagcaucgucaaggggaugaaaaaccuccuuaauuccaccucucuugagacaucgcugagcauugaagcuccuuggggagccauaaacgugcagucaaccuuuaagcccacuguguccgcggccaacaucgcucuaaguuggucuagcgucgagcacagaggcaauaaaauucucguuuccgguaggucagagucuaucaugaagcuggaggagcgaacaggcauuagcugggacuuggggguggaagaugcaagugaguccaaacuguuaaccguaagcgugauggaccucucucagauguauucaccagucuucgaauaccuguccggagaucgccaaguggaggaguggccuaaggccacaugcacuggcgacugucccgaacggugcgggugcaccaguagcacgugucuucauaaggaguggccacacucgagaaacuggaggugcaauccgacaugguguuggggaguuggcaccgguugcacuuguugcgggcuggaugugaaagacuuguuuaccgauuacauguucgucaaguggaaaguggaauauaucaagacagaggcuauaguuuguguggaacucacuucucaggagcgucagugcucccugaucgaggccggaacccgcuuuaaccuaggcccugucacgauuacacugagcgaaccccggaauauccagcaaaaacuuccacccgagauuaucacccuccauccuagaauagaagaggguuucuuugaccugaugcacguacagaggguguugucagcaaguacuguuuguaagcugcagucuugcacacauggcgugccaggggacuuacaggucuaccacauuggaaaccuccugaagggcgauaaagugaaugggcaccuuauccauaagaucgaaccccacuucaacaccuccuggaugagcugggacggaugugaucuggacuauuacugcaauaugggcgauuggccuucaugcacuuauacagguguaacccaacauaaccacgcggccuuugugaauuugcucaacauugagacggacuacacuaaaaauuuccauuuucacaguaagcgagucaccgcucacggggauacaccgcagcuggaccuaaaagcccggccaaccuauggagcaggcgagguuacagugcugguggaagucgcugauauggagcuucauacuaagaaaauagaaaucagcggucucaaguucgccucccugaccuguacgggcugcuacgcauguucuagcgggauuuccugcaaggugaaaauccacguugacgagcccgaugaguugacaguacaugugaagucagaagacccugauauugucgccgcuggaucuaguuuaauggcgcgcaaacuggaguucggcgccgacucgacuuuuaaggcauucagcgcuaugcccaaaaccucccucuguuuuuacaucguggaaagagaguauugcaagucuuguucaagggaagacacacggaagugcguuaacaccaaacuggaucgaccacagagcauacuuaucgagcacaaggggacuauuaucggaaaacagaauaacaccuguacagccaaggccuccugcuggcuggagagugugaaaucuuucuuuuacggcuugaagaacaugcuaagcgguauuuucgggaaugucuuuaucggaauauuccuguuuauugcuccuuucgugcuccugauccuguuuuucauguucggcuggagaaucuuauuuuguuucaagugcugccgcaggacgcguggccuguuuaaauaucggcaccucaaggacgaugaagagacuggguacagaaaaauuaucgaaagguugaacaauaagaaaggaaagaacaagcugcucgacggugagcgccuggcagaucgaaaaauagccgaacuuuucucaaccaagucccauauuggcuga

SEQ ID NO: 10294 - RNA, 5070 nt, Artificial Sequence
  derived and/or modified CDS sequence (opt3) from CCHFV(SPU97/85)__DQ211633.1__GP
augaccgugaacacagucugcacuccccugguuugugccguguucugccuccagcuuuggaaucugggcgggacguugguaccuaccaacagaacacaacacaauaagacuggaaccauggcuacaccagaggguaccuuaggcccgaggcugcccgugagcacugcacuaccuacaaaauccgaccggccaucugucgggcccgccgcgccuucaaguggacucgaaggcagcggugagccaaacaccucccccucuaucacgacuaaggggcuggcccuuccugaaaccacaccagcuccgcccacugcaaccgauacagacgccucgucaaccggagugguuaaugugagcacgcagaugacuaaagauauuccuaugaguacagcuuacaccaacccacccuccacuccuucugcaccaagcacaccccagggcacccaucacacggcccgcggccuguuguccgucgcuucaaccaagagugaggaagugagcaugucuacauccccggggaaaacuucaaccgagacaagcaguccucccccagccacuucugagaccccugcgcccuccccaacaacccaggcacccacuggaaauaacaauccuaacacgagccgacaaccaacaccgucggcccagcccgcuaugucuaauccuaccacuuccccagcccagcccaaccuccugcagaaugcaccuccaaccgcugaccaagguguacaucccggcccgacaaaccguucaaagagaaaucuggaaauggagauaauccucaccuuaagucaggggcugaggaaguauuacggaaaaauucuuaaguuuuuggaucugacucuagaagaggacacagagggccuccuggaaugguguaaacggaaccuuggucugacgugcgaugacaacuucuuucagaagcgcaucgaggaguucuuuuugaccggggaaggauauuucaaugaaguucuccaguuuaaagugccuagcacucuguccucuacagagccaacccacacaggcagccccacugucgagccuuucaagucauacuuugccaagggcuucuuaaguaugaacuccggguauuuuagcgcgaaauguuaccccagaaccucuaauucaggacugcaacucauuaacgugacgaagcauagugccaaaaucgcagauaccccagguccuaagauaacaaaucuuaaaacuaucaacugcauuaaucugagggcuagcguguucaaggaacaccgggaggucgaaaucaacguuuugcuaccccagguggccguaaaucuguccaacugucacgcucagauuaaaucucaugugugcgacuauucgcucgccaccgauggcaugguccgccugccacgaauccaccaugaggggacauuuauaccgggaacuuacaagauugugaucgacaagaaaaauaagcaaaacgauagauguacccuuguuacgaauugcgugauuaaaggcagggaaguccggaagggucagagcgcacugcgucaguacaaaacagagauccgcaucgggaaggccuccucaggcaguagaagguugcucucugaggaaagcgacggagacuguauuucccggacccagcuguuacgaacugagacagcugaaauacacucagauaacuauggcgggccuggagacaagaucaccauuugcaaugguagcacuaucguggaucaacgccugggcucugagcuagggugcuacaccauaaacagaguaaaauccuucaagcucugugaaaacagugcgacaggaaaaagcugcgagauugacucuacgcccguuaaguguaggcagggcuucugccugaaaaucacccaggagggucgggggcacgugaaacuuucccgcggcucagaaaucgucuuggaugcaugugacaguagcugcgagauuaugaucccaaagggaacuggcgauauucugguggacuguucugggggacagcaacauuuucucaaggauaaucugauagaccuugguugccccaacaucccucuguugggcagaauggccauuuauaucuguaggauguccaaucacccaaagacaaccauggcuuuccucuuuugguucucuuuuggguacgucaucacaugcauucuguguaaagugauauucuauuuacugaucguugccggaacugugggcaagaaauuuaagcaguaccgugaacuacggccccagaccugcacgauuugcgagacaaccccuguaaacgcaaucgaugccgagaugcaugaccucaauuguagcuauaacauuugcccguacugugcuucacgacugaccagugacggucuugccagacacgucaugcagugcccaaagaggaaagaaaagaucgaggaaacugaguuguaccugaaucucgaacgcauacccugggugguucggaaacuguuacaaguguccgagucuacaggggucgcacugaagagaagcuccuggcuuacuguguugcucguacugcuaaucgugucacugagcccuguucagagugcgccaauuggccauggaaaaaccaucgagacauaucaggcuagggaaggcuacacgucuuucugucucuuuauucugggguccauccuuuucauagucagcugcuuggugaagggacugauugauucggugggcaacucauuuuuccccgguuuaucuaucuguaaaaccugcaguauuggguccgucaauggauuugagaucgaaagccacaaguguuauugcucucucuucuguugcccuuacugccgccacuguagcgccgaccgagagauacauaagcugcaccuuuccaucugcaaaaagcggaaaacuggcucaaacguuaugcuggcaguguguaagcguaugugcuucagagccacaauugaagugaguaauagggcuuugcucauccgcagcauuaucaacaccacuuuugccguauguauacugacacuagcagucugcgugguuucuaccuccgcuguggagauggagucacugccggccgguacgugggaacgggaggaagaucucacuaauuucugucaucaggagugccaagucaccgaaacagagugucugugccccuaugaggcgcuuguguugagaaaaccacuguuuuuagacaguauuguuaagggcaagaaaaaccuccugaauagcaccucccuugaaacuucucugucgaucgaggccccuuggggagcuaucaacgugcagagcacauucaagcccaccguaucagcagccaacauugcucuauccuggaguucugucgaacacagggggaauaaaauccucgugagcggccgauccgagucaauuaugaagcuggaggaacgcacagggauaucuugggauuugggaguggaggacgccagcgaaaguaaacuguuaacugucuccguuauggaucucagccagauguacucuccaguguuugaguaucugucaggcgaccggcaaguagaagaguggccuaaggcaaccuguacgggugauugccccgagagaugcggguguacauccaguaccugccuucacaaggaauggccacauagcaggaacuggcguuguaauccgacuuggugcuggggagugggcaccgguuguacaugcuguggccuggacgucaaagauuuguucacugacuacauguuugugaaguggaaaguugaguacaucaagaccgaagcgauugugugcgucgagcucacgucgcaggaacgccaguguucucugaucgaggccgggacacgguucaaccuaggaccugugaccauuacucuguccgagcccagaaauauccagcaaaaacuuccacccgaaauaaucacacuccacccuaggauugaggaaggcuuuuucgaucugaugcauguucagaagguguugagcgcuucaaccgucugcaagcugcagaguuguacucacgggguaccaggagacuuacagguguaucauaucggcaaccuccugaaaggugacaagguuaaugggcaccuuauucacaaaaucgagccccauuuuaacacaucuuggauguccugggauggaugcgaccuggauuacuauugcaauaugggcgacuggccuagcuguaccuacacgggugugacucaacacaaccaugccgcauucgucaauuugcucaacauagaaaccgauuauacaaagaauuuucacuuccauucaaaacgagugaccgcucacggcgacacaccgcagcuggaucuaaaggcccggccaacuuacggggcaggagagguaaccgugcuggucgagguugccgacauggaacuucacacgaaaaagauugagaucaguggccucaaguucgcuagccuguccugcacaggguguuaugcgugcucuagcggaaucuccuguaaagugcgcauucauguggaugaacccgacgaguugacuguccacgugaagucagaggauccugacauaguugccgcaggcucuaguuuaauggcuagaaaacuggaauuuggugccgauucgaccuucaaggccuuuagcgcuaugcccaaaacaucccucugcuucuacaucguagagagggaauacuguaagucuugcucacgggaggacacccagaagugugugaacacuaaacuggaacgaccacagagcauucuuaucgagcauaaggggaccauuaucggaaaacaaaaugacacaugcacggcaaaggccuccuguuggcuggagagugucaaaucguuuuucuauggccuuaagagcaugcuaucaggcauauuugggaacguguucaucggaauuuuucuguucaucgcgccuuuuguucuccugauucuuuucuucauguuugguuggagaaucuuauucugcuuuaagugcugucgcaggacucguggccuguucaaauaccggcaccucaaggaugacgaagagaccggguauagaaaaauaauugaaagguugaacaauaagaaaggaaagaacaagcugcucgauggcgagcgccuggcugaccgaaaaaucgccgaauuguuuuccacaaagagucacaucgguuga

SEQ ID NO: 10295 - RNA, 5070 nt, Artificial Sequence
  derived and/or modified CDS sequence (opt3) from CCHFV(C-68031)__DQ211629.1__GP
augagcuucuccaucauguacacuccccugcucugcgccgugcuuugucugcaguuguggucuuuagagggcucacacgggcugaguaacaagacacaacauagcaauacuuccacgaccaaagcuccugaagucucucaggaguuuggacuaccaguuucgacagugucaacuauuaccagcgacccgcccaguauaacauccgcaguaucugugagcgguuccgaaggcucaggggauaccaacacuucaccuagcgucacaacccagggacucacgcugccagagacuacccuugaacuguugacaacuaccgacacagaugccucuuccaccgugguuguggacgucucaacgcagacugugaaggauacacccaucagcaccacucacacaagucucccuucuaccccauccgcgcccacgaccccucaaggcacacaucacacugcuagaggucugcugagcguaaccucgacaaaaccagagggggccucuacucaggcaaauccggagaagauuuccauggaaaccaacucacccaggcucgccaucagugagacaccuagcuucuccccaaccacucaggcucccacggaaaauucuaacccuauuacaagcaaacaguuaauccugucagcacaaccaguuacccccaauccggugacuccucccguccagccagcccuuagucaguccgacaccagcacagcuauacaggauauccauccuucucccaccucacggaguaagcgcaacuuggagauggagauuauccugacucuaagccaaggacucaagaaauauuacggcaagauucugaaacuucuggacuugacacucgaagaggauacggaaggccuguuagaguggugcaagcgaaaucuggggcucgugugugacgaugacuuuuuccagaaacguaucgaagaguuuuuccuuaccggagagggucacuuuaacgaagugcugcaguucaagacuccauccacauugucucccaccggcccugccagaacagggucgccaacugucgagccguuuaagagcuauuucgcgaaaggauuucuauccauggauucaggcuacuucagugcaaagugcuaucccagggccucuaauagcggucugcaacucauaaacguuacccagcacuccacgcggauuaccgacacaccugggccaaaagugacuaaucugaagaccaucaacuguauuaaucuuaaagcuaguguauuuaaggaacaucgcgagaucgaaaucaacgugcuguugccccaggucgccgugaaccucagcucuugccacguucugauuaaaucccaugugugugacuacaguuuagauauagacggaccugucagacugccaaggauccaccacgagggcacauucauucccggcacuuauaagcuagugaucgauaagaaaaauaagcagaacgaccggugcacccucauaacgaauuguguaauuaaagggcgcgagauccgaaagggacaaagcguucugagacaguacaggacagaaaucaaaauugguaaggcaucuuccggcucacggcgucuuuugagugaggaaagcggggaugacugcaucucgcgcacccagcuguccagaacugagacagcugaaauucauucugauaacuacggaggcccgggugacaagauaaccaucuguaaugggagcacuauuguggaucagaggcucggcucagagcugggaugcuauaccaucaaccgggucaaaaguuucaaacuuugcgaaaauuccgccacaggcaaaucuugugagaucgacagcacgccuauuaagugccgacaaggguuuugucugaaaauaacccaggagggacgcggucacgugaaguuguccagaggcucagaagucgugcucgaugcgugcgacagcaguugugagaucaugauuccaaaggggacuggagacauccugguugauugcucuggcggucagcagcauuucuuaaaagacaaccugauugaucuagggugucccaauaucccucuccugggcaagauggccauauacaucugcaggauguccaaccaccccaaaacaaccauggcauuucuuuucugguuuagcuucggauaugugauuacauguaucuugugcaagguaaucuuuuaccugcucauugucgugggcacucuggggaaaaaguucaagcaauaucgggaguuaaaaccacagaccuguacgauaugcgaaacaaccccuguuaaugcuauugacgccgagaugcaugaucugaacugcucguacaauaucugucccuauugcgcuucacgccuuacuucugacggauuggccagacacgugaugcaguguccaaagaggaaagaaaaggucgaggaaaccgagcucuaccugaaccuagagcguauuccgugggugguacggaaacugcuccaggugagugaauccacagguguugcacugaagcgaagcucuuggcuugucguguugcugguguuacucacugucagccuguccccuguucaaucagcccccaucggccacgggaaaaccguggagacauaccagacgagagaaggauauaccaguauaugccuuuuugugcugggcagcaucuuguucauuguaucuugucucaugaagggucuggucgauuccgugggcaauucauuuuucccagggcuaaguaucugcaagacuuguagcauuggauccaucaacggcuuugagacagaaucucauaaaugcuacuguucgcuguucugcugucccuauugcaggcacugcagcgcugaccgcgagauacauaagcuccaccugucaauuuguaaaaagcggaaaaccggguccaacguuaugcuugcggugugcaagagaauguguuucagggcaacugucgaggugaguaauaaggccuugcugauccgcaacaucauuaauacaaccuuuguugugugcaucuuaauucucgcuguaugugucgugucuacgagcgccguggaaauggagucccugccugcaggaacuugggaacgagaggaagaucuuaccaacuucugccaccaggagugucaagucacagagaccgaaugccuguguccauacgaggcccuaguucuccggaaaccccuguuuucagacucuauagugaagggcaugaaaaauuugcugaacagcaccaguuuagaaacaucccucagcaucgaggcuccuuggggugccauuaauguacagucuaccuucaagccgacagugucagcagcgaacaucgcucuguccuggaguagcgucgagcaucgugggaauaaaauucuugugucgggaagaucugaauccaucaugaagcuggaggaaaggacuggcauaagcugggauuuggguguugaggacgccucagaaaguaagcuccugaccgugucuaucauggaucuaucccagauguauagcccagucuuugaguaccugucaggcgaccgccagguggaggaauggcccaaagcaacgugcacaggggacuguccugagcggugcggaugcaccaguagcacuugucuucacaaggaauggccacauuccagaaacuggaggugcaaucccaccugguguuggggcguugggacaggaugcacuuguugcggccucgaugugaaagaccuguucaccgauuauauguuugucaaguggaaaguagaguacauuaagacggaagccaucguguguguugaguugacaucucaagagcgacagugcagccugauugaagcugguacccgcuucaacuuagggccugugacuaucacacucuccgagccgcggaauauacagcagaagcugcccccagaaauugucacccuucacccuagaaucgaggaaggauuuuucgaccugaugcaugugaaaaagguauugucagccucuacuguguguaaacuccaaaguugcacacacggcguccccggugaucugcagguuuaccacaucggcaaccuacugaagggggacaaagugaauggacaucuuauucacaagauagagccacauuuuaacaccucguggaugagcugggauggcugugaccucgauuauuacugcaacaugggggacuggccuuccugcucuuauacgggagugacucagcacaaucaugcagcuuucgucaacaugcugaauaucgagaccgauuacacaaaaauuuuucacuuccacucaaagagggugaccgcccauggcgacacaccccaguuggauuuaaaggcgcguccaacuuauggugccggggaaaucaccguucugguagagguggcugacauggaacuccacacgaaaaagauugagaucagcggacugaaauucgcaucccuuacauguacuggcugcuacgccuguaguucugguauaagcugcaagguccgcauccauguggacgagccggaugaacugaccguucacgugaaaucagaggacccugauauugucgcugccuccaguagcuugauggcacggaagcuagaauuuggcacagacucuaccuucaaggcguuuuccgccaugcccaaaacuucacuguguuucuauaucguggagagagaauacugcaagagcuguucgaaagaggauacccaaaagugcguaaacacaaaacucgagcagccacagucuauucugaucgaacacaaggggacgauaauuggaaagcaaaaugacacuuguaccaguaaagcuggcugcuggcuugaguccgucaagagcuuuuucuacggguuaaagaacaugcugucaggaaucuuuggcaauguguucaucgguauuuuucucuucuuggcccccuuuauccugcucauacuguucuucauguuuggguggaggauucuuuucuguuuuaagugcugccgacggacacgcggacuguucaaauauagacauuugaaggaugacgaagagaccggcuacaggaagaucauugaacggcuaaacaauaaaaagggcaaaaacaagcugcucgauggggagcgauuagcagacagaaaaaucgcugagcuguuuuccacuaagacacacauaggauga

SEQ ID NO: 10296 - RNA, 5070 nt, Artificial Sequence
  derived and/or modified CDS sequence (opt3) from CCHFV(Baghdad 12)__AJ538197.2__GP
augcccgugagcaucaugcacauuucccugauauacgccguccucugccuucagcuguauggcuugggggagacccauggaucuucaagugguacagaacacaacagaacuaauguuguggcuacgccuggcgggagccaauccccagagccguuaguaucuaccacacugcccgugacucuagacucgucaaccgucaccccugcaacccaggccagcggaccagaaggcaguggugagguguacacuucucccccuacaaccacggaagggcucuccccaagcgaugcgacuuccgagcugcccaccacaacuggaaucggcauuucaaguagcucugacguuaacuccucaacccaggcugccggcgauacaagcaccccuacggcaaggacaagucuuccagacucuccguccacucccccuaccagccaggauacucaucacccaaugcggaaucuguugucggugacaucucucaagcccgaggaaaccccugccccauccaaaucagggaaggagagucccgcugcaagcuccccgcauccugucgccucuagacccccaacgccuagcaccacagcucaaggacccacugaaaacaauucacgaaacaccacagugcagcugaaaaguguaacucaguccgccacccuggguccaauggcgagccccacacagaccguucucuuacaaucugugacuucaaucgcaauucaggacacgcacccuaguccaacaaaucguagcagaaggaaccuggagauggagaucauacuuaccuugccgcagggccugaagaaauauuacgggaagguccuacggcuccugcagcuuacucuggaagaggauaccgaaggauugcucgagugguguaagcgcaaucugggcuuagacugcgaugacacauucuuucaaaaacgcaucgaagaguucuuuauuaccggugaggggcacuucaacgaagugcugcaguuuaggacucccggaacacucuccacgaccgagucuacucaugccggcucgccuacaguggaaccauucaagagcuauuuugcuaaaggcuuccuucugaucgauuccggguacuuuucagccaaguguuauagucggaccucuaauagcggauugcagcuaauuaacgucacacgccacuccacuaaaaucgcagacacccccgguccuaagauaacgaaucugaagaccauuucaugcaucaaccucaaagcuagcauuuucaaggagcaucgagaaaucgagaucaauguucugcuuccacaaguggccguaaaccugucuaacugucacgugacaauuaaaucccacgucugcgauuacaguuugaauauagacggcacugugaagcucccccauauccaccaugaggggauuuuuaucccgggaaccuacaaaauaguuauugacaagaaaaacaagcugaaugauagauguacauuauucacuaacugcgugaucaagggcagggaaguccggaaaggucagagcgugcugcgucaguauaagaccgagauccgcauugggaaagcgucuacgggcuccagaaggcuacucucagaagagaguggagacgauuguaucagccggacacgacugcuucgcaccgaaacugccgagauucacggcgacucguacgggggaccuggugauaagauaacaaucugcaauggcuccaccauuguagaccagagauuggggucugagaugggauguuauacuaucaacaggguuaagagcuuuaaacugugcgaaaauucagcaaccggcaagaguugcaaaaucgauuccauuccagugaagugucggcaagguuacugccucaaaauaacacaggaggggcgcggccaugucaagcugucuagaggaagcgaagugguccuugacgcuugugauuccucaugcgaggugaugauccccaaaggcacgggggacauucugguugauuguagcggaggucagcagcacuucuugaaggacaaccucaucgaccugggcugcccuaauauucccuuacuggggaagauggccaucuauauauguaggaugaguaaccacccaaaaaccacuauggcuuuccuauuuugguucucuuuuggauacgugaucacaugcauucucuguaaggccaucuucuaucugcuuauuaucguaggcaccuuggguaaacguuuuaagcaauaccgggagcugaaaccucagacaugcacuauaugugaaaccacgcccgucaaugcaauugaugccgagaugcaugaccucaacugcuccuacaauaucugcccauauugugcuagccgacugacaucggauggguuagcgagacacgugacccagugcccgaagaggaaggaaaaaguugaggaaacugagcuguaccuuaacuuggagcgcauuccuugggugguccggaagcuccuacaggugucagaaucuaccggcguagcacugaaaagaaguuccuggcugaucgugcuccugguucuuuuggccgucagcucuagccccgugcaauccgcuccaauaggauauggcaagacaaucgagacuuaccaggccagggaaggguauaccucaauuugucuguucguguuaggaaguauccucuuuauugucagcugccugacaaaaggccuuguugacucuaucgguaauauauucuuucccgggcuguccauuuguaagacgugcucaaucggaaguaucaacggcuucgagguggaaagccauaaauguuacugcuccuugcucuguugcccuuauugucgccacugcucugcagaucgagagauucaccagcugcaucuaucgaucugcaagaagcggaaaaccgguagcucagugaugcuggccguauguaagcguaugugcuuuagagcuacuauggaggucuccaacaaagcccuccugauuaggaguauaaucaauacaaccuucgugguuuguauucuuacuuuggcagugugcgucgugucuacaagcgcgguugaaauggagucccugccagcuggcaccugggaacgcgaggaagacuuaacgaacuuuugucaccaggagugccaagugacugagaccgaaugucucugccccuacgaggcccugguacuucggaagccucuguuccuagauucaaucgucaaagggacaaagaaucuccugaacucuaccagcuuggaaacaagucuguccauugaggcaccguggggagccaucaaugugcagagcacuuacaagccaaccgugucuacagcuaacauagccuuaucaugguccagugucgagcauagaggcaauaaaauccucguuagcgggaggucggaaucuauuaugaagcuggaggaacgaacuggaaucuccugggaccuuggcguggaggaugcaagcgaaucaaaacuguugaccguaagugugauggaccucucucagauguauucccccgucuucgaguaccugagcggugaucgccaaguggaggaauggccuaaggcuacguguacaggggacugcccagagcgguguggaugcaccacuucaaccugccuacacaaagaauggccccauaguagaaacuggagguguaauccuacauggugcuggggcguugguacuggcuguaccugcugugggcuggaugugaaggaccuuuuuacggacuauauguucgucaaguggaaaguggaguacauuaagacagaugccaucguuugcguggaacucaccagccaggagcgucaguguucccugauagaggcgggaacucgcuuuaacuugggcucugucacaauuacccugagcgaaccgcggaauauccagcaaaaauuacccccagagaucauuacucuccacccuagaauagaagagggguucuuugaccugaugcacguacagaaggugcuuuccgccucaacaguuugcaaacugcagucuuguacccauggagugcccggcgauuugcaggucuaucacaucgguaaccuccugaagggggacaaggugaauggacaucuaauucacaaaaucgaaccacauuucaacacgaguuggaugucgugggauggcugcgaccuggauuacuauuguaauaugggugacuggccuagcugcacuuacaccggcguaacacaacacaaccacgcuuccuuugugaaccuucucaauauugagaccgauuacacaaagucuuuccauuuucacucaaaaagggucacugcacauggggacacaccccagcuggauuugaagguucgaccaacguauggagccggcgagaucacaguguuaguggaagucgcugacauggagcugcacacuaaaaagauagaaaucagcgggcucaaauucgccucccugaccugcacaggauguuacgcaugcaguucuggcauuagcuguaaggugcggauccacguugaugagccggacgagcuuaccguacaugugaagucagacgauccugacgucguggcggccuccaguagccugauggcucgcaaauuggaauuugguacugauucuaccuucaaggccuuuuccgcaaugcccaaaacaucacuaugcuucuauauuguugagagagaauacuguaagagcugcucgaaagaggacacgcagaagugugugaacacuaagcuggaacagccacaaucuauccucauagagcacaaagggaccauuaucggaaagcagaauaacacaugcaccgcuaaaacaaguuguuggcuggaguccgucaagagcuucuuuuauggccuuaaaaauauguuaucaggcaucuucgggaacuuuuucaugggaauuuuucuguuccucgcccccuuuaucuugcugauacucuucuuuauguucgguuggaggauucuguuuugcuucaaguguugccggcgaacuagaggccuuuucaaguaccgccaucugaaagaugacgaagagaccggguauaggcguaucauugaacgguugaauaacaagaaaggaaagaauaaacuacuggauggcgagagacucgcagacaggcgcaucgccgaauuauuuuccacgaagacucacauagguuga

SEQ ID NO: 10297 - RNA, 5070 nt, Artificial Sequence
  derived and/or modified CDS sequence (opt3) from CCHFV(Hodzha)__AY223476.1__GP
augcccgugagcaucaugcacauucugcucaugugcgccguccuuugucugcagcaauacggcuugggggagacccauagaccuaacaauggaacagaacacaacaagacuaauguuuuaacgaccccaggugacaaacuguccccggagcuacccgugucuacagcucucucaguaacuccugauaguagcaccgugacaccaaccacucccgucuccggccuggaagggucuggagacguguauacaucgccuccaguuaccacgaagggccuuucacccagcaaagcaaccagugagcugccugccuccucugguauagauacuagcuccgcgucagacguggauaguagcacacaggcugccagggacacuucuaccuugacaguccggaccuccccaccgucaagccccaguacgccuccaacuucucaggauacauaccaucucgugcgcaaccugcuguccguaaccagccccuggccugaagagacuacagcaccaucgaagucugggaaagagucccccguugccaauucaccgcacccugugaccagucgacccagcuccccaccuaucacgguccagggacccaccgaaaacucuagccauaauacaacuggccaacucgagucaauggcucagaguaccacauuagugccaauggcaucccccacucagaccgugcugagccagucugucacaucacuugccguucaagacgcucacccuaguccaaccaaccguagcaagagaaauuuggaaauggugauuauccugacucuaccgcagggccucaagaaauauuacgggaagguacugaggcuucugcaguugacgcucgaggaggauacagaaggacuguuagaguggugcaaacggaaccugggucucgacugugaugacaccuucuuucagaagcgcauugaagaguucuuuaucacuggcgaagggcacuucaaugaggugcuucaauuuaaaacccccuccacacugucuaccacugagucgacacaugccgucagcccuacggcggaaccauucaaguccuauuuugcaaagggauucuugucaauagauaguggcuacuuuucugccaaaugcuauagcaagaccuccaacucaggucuacagcugaucaaugugacuagacacagcacaaggauugcugacacccccgggccuaaaaucacaaaccucaagacuauuucuuguaucaaucugaaagccuccguuuucaaggagcaucgggaaguggagauaaacguccuucugccacagguggcaguaaacuugaguaauugccacguuaccauuaaaagccacgugugugacuacucucucgaugucgacggaacggugcgccugccccauauccaccauggcggcaccuuuauuccggggacauacaagaucgucaucgauaagaaaaacaaguuaaaugaccgaugcacucuguauaccaacugugugauuaaaggaagagaaguuaggaagggucaauccauacuacggcaguacaaaacagagauccguauuggcaaggcuucaacugggagucgcagacuccugagcgaggaaucgggagaugacugcaucuccaggacccagcuuuugcggacggagacagccgaaauacacggcgaugacuauggugggccuggcgauaagauuaccaucuguaauggaucuacuaucguggaccagcgacugggcagcgagcucgggugcuacacaauuaaccgcguaaaaucauucaagcugugcaaaaauagugcgaccggaaaguccugugaaaucgauucuacuccagucaaaugcagacaagguuauugucuuaagauuacccaggagggcagggggcaugugaagcugagccggggauccgagguuguguuggacgccugcgacucaagcugugaagucaugauacccaaaggcacaggugauauccucguggacugcagugggggccagcagcacuuucugaaggauaacuuaauugaccugggauguccucgcaucccccuacucggcaaaauggcaaucuacauuugcagaaugucuaaucacccaaagacgaccauggcuuuccuguucugguuuuccuucggguauguaauaacuuguauccuuugcaaagccaucuuuuacuugcugauuauugugggaacacucgguaagagguucaagcaauaccgugagcugaaaccucagaccuguacaaucugcgaaacuacccccgcuaacgccauagaugcagagaugcaugacuuaaauugcagcuauaacaucuguccauacugcgccucgcggcugacgucagauggccuugcucgacacguuacacaguguccgaagagaaaagagaaggucgaagagaccgaauuguaucucaaucuggagaggauuccuuggaucgugcgcaaacuacuucaggugucugaaaguacuggggucgcgcucaagcgguccagcuggcugauuguucuuuuggugcuguuugcagugucuuuaagccccguacaauccgccccaaucggacauggcaaaaccauagagacauaccaggcuagagaggacuauacuucaauuugccucuucguccuggguaguauccuuuuuauugugagcugucugaugaagggguugguugauucuaucggcaacauauucuuucccggacucaccaucugcaagacauguuccauuggcucaaucaauggguucgaaauugagagucacaaaugcuacuguagccugcuaugcuguccuuauugcaggcacugcuccgccgaccgcgaaauccaucagcugcaccucucuauauguaagaaacgaaagacgggaucgaacgugaugcuggcagucugcaaacggauguguuuucgugccaccauggaggugagcaacaaggcucuuuugauuagaucaaucaucaauacuacauucguugugugcauucugaucuuagccguaugugucguguccaccagugcaguggaaauggagucucucccagcgggcacuugggagagggaagaggaucugacaaacuuuugccaucaggaaugucaagucaccgagacggaaugccuuugucccuacgaggcucugguucuacgccggccucucuuccuggacagcauugugaaggguacuaaaaauuugcugaacuccaccucauuagagacaucucucagcauagaagccccguggggagcaaucaauguacagaguaccuacaagccaacuguguccacagccaacauugcucugagcuggucuucagucgagcacagagggaauaaaauccuuguguccggcaggagugaaagcauuaugaagcuggaggagcgaaccgguaucucgugggauuugggcguugaagacgccucugaguccaaacuccugacagugagcgucauggaccuaucacagauguauagucccguguucgaauaccugucuggggaucgccaaguugaggaauggccuaaggcaacuugcaccggagacuguccagagcggugcggcugcacguccagcacaugucuucauaaggaguggccccacucaagaaacuggaggugcaauccuaccugguguuggggaguggggacuggcugcaccuguugcggucucgaugucaaagaccuguuuacagauuauauguucguaaaguggaaaguggacuacauaaagacugaagcuaucguuuguguggaguugaccagucaggaacgucagugcagccuggucgaggccgggacgcgcuuuaacuuaggaccggugacaauuacccucuccgaaccccggaauauccagcaaaaacugccaccugagauuaucacucuucaccccagaauagaggaaggcuucuuugaucugaugcauguacagaagguguugucugcgagcacagucuguaagcuccaguccugcacccacgguguuccaggcgaccuacagguguaucauauugggaaccugcugaaaggagauaaggugaauggccaccuuauccauaaaaucgagccucacuucaacacuucauggaugucuugggacgggugugaucucgacuacuauugcaauaugggagauuggcccaguugcacauacaccggcgucacgcaacacaaccaugccucguuugugaaccuguugaauauugaaacugacuacaccaagagcuuccacuuucauuccaaaaggguuacagcucacggugacaccccacaguuagaucugaaggcacgaccgacauauggggccggagagauaacuguacucguggaagucgcugacauggagcugcacaccaaaaagaucgagauuacgggccuuaaguucgccucucugacauguacugguugcuacgcauguucaagcggcaucuccugcaaagugcggauucauguugaugaaccugacgaguugaccgugcacgucaagagugaugaccccgaugugguagcggccucuagcucacuaauggcucgcaaacuggaauuugggacagacuccaccuucaaggccuuuagugcaaugccaaaaacuagccucuguuucuauaucgucgagagagaguacugcaagucuuguuccaaggaagauacccagaaaugcgugaacacaaagcuggagcagccccaaucaauacuuaucgaaaggaaaggaacgauuaucggcaagcagaauaacacuuguaccgcuaaagccagcugcugguuagagucgguuaagucuuucuuuuaugggcugaagaauaugcucaguggaauuuucggcaacguguuugucgguaucuucuuguuucuggcaccuuucauacuccugauucuguuuuucauguuuggguggcggauccuguucuguuuuaaaugcugccgaagaacacgcggauuguucaaguacaaacaucuaaaggacgaugaagagaccggcuauaggcguaucauugagcggcugaauaacaaaaagggcaagaauaaacucuuagacggggaaagacuggccgacaggcgcaucgcugagcuuuucuccacuaagacacacauaggauga

SEQ ID NO: 10298 - RNA, 5067 nt, Artificial Sequence
  derived and/or modified CDS sequence (opt3) from CCHFV(Kosovo/9553/2001)__AY675511.1__GP
augcccaucaacauuaugcacacccugcucgugugcuucauacuuuaccugcaguuguuaggccuugggggagcccauggucaaagcaaugcuacagagcacaacggcacuaauacgaccacagcaccugggacuucccagucuccaaagccgcccgccucaaccacaccuagucaugcgccagaaagcuccaccaucaaacuaacuacacccaccucugagacggaaggaucgggcgagacuaccccuccaacaucaacuacccaggguagucccccucucgaaacaaccccagagagaaguacgacuacagcuaccuccacuucugggacagacaacaugaauagcaccacgcagaugaccgauaacacaccgacucugaccgccuccacaucacccaguagcucuccuuccacuccaucaaccagccaaggacuucacuaucccgucaggagucuguugucuguuuccagcccuaagacagugaccacuccaacgcccaugucgccgggcgagaugucuuccgaaacaucaagucagcauagcgcaaugucccggaccccuacuccccacaccgccacacagguaucuaccgagaaugcuaaccgcagcacuucacgacagagugaauccagcgcacaaccagccacacagucuccugugacgucacccgcucagaguauucuccugaugagcgccaccccaacuacaauccagaauauucaccccuccccuaccaaccguucuaaaagaaaucuggagauggagaucauacucacauuaucgcaaggccugaagaaauacuaugggaagauccuuaaguugcugcaucuaacucucgaagaggacaccgaaggacugcuugagugguguaaaaggaaccuggguagcaauugcgaugacgacuuuuuccagaagcggauugaagaguuuuucaucacgggcgagggguacuuuaacgaagucuugcaguucaaaacccucuccacaccaucaccgacugagcccagucacgcgcgccugccuaccgcagaaccauuuaagucuuauuucgccaaaggauuuuuaagcauugauuccggcuacuucucagcuaaguguuaucccagaagcucuacauccggucugcaacucaucaaugugacucagcauccugccaggauagcagagaccccagggcccaagauuacgagucuuaaaacaaucaacugcauuaaccugcgggcuagcguuuuuaaggaacaccgcgagguggagaucaaugucuugcuaccgcagaucgccgugaaccugucuaauugucacguaguuauuaacucccaugugugcgauuacucacucgacaccgauggaccuguccgacugccaagaauauaccacgaaggcacuuucaugcccggcacauauaaaaucgugauugacaggaagaauaaacuuaacgaucgguguacccuggugacuaauugcgucaucaaggggcgugagguucgcaaaggacagaguguguugagacaauacaagaccgaaauaaagauugguaaagcgccuacaggcagcaggaagcuccugucggaggaacccggggacgauuguaucucccggacgcaguuacugcgaaccgagacugccgagauccaugacgacaacuauggaggcccaggugauaaaauuacaaucugcaaugggucuaccauuguagaccagcgccuaggcagcgaacucggauguuacacaauaaacagagugaagucauuuaaacugugcgagaauagugcaacuggcaagaccugcgaaaucgauuccacgccugucaaguguaggcagggguucugccuuaaaauuacacaagagggacggggucacgugaaguugucucgcggcagcgagguugugcuggacgcuugugauuccucaugcgaagucaugauccccaaagggaccggagacauccucguggauuguagcggcggucagcagcauuuccugaaggacaaccuuauugaucuggggugcccacacauaccguugcucggcaaaauggccaucuauauugcuagaaugaguaaucacccuaagacuaccauggccuuucuguucugguuuucuuuaggauacguaaucacauguauucugugcaaggcacuauucuauucccucaucauaaucggcacucuggggaaaaagauuaaacaguacagggagcuuaagccccaaaccuguacaaucugcgaaacggccccaguuaacgcuauugacgcggagaugcaugauuugaauuguagcuacaacaucugccccuauugcgcaucgcgucugaccucagacggacucgcccggcacgugaaacaguguccuaagcgaaaggaaaaagucgaggagacugaacuguacuuaaaccuggagagaauaccauggguggucaggaaacuucuccaggugucugaaaguacagguguugcuuugaaacgcuccagcuggcugauugugcuacugguacuccugaccgucucucuuagccccgugcaguccgccccuguuggccaugggaagacuaucgagacauaucaaacccgggaaggauuuacgucaauuugcuuguucaugcugggcaguaucuuauuuauagugagcugucucgucaaaggucugguggacucuguauccgauucauucuuuccggggcuuagugugugcaagacuuguagcaucggcuccauuaauggauucgagaucgagucucacaaaugcuacuguucgcuguuuugcuguccauauugcagacacuguagcgcagacagggaaauucaucaguugcaccucucaaucugcaagaagcgcaaaaccggcuccaacguuaugcuggccgucugcaagcgaauguguuuccgggcuacaauagaggccagucguagagcacuacugauuaggucuaucaucaauaccacuuuugugauuugcauccucacacugaccauuuguguggcgagcacauccgcugucgaaauggagacucuucccgccgcaaccugggaacgcgaggaggauuugacgaacuucugccaucaggaaugucaaguuccugagacagaaugccuguguccauacgaggccuuagugcuccggaaaccccuguuccuugacucaauagugaaggggaugaaaaaucugcuaaacucuaccagccucgagacuagccuguccaucgaagcuccuuggggagccauuaauguacagagcaccuuuaagccgacagucucuacugcaaacaucgcuuugucaugguccaguguggagcacagaggcaauaagauucugguuaccgguaggagcgaaucgaucaugaaauuagaggaacgaacgggggugucuugggaucucggagucgaggacgccuccgagagcaagcugcuuacagugucaauaauggaucugagucagauguauucucccguuuucgaauacuuguccggcgaccgccagguggaggaauggccaaaagcgaccugcacuggugauuguccugagcggugcggcuguacaagcucaaccugccuccauaaggaauggccccacaguagaaacuggaggugcaauccaacuugguguuggggaguagggacaggcugcaccuguugcggggucgacgugaaagaucuguuuacggaccacauguucgugaaguggaaggucgaguacaucaaaacugaggccauuguuuguguggaacuaaccagccaagagcgucagugcucccugaucgaagcuggaacacgcuuuaaccuuggcccuguaaccauuacacucucugagccccggaauauccagcagaagcugccaccggaaauaauuacuuugcauccuaaaaucgaggaggguuucuuugaucugaugcacgugcaaaaggucuuaagcgcauccaccguguguaaacuccagucaugcacgcaugggauccccggagaccugcagguuuaucacauuggcaaccuucugaagggugacagagugaauggccauuugauacacaagaucgaaccacacuucaacacaucuuggaugaguugggaugggugugaccucgauuacuauugcaacaugggagacuggcccucguguacuuacaccggcgucacacagcauaaucacgccgcuuuugugaaccugcuaaauauugagaccgauuauacuaaaaccuuccauuuucacagcaagaggguuacagcccacggggacacgccucaacuggaucuuaaagcacgaccaacuuacggagcgggcgaaaucaccgugcucgucgagguagccgacauggagcugcauacaaagaaaguggaaauuuccgguuugaaguucgcuucuuuagccugcaccgggugcuaugcauguucaagcggaaucuccugcaaaguucggauacacguggaugagcccgacgaacugacuguccaugugaagaguucugauccugacguaguggcugccagcacaucacucauggcacgcaagcuggaguuuggcaccgauuccacguucaaagccuucagugcuaugccgaagacuagccuuuguuuuuacaucgucgaaaaagaguacugcaagucuuguuccgaggacgacacaaagaagugcguugauaccaagcuggaacagccacagucaauuuugaucgagcacagagguaccauuaucggcaaacccaacgacacuuguccugcgaagacaagcugcuggcuagaaucggugaaaucuuucuuuuaugggcugaagaauaugcucggaaguguguucggcaacuuuuucauagggauucugcuguuuuuagcccccuucuuucuguggaugcucuccuucauguuuggauggaaaaucuuguucuguuucaagugcuguaggcggacccgaggccuguuuaaguacagacaucucaaagaugacgaggaaacagguuaucgcaggaucauugagcgucugaauaacaagaaagggaagaaucggcuucuggauggagagagauuggcagacaggaaaaucgcugaacuauucagcacuaagacgcacauaggcuga

SEQ ID NO: 10299 - RNA, 5067 nt, Artificial Sequence
  derived and/or modified CDS sequence (opt3) from CCHFV(200406546-Turkey)__KR864902.1__GP
augcccaccaacaucacacacacucugcucgugugcuucauucuuuaccugcaguuguuaggcagagggggagcccauggucaaagcaaugcuacggagcacaacggcaccaauacaacuaccgcaccugggacaucccagucucauaagccacuggucucaaccacuccgccccacacacuagaaaguagcaccauaaaacauacgacuccuaccuccgagacagaaggaucuggcgagacuaccccacccccuaacacaacccaggguccaucgcccccugaagccacgccagagaggccggcgacuacagcuaccucaacucccagcacagacaauaccaacaguacgacccagaugaaugauaacaauccuacauccacuaucucuaccagcccauccucaagucccagcacaccuccaacuccccaagggauucaccacccggcccggucucuccuguccguuucaagccuuaagaccgcaacaaccccuacucccacgaguccaggagagaucucuuccgaaacaagcucgcagcauucugccaugucccgcaccccuacucugcacaccacaacccaggugucaacugagaguacaaaccauagcacgccccgacaguccgaaucuagcgcucaaccaaccacucccucaccuaugacaaguccagcacaguccauuuugccgaugagcgccgcucccaccgccauccagaauauacacccuucuccaacaaaccguucaaaaagaaaucucgagguagagaucauucugacucugagucagggccucaagaaauauuacggcaagaucuuaaagcugcuucacuugacccuggaagaggacacggaagggcuacucgagugguguaaaaggaaccugggaagcuccugcgaugacgacuuuuuccaaaagcggauugaagaguuuuucgugaccggugagggcuauuuuaaugaaguccuucaguucaaaacacugucuacuuugucgcccaccgagccuagccaugcgaagcucccaacaguggaacccuuuaaauccuacuucgcaaagggguuucugucaaucgacaguggauauuucucugccaaguguuacccgcgcagcuccacuucaggcuuacagcugauaaacguuacccaacacccugcuagaauugccgagacgccaggucccaaaacaaccagccucaagacuaucaacugcauuaaucuuagggcaucuguguuuaaagaacaucgggagaucgagaucaacguccuguugccucagauugcugugaaucuauccaacugucacgccguaauaaagagucauguuugcgauuauagccuggacacagaugggcccgugcgccucccacacaucuaccacgaaggaaccuucauuccuggcacuuacaaaaucgucauagacaagaaaaauaagcugaacgaucgauguauucuugugaccaauugcgugaucaagggcagagaggucaggaaagggcagucuguucugcggcaguauaagacagaaaucaaaauuggaaaggcguccacggguucacguaaauugcucagugaggaacccggcgacgauuguaucagccgcacccaacuguuaagaacugagacagccgagauucaugacgacaacuacgggggaccaggcgauaagauaaccaucugcaaugguucgacaauuguggaccagaggcugggguccgaacuaggcuguuauacuaucaaccggguaaagucuuuuaaacucugcgagaauagcgcaaccggaaagacgugcgaaaucgauucaacaccggugaaaugucgacagggcuucugccugaagauuacccaggaggggcgcggacacgucaaacuuaguagagguuccgaggugguuuuggacgugugugauucuagcugcgaagucaugauaccuaagggcacuggggacauccugguggauuguuccggaggccaacagcauuuccucaaggacaaccugauugaucuugguugcccccacguaccacuguuggggaggauggcuaucuacauuugucggaugucaaaucacccccgcaccacaauggccuuucucuucugguuuagcuucggcuauguuaucacuugcauauuuuguaaagcucuguucuacaguuuaaucauuaucggaacccugggcaagaaauuuaagcaguauagagagcuaaaaccucagacaugcacgauuugugaaaccgccccagugaacgcaaucgacgccgagaugcaugaucucaauugcucuuacaacauaugccccuacugugcuuccaggcugacuagcgacgggcuugcgcgucacgucccucaaugcccgaagcggaaggaaaaaguggaggagacagaauuguaucugaaccucgagcgaaucccauggauugucagaaagcuguuacaggugucggaaucaaccggaguugcacugaaaaggucuaguuggcuuauuguguugcucguacugcuaacugucucccugagccccgugcagucugccccuguuggucauggcaagacaaucgagaccuaccagacgcgcgaaggguucacuagcauaugucucuuuaugcugggauccauccuuuucauugugucaugcuuggucaaaggccugguggacaguguaagcgauuccuuuuucccagguuuaucuguguguaagaccugcucaaucgggaguauuaauggcuuugagaucgagagccacaaauguuauugcucccucuucuguugccccuacugucggcauugcucugcugacagagaaauacaccaacugcaccuuucgauuugcaagaagaggaaaacaggaagcaacguuaugcuggccgucuguaagcgcaugugcuuccgagcaaccaucgaggccucacggcgugcuuugcucaucagauccauuaucaauacuacauuugugauuuguauacugacccuaacaaucugcguggucaguacuucugccguugaaauggagaaccugccugcaggcaccugggaaagggaggaggaucucacgaauuucugucaucaggaaugccaggugacagagaccgaaugucugugcccguaugaggcgcuuguguugcgcaaaccccuguuuuuagacagcauuguaaaggggaugaaaaaccuccuuaauuccacuucacuggagaccucucugagcaucgaagcuccauggggagccauuaacguccaaaguacauucaagccuacuguguccaccgcaaauaucgcccuaagcuggucuucaauagagcaccggggcaacaagauccucguuacggguagauccgaaaguauuaugaaacuggaggaaaggacaggggugagcugggauuugggagucgaggacgcuucggagucuaagcuguuaaccguguccaucauggaucucagccagauguacucacccguuuuugaauaucugaguggcgaccgacagguggaggaauggccaaaagccacuuguacaggugauugcccugagcgcuguggcugcaccucuuccacuugccuucauaaggaauggccccacagccggaauuggagauguaacccaacauggugcugggguguaggaaccggcuguacgugcuguggggucgacgugaaagaucuguucacugaccauauguuugugaaguggaaggucgaguacauuaaaaccgaggcaaucguuugcguggaauugacaucacaggagaggcaauguagucucauagaagcuggaacccguuucaaucugggcccgguaacaauuacucuaagcgagccucgcaacauccagcagaagcugcccccagaaaucauuacccuucaccccaaaguggaggagggguuuuucgaucucaugcacguccagaaggugcuguccgccucuacgguuugcaaauugcaaagcuguacacaugggauaccuggagacuuacagguguaccacaucggcaaucugcucaagggugaccgggucaacggccaucugauucacaagaucgaaccacacuuuaacacuuccuggaugucaugggaugggugcgaccuugauuauuacuguaauaugggagacuggcccucuugcaccuauacaggcgugacccagcauaaccacgcggccuucguuaaucuguugaacauugagacugauuacaccaaaacauuucauuuccacaguaagagagugacggcucauggggacacuccucagcucgaucugaaagcaaggccgaccuauggagccggcgaaaucacaguccuaguagagguggcugacauggagcugcacaccaagaaaguugaaauaucgggucuuaaguucgccagccucgcaugcacuggguguuacgcgugcuccucuggaaucucauguaaagugcggauucacgucgaugagccagacgaacugacagugcauguaaagagcuccgaucccgacguggucgccgcuaguaccucuuugacggcccgaaaguuagaguuuggcacugauagcacauucaaagcauuuucagcuaugccuaagaccucccugugcuucuauaucguugaaaaagaguacuguaagaguugcaaugaggacgacacccaaaaauguguggauacuaagcucgaacagccccagagcauucugaucgagcacaaggguacaauaauuggcaaacaaaacgauaccugcacagccaaggcaucuuguuggcuugaauccgugaaaucauuuuucuacgggcugaagaauauguugggaagcgucuuuggcaacuucuuuaucgggauccuacuguuccucgccccauuugugcugcuuguuuuauucuucauguuuggauggaaaauucuguucugcuuuaaguguugccgcagaacuaggggccucuucaaguaucggcauuugaaagaugacgaggaaacggguuacaagcgaaucauagagagacugaauaacaaaaaggggaaaaaucgccuccuggauggagagaggcuugcugaccguaagauugcggaacuguuuucgaccaagacacacaucggcuga

SEQ ID NO: 10300 - RNA, 5067 nt, Artificial Sequence
  derived and/or modified CDS sequence (opt3) from CCHFV(Haskovo-V46/13)__KR092379.1__GP
augcccaccaacaucaugcacacacugcucgugugcuucauucuuuaccugcaguuguuaggccuagggggagcccauggucaaagcaauacuacggagcacaacggcaccaauaacacaacugcuccugggaccucccagucuccaaagccgcauaugucaacaacucccccucacgcaccagaaaguagcacuauaaaacccacaaccccuacguccgagacugaaggaucuggcgagaccacaccacccucgaauacuacccaggguccuucaccaccggaaacaaccagcgagagacccgccacgacugcgaucaguacauccucuaccgacaacaugaauccuacuagccagaugacagauaacaccccaacguccaccgucucaauuagucccucuagcuccccuucaacaccaagcacuccccaagggaugcaucacccggcuaggagucugcucucuguuuccagcccuaagaccgccacaacucccaccccaacaucgccuguggagguaggaucugaaaccuccucacagcacagugcaaugagcuccacucccacgccacauacagccacccaggugucuacugagaauaccaaccacagcacaccccggcagucagaaccuagugcucaacagaccacuccauccccgaugcccagcccugcacagucuacacugcuuaugucagccgcuccaacggccguccagaauacccaucccaguccuacuaaccgcagcaaacgaaaucuggagauggagaucauuuugacacucucccaaggccugaagaaauauuacggcaagauccugaagcucuuacaccugacccuugaagaggacacagaaggguugcuggagugguguaaacguaaccuaggaucuaauugcgaugacgacuuuuuccagaagagaauagaagaguuuuucaugacuggugagggcuauuuuaacgaagugcuccaguucaaaacccugucgacgcuuagcccaauggagcccucccacgcggaacugccgaccgcagagccuuuuaagucauacuucgccaaaggguuuuugaguaucgacucuggauauuucagcgcuaaguguuacccaagguccucaacaagcggccuccaacugauuaacguuacucagcaucccgcccggaucgcagaaaccccuggucccaagacaacuucuuuaaaagcuauuaauugcaucaaccugcgcgccuccguguuuaaggagcacagagagauagaaauuaauguccuccuuccacagaucgcggugaaccugaguaauugucauguaguuauuaacagccacgugugcgauuauucuuuggacaccgaugggccugucaggcuaccccauaucuaccacgagggaacguucaucccaggcacauacaaaauugugauagacaagaaaaauaagcugaacgaucgguguacccucgugacuaauugcgucaucaaaggccgcgaaguucgaaaggggcaguccgugcugagacaauauaagacagagauuaaaaucggaaaggccucaaccgguaguaggaaacuucugagcgaagaguugggcgacgauuguauaucgcggacucagcuccugcguaccgagacagcagaaauucacgacgacaacuacgggggaccgggcgauaagaucacgaucugcaaugguuccaccauuguagaccagcgcuuagggucugagcugggcuguuauacuaucaacagaggaaagagcuuuaaacuaugcgaaaauucagcuacaggcaagaccugcgagauugauaguacaccugugaaauguaggcagggguucugccucaagauaacucaagagggacggggucaugucaaacugucccgaggcucugaagugguucuugacgccugugauagcuccugcgaggugaugauccccaaggggaccggagacauuuuggucgauuguucaggcggucagcagcacuuccugaaagacaaccucaucgaucuggggugcccacauaucccccuucugggcaagauggcuauuuacauaugucgcaugagcaaucacccuagaacgacaauggccuuuuuguucugguuuaguuucggauaugugauuaccugcaucuuuuguaaggcacucuucuacucucugaucauuaucggcacuuuagggaaaaagauaaaacaguauagggaacugaagccacaaaccugcacaaucugugagacuacccccguaaacgccauugacgcugaaaugcacgaucuaaacugcuccuacaauaucugcccuuacugugcgagccggcucacaucggacggacuggcacgccauguuacgcagugcccgaaaagaaaggagaagguggaggaaaccgagcuuuauuugaaccuggaaaggauuccauggaucguccguaaacucuuacaggugucagagucuacuggugucgcccugaagcggaguuccuggcugauagugcuuuugguucuccugcccgugagccuaucuccuguacagagcgcuccagucggccacgggaaaacaauugaaaccuaccaaacucgagagggauuuacauccaucugucuguucaugcucggcucaauucuguuuaucgugaguugccuuguuaaggguuugguggacagcgucggggauucuuucuuucccggccuguccguguguaaaaccugcucaauaggaaguaucaauggcuucgagauugaaagccauaaguguuauugcuccuuauuuuguugcccuuacuguagacacugcucugccgacagggagauccaucagcuccaccugucgauuugcaaaaagcgcaagacggggagcaacguaaugcuugcaguguguaaacggaugugcuucagagccacuaucgaggcuucaaggcgcgcccuguugauacgauccauuaucaauaccacauucgcaauguguauccucacccugacuauuugcguugucaguacaucugcgguggaaauggaaaaccuaccggcuggaaccugggagcgggaggaagaucugacaaauuuuugucaccaggagugccaagugacugaaaccgagugucucugccccuaugaggcccugguccuucguaagccauuguuccuggacagcaucguuaaaggcaugaagaacuuacucaauuccacgucacuggaaacaucucuuagcauugaggcaccuuggggugccauaaacgugcagaguaccuuuaaacccacuguguccaccgcuaauaucgcccugagcuggucuucaguagaacauagagggaacaagauucuagucacaggaagguccgagaguaucaugaagcucgaggaacgcacuggcgugagcugggaucuggguguugaggacgcaucggaaucuaaauugcugaccguguccauuauggauuuaagccagauguacucaccagucuucgaguaucucaguggcgacagacagguggaagaguggccuaaggcuacguguacaggggauugccccgaacgguguggaugcaccucuuccacuugccugcacaaagaguggccacauagcaggaauuggcgauguaacccgacauggugcuggggcguugggaccggauguacuugcuguggcguggacguaaaggaucuuuuuacagaccacauguucgucaaauggaagguggaguacaucaagaccgaagccauagugugcgucgagcugacgucacaagaacgccaguguaguuugaucgaggcggguacucgguuuaaucucgggccuguuaccauuacacugagcgaacccagaaacauccagcagaaacuaccacccgagauuaucacccugcauccuaagauagaggaaggauucuuugaucuuaugcacgugcaaaaaguacucuccgccucuacagugugcaagcugcagagcuguacucacggcauuccaggugacuugcaggucuaccauaucggcaaccuguuaaaaggggacagggugaauggacaccucauccauaagauugagccccacuucaacaccuccuggaugucaugggauggcugcgaccuggauuauuacuguaauaugggggacuggccuucuugcacguauacaggaguuacucagcacaaccaugcugcauuugugaaucuucugaacauagaaaccgauuacacaaagaccuuccacuuucauaguaaacgugucacugcccacggcgacaccccgcaauuggaucucaaggcucgcccaacauauggugccggggagaucacggugcugguugagguggcagacauggaacuacauacuaaaaaggucgagauuucgggacugaaauucgcgagccuuaccugcacaggcuguuacgccugcuccucugguaucucauguaagguacggauucacguggaugaacccgacgagcucaccguucacgugaaaagcuccgauccugacgucguggcugccggcaccagucugauggcaagaaaguuggaguucgggacagauucuaccuuuaaggcuuucagcgccaugcccaaaacgucauuaugcuuuuauaucguagaaagggaguacuguaaguccugcagugaagacgacacucagaaauguguggauacaaagcuggagcagccacaaagcauacucaucgaacauaaaggaaccauuaucggcaagcagaaugauaccugcacugcacgagccucuuguuggcuggaguccgucaagucauucuuuuacgggcuuaaaaacaugcugggaagcguuuucggcaauuucuugauugguauccuacuguuucucgcuccuuuugugcugcuuguguuauucuuuauguucggguggaagauacuguucugcuuuaaauguugccggcgcacaagaggacucuucaaguauaggcacuugaaagaugacgaagagaccggcuaccggcgaauuaucgagagacugaacucgaagaagggcaaaaaucgccuccuggauggggaaaggcuugcggaccguaagaucgccgagcuguuuucuacaaaaacucauauuggauga

SEQ ID NO: 10301 - RNA, 5067 nt, Artificial Sequence
  derived and/or modified CDS sequence (opt3) from CCHFV(VLG/TI29414)__AY179961.1__GP
augcccaccaacaucaugcacacacugcucgugugcuucauucuuuaccugcaguuguuaggccuugggggagcccauauacaaagcaaugcuacugagcacaacgguacgaauaccacaacugcaccuuccaccucucagucaccaaagccgcuagucaguacagcgcccccucaugcccucgaaagcuccaccaucaaaccaacuacacccguuucugagaccgaaggcagugggggaacgacuccuccacccaacaccacacagggcccuucaccaccggaggcuacucccgaaagaccugccaccacagcaaccagcacgccaaguacugacaauacaaacuccaccacucacgugacagauaauaaccccaccucuacgauuagcaccuccccuucaaguagcccaucuacacccuccacuccgcaggguauccaucacccugccaggaaucugcuuucaguaagcagucccaagaccgcuacaacuccaaccccuacaucucccggggacauuuccagcgagaccucgucucugcacuccgcaaugucacggacuucgacguuguauacagccacccaagugagcacugagaacgcuaaucauuccgccccacgccagucugaaagcucagcgcagcagaccacaaccagucccaugacuuccccugcacaaccaauccucgucaugagcgccgcuccgacagccauacagaacauccaccccucuccuacgaaucgaucaaaacguaaccuggagauggaaauuauccugacccucagucagggauuaaagaaauacuauggcaagauucugaaacuuuugcaucugacucuagaggaggauacagaaggccuccuggagugguguaagagaagccuuggguccaauugcgacgaugacuuuuuccagaagaggaucgaagaguuuuucaugaccggagaagguuacuuuaacgaggugcugcaauucaaaacauugucuacucucucgccaaccgagcccagccacgcacggccuccaacgguugaacccuuuaaguccuauuucgcuaaaggcuuucugucaauagauaguggguacuucucugccaaguguuauccgcgcuuaagcaccuccggacugcagcucauuaacgugacacagcacccugcgagaaucgccgagacuccaggccccaagaccacaucacuuaaaacuauuaauugcaucaaccugagggcaagcgucuuuaaggaacaucgggagaucgaaauuaauguguugcuaccucaaauagcuguaaaccugucuaauugucacguugugaucaacucccaugucugcgacuacagucucgauaccgacggucccgugcgccugccacacauuuaccaugaggggacguucaucccuggaacauauaaaauagugauugauaagaaaaauaaacuuaacgaccgauguacccuggucacuaauugcguuaucaagggcagagaggugaggaagggccagagcguauugcggcaguacaagacagaaaucaaaauugggaaggccucuaccggaucccguaaacuccugucagaggaacccggugaugacuguaucagucgcacucaguuacugagagcugagccagccgaaauucacgacgauaacuauggcgggccgggagacaagauaaccaucugcaauggcagcacaauuguggaucaaaggcuagguucggagcucggguguuacacgaucaaccgggucaaauccuuuaagcugugcgaaaauucugcaaccggcaagacuugcgaaaucgacagcacaccugugaaaugucgacagggauucugccuuaagauuacccaggagggccgcgggcacguuaaauugucaagaggaagugaagugguccuggaugccugugacuccucuugcgaggugaugauacccaaggguacaggcgauauccucguagacuguagcgggggacagcaacauuuccugaaagauaaccuuauugaccugggcugcccacacauccccuugcucgguaagauggcuauuuauaucuguaggauguccaaucauccucggacuaccauggcguuucuguucugguuuucauucggguacguuauaacgugcaucuuuuguaaggcauuauucuauagccugauuaucauuggcacacuagggaaaaagaucaaacaguaccgcgagcucaagccacagaccugcacuauaugugaaaccgcccccgugaacgcuauugaugccgagaugcacgaccugaacugcaguuacaauaucugcccuuauugugcaucuagacuuacauccgacggcuuggccaggcacgucccgcagugcccaaaacguaaggaaaagguggaggaaacugagcuguaccucaaccuggagcggauucccuggaauguccgaaaauuacugcaagugagcgaaucgaccgggguugcucuuaagagaucaucuugguugaucgugcuccugguacuacugacagucagucucuccccugugcagagcgccccaguuggacaugguaaaacgauagagaccuaucagacuagggaaggcuuuacaucuaucugucuguucaugcuugggagcauuuuguuucugguguccugcuuagucaagggacucguggauucaguaagugacagcuucuuucccggccugucuguguguaaaaccugcuccaucgguucaauuaacggguucgagaucgaaagucacaaguguuacugcagccuguuuuguugcccuuauugucgccauugcuccgcagaucgggagauacaccagcugcauuugucuauuugcaaaaagagaaagaugggcucgaauguuaugcucgcggucuguaaaaggaugugcuuccgcgcuacuaucgaggccagccgacgggcacugcuaauccguucaauuaucaacacaaccuucgugauuuguauacugacgcucacuaucugcguggucuccaccagugccguugaaauggagaaucugccgucuggaacaugggaaagagaggaagaccuuaccaacuuuugucaccaagagugccaggugacugagacagaauguuugugccccuacgaggcucugguguuaaggaagccacucuuccuggauagcauuguaaaaggcaugaagaaucuucugaacuccaccaaucuagaaacaucacucucuaucgaggccccuuggggagcaauuaacguccagagcacuuuuaaacccaccgugaguacggcuaauaucgcccuguccuggagcucuguugagcaccgcggaaacaagauauuggugacaggccggucagaauccaucaugaagcuggaggaaagaaccggugucaguugggacuuagggguggaggaugcgagcgaaucgaaacuccugacuguuucuauuauggaccuuucccaaauguauagcccaguguucgaguaccugucaggagauaggcagguagaggaauggccuaaggccaccuguacaggcgacugccccgagcgaugugguugcaccaguucuacuugcuugcauaaagaauggccacacucccgcaauuggcgguguaacccgacguggugcugggaggucggcacaggguguaccugcuguggauggaacgugaaggaucucuuuacugaccauauguucgugaaauggaaggucgaauacaucaagacagaggcuauuguuugcguggagcugaccagccaggaaagacaguguucacuaaucgaggcaggcacuagguuuaaucuggggccuguaacaauaacccuuagugaaccccguaacauucaacagaaacucccacccgagaucaucacgcugcacccuaagguggaagagggauucuuugauuugaugcauguccagaaagugcugagcgccuccacuguuugcaaguuacagucuuguacccacggcauuccaggugaccuccaaguguaucacauagggaaucugcuuaaaggagaccgcgucaacggccaucugauccacaagauugagccccauuucaauacaagcuggauguccugggaugguugcgacuuggauuacuauuguaacaugggcgacuggccuucaugcaccuacacagggaugacucagcacaaucacgcugccuuugugaaccuccugaauaucgaaaccgauuauacgaagacauuccauuuucacucuaaacggguuacugcacauggagacaccccgcagcuagaucugaaggcgagaccaacauacggcgccggggagauuaccgugcuugucgaaguagcugacauggagcuccacacuaaaaagguggagaucaguggacugaaauucgccucguuggcaugcaccggcuguuaugcuugcagcuccgguauaucuuguaagguuaggauccauguggaugaacccgacgaguuaacaguccacgugaaaucaaacgauccugacguaauugccgcaagcacgucccugauggcccgaaagcucgaguucgggacugauaguaccuuuaaggcuuucucugcgaugcccaaaacaagccugugcuuuuacaucgccgagcgggaauacuguaagucaugcuccgaggaggacacccagaaauguguggacacuaaacuugaacaaccacagaguauucugaucgagcacaagggaacaauaauuggcaagcagaaugauaccugcacggcaaaggcuagcuguugguuggaaucugucaaauccuucuuuuauggucuaaagaacaugcugggcucaguuuucgggaacuuuuucaucggaauccuccuguuucuugccccuuucguguuacuggugcucuuuuucauguucggcuggaaaauuuuguuuugcuucaaguguugccgcagaacuagggggcugcucaaauaccggcugcuuaaggacgaugaggaaacaggauaucgaagaaucauagagcgccugaauaauaagaaaggcaagaacagguugcuagacggugagcgucuggccgaucggaaaauugcugaacucuuuagcaccaagacccauaucggguga

SEQ ID NO: 10302 - RNA, 5067 nt, Artificial Sequence
  derived and/or modified CDS sequence (opt3) from CCHFV(UCCR4405)__KY484029.1__GP
augcccaucaacauuaugcacgcccugcucgugugcuucauacuuuaccugcaguugagcggcuuagggggagcucauagacaauccaaugcaaccgagcacaacgguacaaauacuacgaccgccccuggcacaucucagucaccaaagccgcccgucaguacuacccugccucauacaccagaagcgagcaccaucaaacuaacuacacccaccuccgagacggaagggucuggagagacuaccccuccacccaacacaacucagggccucccucugccagguaccacaccggaaaggucggcuaccacggccacuucaacaagcaguaccgacgauaugaacuccacuacacagaugaccgacaauacgcccaccucuacaguuagcauugggcuuuccucaaguccuagcaugccaucuacuucccaaggaauccacuaucccgugcggucacuguugagcguaaguucuccuaagaccgcaacaacuccaacccccauguccccgggcgaggugagcccugagacaucgucucagcauuccgccaugucacgcauucccacccucuacacugcuacgcaggucaguacagaaaauaccaaccgaagcaucccacgucaguccgagucuagcgugcaaccugcaacucagucacccauaaccaguccagcccagacaauccugcugauguccgcugcccccaccgcgauucaggauaugcacccuagccccaaaaauagaucuaagaggaaccucgaaguugagaucauuuuaacucugucacaaggccuuaaaaaguauuacgggaagaucuugaaacugcuacaccucacacuggaggaagacacggagggacuucuggaaugguguaagcggaauuuggguaguaacugcgaugacgacuuuuuccagaaacgcauagaggaauuuuucauuaccggcgagggguauuuuaaugaggugcuccaguucaagacuccgagcacacugucccccaccgaaccuucucaugucagauuaccaacagcagagcccuuuaaaucguacuucgccaagggauuucugagcaucgauuccggcuauuucucagcuaaguguuacccuaggaguucuacuagcggucuccaacuuauuaacgugacccagcacccagcccggaucgcagaaacgcccgggccgaaaaccacaucccugaagacuaucaauugcauuaacuugcgcgcuucaguauuuaaagagcaucgagaaguugagauaaacgugcuacugccucagaucgccgucaaucucagcaacugucacguggugauuaauucucacgucugcgauuacucccuggacaccgauggaccaguuagacuucccaggauccaucacgagggcgcguucauaccuggcacauauaagauugugaucgacaaaaagaacaaacugaaugaucgguguaguuugguaacuaacugcgugaucaaggggcgugaaguccgcaagggacagagcgugcucagacaauacaaaaccgagauuaagaucgguaaagccucuacgggcuccaggaagcuguuaucagaggaacccggggacgacuguauuagucggacacagcugcuaaaaaccgaaacugcagagauacaugaugacaauuauggaggcccaggugauaagaucacaauuugcaacgggagcaccaucguugaccagcgacucggcucggagcugggauguuacacuaucaaucgcgugaaguccuuuaaacuuugcgaaaacucugcuaccggcaagacaugcgagauugauagcacgccugucaaauguagacagggguucugcuugaagauaacccaagaaggaaggggucacgugaaacugucacggggcagugagguaguucucgacgccugugauuccucuugcgaggugaugauccccaaggggacuggagacauucuggucgauuguagcggcggucagcagcauuuccuuaaggacaaucugaucgauuuggggugcccacacauuccgcuccugggcaaaauggcuaucuauauaugucgcauguccaaccacccuagaacaaccauggccuuuuuauucugguuuucauucggauacgugaucacaugcaucuuuuguaaggcacuguucuauagccuaauuauuaucggcacucucgggaaaaagauaaaacaguacagggaacugaagccccaaaccugcacgauuugugagacagccccagucaaugcuaucgacgcggaaaugcaugaccuuaagugcaguuacaacauuugccccuauugugcaucucguuugaccuccgauggacuggcccggcacgugacucagugcccuaaacgaaaggagaaaguugaagagaccgagcucuaccugaauuuagaaagaaucccauggauagugaggaagcugcuucagguaagcgagucgacaggugucgcuuugaaacgcucaucuuggcucaucgugcugcuaguucugcucacugugagucugucccccguccagagcgccccugugggccaugggaagaccauugaaacauaucaaacgcgggagggauuuaccucuaucugucuuuucauguugggcagcauucuguuuaucguauccugcuuagugaaaggucucguugacucagucagugauagcuucuuuccggggcugucuguguguaagacuugcuccauaggcucaauuaacggauucgaaaucgagagucacaaguguuacugcagccuguuuuguugcccauauuguagacacuacuccgcagacagggagauccaucagcugcacuugucuauuugcaaaaagcgcaaaacaggcucgaacgugaugcucgccgucugcaagcgaauguguuucaaagcuaccaucgaagccagccggcgugcacugcuaauuagaucaauaaucaauacuacauucguuauuugcauccugauucucgcgaucugugugguguccaccagugcuguagagauggaaaaccugcccgccgggacgugggagagggaagaggaucuuacuaauuuuugccaucaggagugucaagucaccgaaacagagugcuuguguccuuaugaagcacugguguuacgcaagccacucuuccuggacucuaccguuaagggaaugaaaaaccuucugaauagcacuucccuagagacaucacucucuauagaggcccccuggggcgcuaucaacgugcagagcaccuuuaagccuacagucaguacugccaauauugcacuguccuggagcucuguggaacaccgggguaacaaaaucuugguuaccgggagaucagaguccauuaugaagcuggaagagaggacgggagugaguugggauuuaggcguagaagacgcuagcgagucgaaacuccugacagucucuaucauggaucuuucccagauguacagcccgguguucgaguaccugucaggugaccgacagguggaagaguggcccaaggcaaccugcacuggcgauuguccagaacgcugcggguguaccaguucuacaugcuugcauaaggaguggccucacucccggaauuggagaugcaaccccacuugguguuggggagucggcaccgggugcacguguugcggaguugacgugaaagaucucuuuacagaccacauguucguaaaguggaaaguggaauauauaaagaccgaggcgauugucuguguggagcugacuagccaagaaaggcagugcucacuaaucgaggccggcacacguuuuaaucuggguccaguuaccaucacucuuagugaaccucgcaacauucagcagaaacucccaccagagauaaucacacugcauccgaagauugaagagggguucuuugacuugaugcacgugcaaaagguccugagcgcuuccaccguguguaaauuacagucuugcacgcauggaaucccuggcgaucuccagauuuaccacaucgguaaucugcuuaagggcgaccggguuaacgggcaucugauacacaaaaucgagccccacuucaauacuagcuggauguccugggauggaugugacuuggauuauuacugcaacaugggcaacuggccaucauguaccuauacaggggugacccagcauaaucacgcagccuuugucaaccuccugaauauugaaacagacuacacuaagaccuuccauuuucacucuaaaagaguaacggcucacggagauacaccccaacuagaccugaaggccaggccuacuuauggcgccggugagaucaccgugcuuguugaaguggcggauauggagcuccauaccaaaaaggucgagauuagugggcugaaguucgccucguuggugugcacaggaugcuacgcuuguagcuccggcaucucuugcaaaguacgaauacacguggacgaaccagaugaguuaacuguccauguuaagucaagcgaccccgaugugguggccgcauccaccagucugauggcucggaaacucgaguucgguacagacucuauuuuuaaggccuucagcgcaaugccuaaaacgucacuguguuuuuacaucgucgaacgcgaauauugcaaguccuguagugaggacgauacuaagaaaugcguggacaccaaacuugagcagccgcagagcauccugauugaacacaaaggcacaaucauagggaagcaaaacgauaccuguacugccaaggcuucuugcugguuggaguccguuaagucauucuuuuacggacuaaagaauaugcugggcagcguauucgggaacuuuuucgugggcauucuccuguuucuugcgccauucgucuuacuggugcucuuuuucauguucggauggaaaaucuuguuuuguuucaagugcuguagaaggacacggggucuguuuaaauaucgacaucucaaggacgaugaagagaccggguacagacgcauuaucgaaaggcuuaauucgaaaaagggaaagaaccgucuucuggacggcgagcgguuggccgauagaaaaauagcagagcuauucucuacgaagacucacauuggcuga

SEQ ID NO: 10303 - RNA, 5067 nt, Artificial Sequence
  derived and/or modified CDS sequence (opt3) from CCHFV(Ast133)__KX056060.1__GP
augcccaucaacauuaagcacacccugcucgugugcuucauacuuuaccugcaguugagcggcuuagggggagcccauggucaauccaaugcuacagagcacaacggcacuaauacgaccacagucccugggacuucucagucaccaaaaccgcccgcaaguaccacaccuccacauacccccgaaagcuccacuguuaagcugacaaccccuacgucugagacugaaggaucgggcgagaccacaccacccccuaacacuacccagggucuaccacucccggggacaacccccgaaagaucagccacgacugcgacaagcaccaguuccacugacaauaugaacucuacaacccaggugacggauaauaccccuacaagcacuguauccaucucaccaaguagcucucccuccaugccuucaaccagccaagggauucaccauccagugaggagucugcuuucugucuccagccccaaaacagugacuaccccgacaccuaugucgcccggcgagaugucuccagagaccuccucacagcacuuugcuaugagucggaucccuacucuguauacggccacacagguuagcaccgaaaacacugaccgcuccacaccccgacagucugagagcucagugcaaccagcaacccagagucccauuaccuccccugcccagacuaucuugcucaugagcgcugcaccaaaggccauacaggauaugcacccgucucccacaaaucguucaaaaagaaaccuggaagucgagaucauucugacgcucagucaaggcuuaaagaaguacuaugggaaaauccugaagcuguugcaucugacccuagaggaagacacugagggacuccuggaaugguguaaaaggaaucuugguagcaacugcgaugacgauuucuuucagaagcggauugaggaguucuuuaucacaggcgaaggguacuucaaugaggugcugcaguuuaaaaccuuguccacacucucuccuacugaaccaucgcacguacgccugcccaccgcugagccuuucaagagcuauuuugccaagggauucuuauccauagacucaggcuacuuuagugcgaaauguuauccaagaucuagcacguccggucugcaacucauuaacguuacccagcaucccgcaaggaucgccgaaacaccggggccuaagacuaccucacuuaaaacaauuaauugcaucaaccugcgggcuagcguguucaaggagcaccgcgaagucgagaucaacguguugcuaccacagauugccgugaaucugucuaacugucacgucguuauaaauucccaugugugcgauuacagucucgacacugauggacccguacgacugccuagaauccaccaugagggcaccuuuauucccggcacguacaaaaucgugauagacaggaagaacaaacuuaaugaucgguguagccuggucacaaacugcgugauuaaggggcgugaaguucgcaagggacagucuguguugagacaauauaaaaccgagaucaagaucgguaaagcauccacuggcucaaggaagcuccugagugaggaaccagacgacgauuguauuagccggacacaguuacugaaaaccgaaacugcugagauccacgacgauaauuacgggggaccuggcgacaagauuaccauaugcaacgguucgacaaucgucgaucagcgacuaggguccgagcucggcuguuauacgauuaaucgcgugaagucuuucaaacugugcgaaaacagcgccaccggaaagacuugcgagaucgacucaacacccguaaaauguagacagggcuucugccuuaagaucacccaagaagggaggggacauguuaaauugagucgggguuccgaggugguccuggaugcgugugacucuagcugcgagauuaugauaccaaagggcacaggggauauccucguggacuguuccggaggccagcagcacuuucugaaggauaaucuuauugaccuggguugcccgcacaucccuuugcucgggaaaauggccauuuacaucugucgcaugucaaaccaucccagaacuaccauggcauuccuguuuugguucagcuuuggcuaugucauaacgugcaucuucuguaaggcuuuauuuuaccugcuaauuaucauuggaacacucggcaaaaagaucaaacaguauagggaacugaagccacaaaccugcacuauaugugagaccgcccccgugaaugcuauugacgccgaaaugcacgaucuuaacugcaguuacaauaucugcccuuacugugcaucucguuugacauccgacgggcuggcccggcauguuacucagugcccaaagcgaaaagagaagguggaagagaccgagcucuaucugaacuuagaaaggauucccuggaucguaagaaaacugcuucaggucagcgagucgacaggaguggcuuugaagcgcucaucuuggcucauaguucugcuagugcugcucacggucagucuguccccugugcagagcgcgccgguaggucacggcaaaaccaucgaaacuuaccaaacacgggagggguucaccucuauuugucuuuuuauguugggaagcauccuguucauuguguccugcuuaguuaagggccucgucgauucagugagugacagcuuuuucccaggucugucuguguguaaaacuugcuccaucgggucaauaaacggcuuugaaauugagagucacaaguguuauugcagccuuuucuguugccccuacuguagacauugcuccgcagauagggagauccaccagcugcauuugucuaucugcaagaaacgcaagacaggaucgaaugucaugcucgccguuuguaaacgaaugugcuucaaggcuaccauugaagccagccggcgugcacugcuaaucagaucaauuauaaacacgacuuuugugauguguauccugacccucgccauuugcgugguauccacaagugcugucgagauggaagaccugccugccggcaccugggagagggaagaggaucuuacuaauuucugucaccaggagugccaagugacagaaaccgaguguuugugcccauaugaagcacugguuuuacgcaaaccccucuuuucugacagcaucgugaaggggaugaagaaccugcuuaauuccacaucacuggagacuucucuaagcauugaggcgccuuggggagcuaucaacguccagaguaccuucaaaccgacgguguccacagccaauauagcacucagcuggucuucaguugaacaucggggcaacaagauccuggugaccgguagauccgagaguauuaugaaauuggaagagaggacugggguaagcugggaucugggagucgaagacgccucggagucuaaguuacucaccguguccaucauggaucugagccagauguacucacccguguuugaguaucuuaguggcgaccgacaggucgaagaguggccaaaagcuacauguacuggugauugcccugaacgcuguggcugcaccucuuccacgugccugcacaaggaguggccccacagccggaauuggagauguaacccaacauggugcuggggaguuggaaccggcuguacuugcugugggguggacguaaaggacuuguucacagaucauauguuuauuaaauggaagguggaauacaucaaaaccgaggccauagucugcguggagcucacuucacaagaaaggcaguguagucugauugaggcaggaacacguuucaaucuaggcccuguuaccaucacgcugagcgaaccccgcaacauccagcagaaacuuccaccggagauuauaacucuccacccuaaaaucgaagagggguuuuucgaccugaugcaugugcaaaaggucuuguccgcuucuaccgugugcaagcugcagagcuguacacacgguauucccggagauuuacagaucuaccauauuggcaaucuccugaaaggugaccggguuaacggccaccuuauccacaagauagagccacauuuuaauaccuccuggaugucaugggaugggugcgaccuggauuauuacuguaacaugggagacuggcccucuugcacauauacuggcgugacccagcacaaccaugccgcguucgucaauuugcucaacaucgaaacggauuacacaaaaacuuuucacuuccacaguaagagaguaaccgcccauggggacacaccucaacuggaucuaaaagcuaggccaaccuauggagcaggcgagauuacugugcugguugaaguggccgacauggagcuucacaccaagaaagucgagaucucgggucucaaguucgcuagccugacaugcacgggguguuacgccugcuccucuggaauuucauguaaggugcgaauccauguagaugaacccgacgaguugacugugcacgucaaaagcuccgacccugauguuguggcagcgaguaccucuuuaauggcccggaagcuggaauuuggcacagacagcaccuucaaggcuuuuucagccaugccgaagacuucccucugcuucuauauaguggagcgcgaauacuguaaaaguugcagcgaggaugacacaaagaagugugucgauaccaaacuggagcagccacagucuauucuuaucgaacauaaggguacgaucauuggcaaacaaaaugacacuugcacagcaaaggcuuccuguuggcuggagucagugaaaucguuuuucuacggguugaagaacaugcuaggaagcguuuuuggcucuuucuuuguagggauccuucucuuccuggcccccuuugugcuuuuaguccuguucuucauguuuggauggaagauacucuucugcuuuaaauguugcagaaggacccggggcuuguucaaguaucgacaccugaaagaugacgaagagaccgguuacagacgcauuaucgaaaggcucaauaguaagaaagggaagaaccgucugcuugauggagagcggcuggcagacagaaagauugccgaguuguuuuccagcaaaacucacaucggcuga

SEQ ID NO: 10304 - RNA, 5067 nt, Artificial Sequence
  derived and/or modified CDS sequence (opt3) from CCHFV(Ast137)__KX056057.1__GP
augcccaucaacauuaugcacacccugcucgugugcuucauacuuuaccugcaguugagcggcuuagggggagcccauggucaauccaaugcuacagagcacaacggcacuaauacgaccacagugccugggacuucucagucaccaaagccgcccgcaaguaccacacugccucauaccccagaaagcuccacuguuaaacuaacaacccccacgucugagacugaaggaucgggcgagaccacaccuccacccaacacuacccagggucucccuccaccggggacaacccccgaaagaccugccacgacugcgacaucaaccagcaguacugacaauaugaacuccacaacccaggugacggauaauaccccaacaucuacuguaagcaucucccccucaaguagcccuucuaugccauccaccucacaaggcauucacuaucccgugaggagccugcuuagugucucuuccccgaagacagugacuaccccuacacccaugagcccaggagagaugucgccugagaccucuucccagcauucagcuaugagucggauccccacucuguacacggccgcacagguuagcacagaaaacaccaaucgcuccacuccacgacagucugagagcucagcccaacccgcuacccagaguccuacaaccuuuccagcacagacuauuuugcucauguccgccgcuccgaaagccauccaggacaugcaccccagcccuacaaaccguucuaagagaaaucuggaaguggagauaauccugacgcucucacaaggccugaaaaaguauuacgggaagauuuuaaaacuuuugcaccugacccuagaggaagauacugagggacuccuggaaugguguaagaggaaccuugguaguaauugcgacgaugacuucuuucagaaacggaucgaggaguucuuuauuacaggcgaaggguauuucaacgagguccugcaguuuaagaccuugagcacacucuccccaacugaacccucucaugugcgccugccuaccgcggagccauucaaaucguacuuugcaaagggauucuuaagcaucgauuccggcuauuuuucagccaaguguuaccccagaaguucuacgagcggucugcaacucauaaauguaacccagcacccggcuaggauugccgaaacaccugggccaaaaacuaccucccuuaagacaaucaacugcauuaaccugcgggcaucaguuuucaaagagcaucgcgaaguggagaucaaugucuugcuaccccagaucgcugugaaccugagcaauugucacguggucauuaacucucacguuugcgacuacucccucgauacugacggaccugugcgacugcccagaauacaucacgagggcaccuuuaucccaggcacguauaagauuguaaucgauaaaaagaauaaacuuaacgacagguguagucuggugacaaauugcgucauaaaggggcgggaagugcguaagggacagagcguuuugcgccaauacaaaaccgagauuaagaucgguaaagccucuacuggcuccagaaagcuccugucagaggaaccuggggaugacuguaucaguaggacacaguuacugaaaaccgaaacugcggagauucaugacgauaacuauggaggccccggugacaagaucaccauuugcaaugggagcacaauaguggaucagcggcuaggcucggagcucggauguuacacgaucaaccgagucaaguccuucaaacugugcgaaaauucugccaccggcaagacuugcgagauugacagcacaccagugaaaugucgccagggguucugccuuaagaucacccaagaaggaagaggucacguaaaauugucaaggggcagugagguugugcuggaugcaugugacuccucuugcgagaucaugauuccgaaggggacaggagauauacucgucgacuguagcggcggucagcagcauuuucugaaggauaaccuuaucgaccuggggugcccucacauucccuugcucggcaaaauggcuauccacauuugucggauguccaaucauccacgcacuaccauggccuuccuguuuugguucucauuuggauaugugaucacgugcauauucuguaaggcuuuauuuuacagccugaucauuaucggcacacuagggaaaaagauuaaacaguauagagaacucaagccccaaaccugcacuaucugugagaccgccccugucaacgcaauagaugccgaaaugcacgaccugaauugcaguuacaacauuugcccauacugugcuucuaggcuuacauccgacggauuggcgcgucaugugacucagugccccaagcggaaagagaagguugaagagaccgagcuguaucucaaccuggaacgaaucccuuggauugugagaaaauuacugcagguaagcgagucgacaggugucgcacuuaagaggucaucuugguugaucgugcuccugguucuacugacggugagucucuccccgguccagagcgccccagugggccacgggaaaaccauagaaacuuaccaaacacgcgagggauucaccaauaucugucuguuuaugcuuggcucuauuuuguucaucguaagcuaucuggugaaggguuuaguugauuccgucucagacucauuuuuccccgggcucagcgugugcaaaacuuguucuauuggcuccaucaacggauuugaaauagagucacacaagugcuacuguagucuguucugcuguccuuauugccggcauuguagcgcugauagagagauucaccagcuucaucugggcaucugcaagaaaaggaagacaggguccaaugugauguuggccgucugcaaacgcauguguuucaaggcaaccaucgaagccucucgacgggcucuccugauucguucgaucauuaacacgacuuuuguuauaugcauccuaacccuggccauuuguguggugagcacaucagcaguagagauggaaaaucucccagcgggaaccugggagagagaagaggaccugacuaacuucugccaccaggagugucaagucacagaaaccgagugccuuugucccuacgaggcuuuggugcugaggaaaccuuuauuucucgauuccaucguuaagggcacaaagaaucugcuuaacaguacuucucuggaaaccagccuauccauugaggccccguggggugcaaucaaugugcagucaacguucaaacccacagucucuaccgccaacauagcucucagcuggaguuccguggaacaucgcgggaauaagauccugguuacuggacggagcgagucuauuaugaaauuggaagagagaaccggcgugucaugggaccuggguguagaagaugccuccgagaguaaguuacucacagucagcaucauggaccugucgcagauguauucuccaguguuugaguaccuuuccggcgaucgacagguggaagaguggccuaaagcaacuugcaccggggacugucccgaaaggugcggauguacgagcucaacaugccugcacaaggaguggccacacagucgcaacuggcggugcaauccuaccugguguuggggcgucgggacuggaugcacauguugcggcguugaugugaaggacuuguucaccgaucauauguuuauuaaauggaagguagaauacaucaaaacugaggcuauagugugugucgagcucacaucucaagaaagacagugcucccugauugaggccgguaccagguucaaccuagggcccgugacgaucacucugagcgaaccacguaauauccagcagaaacuuccgccugagauuauaacccuccaccccaaaaucgaagagggauuuuucgaccugaugcauguucaaaagguguugucagcgaguacagucuguaagcugcagagcugcacccacggcauuccaggugacuuacagaucuaucauauuggcaaccuccugaaaggggaucgccuuaacggacaccugauccacaagauagagccccauuuuaauacauccuggaugucuugggacggcugugauuuggacuacuauugcaacaugggggauuggccuagcuguacuuacaccggagugacgcagcacaaucaugccgcuuucguuaaccuccugaauaucgaaacagacuauacuaaaaccuuucacuuccacuccaagcgggugacagcacauggcgauaccccacaacuagaccugaaagccagacccacuuacggugcuggggagauuaccguccuuguagaaguggccgauauggagcuccacacaaagaaaguugaggugucaggacugaaguucgcaucuuuggcgugcacgggcugcuaugccuguaguucggguaucagcugcaaggucaggauucauguggacgaaccugaugaguuaacuguacacgugaaauccucugacccggaugucguugcugccucaaccagccugauggcacgaaagcucgaauuuggcacagacuccaccuucaaggcuuuuagugccaugccaaagacuucucuguguuucuacaucguggagcgggaauacugcaaaagcuguucagaggacgauacaaagaagugcguggacaccaaacuugagcagccccaguccauacugauugaacauaaggggacgaucaucggaaaacaaaacgauacuuguacagcaaaggccaguugcugguuggagagcgucaaauccuuuuucuauggccuaaagaauaugcuggggucuguguuuggaaacuucuuuguuggcauucuccuguuccuugcuccuuuuguauuacugguccucuucuucaucuuugguuggaagauauuguucuguuuuaaaugcugucgcagaaccagggggcuguucaaguaccggcaccucaaagacgaugaagagaccggauaucgaaagauuaucgaaagacugaauaguaaaaagggcaagaaccgccuucuggacggcgagagguuggcggaucguaaaauugccgagcuauuuagcacuaagacacacaucggguga

SEQ ID NO: 10305 - RNA, 5067 nt, Artificial Sequence
  derived and/or modified CDS sequence (opt3) from CCHFV(Ast149)__KX056054.1__GP
augcccaucaacauuaugcacacccugcucgugugcuucauacuuuaccugcaguugagcggcuuagggggagcccauggucaauccaaugcuacagagcacaacggcacuaauacgaccacagcaccugggacuucucagucaccaaagccgcccgccaguaccacaccuccacauacccccgaaagcuccacugucaaacugacaaccccuacgucugagacugaaggaucgggcgagaccacaccacccccuaacacuacccagggucuaccaccgcccgggacaaccccugaaagaccagcgacgacugcuacaucaaccagcaguacugacaauaugaacuccacaacccagguuacggauaauacccccacaucuacugugagcaccuccccuucaaguagcccaucuaugcccuccacaucacaaggaauccacuauccgguaaggagccuccugagugugucuuccccuaagacugucaccacacccaccccaaugagcccuggcgagaugucgcccgagacuucuucccagcauucagccaugagucggauuccaacgcuuuacacagcagcccaggugagcaccgaaaacgcuaaucgcuccacuccccgacagucugagagcucagcacaaccugccacccagaguccaacaaccuuuccggcucagacuauccuguugauguccgccgcgcccaaagcaauucaggacaugcacccuagcccaacaaaccguucuaagagaaaucucgaaguugagaucauacugacgcugucacaaggccucaaaaaguauuacgggaagaucuuaaaacugcuucacuugacccuggaggaagauacugagggacuacucgaaugguguaagaggaaccuggguaguaauugcgacgaugacuucuuucagaaacggauugaggaguucuuuaucacaggcgaaggguauuucaacgaggugcuucaguuuaagacccugagcacauugucccccacugaaccuucucauguccgccucccaaccgccgagcccuucaaaucguacuuugcuaagggauuccugagcauugauuccggcuauuuuucagccaaguguuacccgagaaguucuacgagcgguuuacaacugaucaaugugacccagcacccugcaaggauagcugaaacaccagggcccaaaacuaccucccucaagacaauuaacugcaucaaccuucgggccucaguauucaaagagcaucgcgaaguugagauuaaugugcuguugccucagaucgcggucaaccuaagcaauugucacguggugaucuacucucacgucugcgacuauucccuggauacugacggacccguucgacucccaagaauacaucacgagggcaccuuuauaccuggcacguacaagaucgugauugauaaaaagaacaaacugaaugacagguguagucuuguaacaaacugcgugaucaaggggcgggaaguccguaagggacagagcgugcugcgccaauauaaaaccgagauaaagauugguaaagccucuacuggcuccagaaaguugcucucagaggaacccggggaugacuguaucaguaggacacagcuguuaaaaaccgaaacugcagagauccaugacgauaauuacggaggcccaggugacaagauuaccaucugcaacgggagcacaauuguugaucagcggcugggcucggagcuaggauguuauacgauaaaucgagugaaguccuucaaacucugcgaaaacucugcuaccggcaagacuugcgagaucgacagcacaccggucaaaugucgccagggguucugccugaagauuacccaagaaggaagaggucacgugaaacuuucaaggggcagugagguaguuuuggaugccugugacuccucuugcgagaucaugaucccuaaggggacaggagauauucugguggacuguagcggcggucagcagcauuuucucaaggauaaucugauagaccuugggugcccccacaucccacuguugggcaaaauggcuauuuacaucugucggauguccaaccacccccgcacuaccauggccuuccucuuuugguucucauuuggauaugucauuacgugcaucuucuguaaggcacuguuuuacagcuuaauaaucauuggcacacuggggaaaaagaucaaacaguacagagaacuaaagccucaaaccugcacuauuugugagaccgccccagugaaugcuaucgaugcggaaaugcaugaccucaacugcaguuauaauauaugccccuacugugcaucuaggcugacauccgacggacuugcccgucacgucacucagugcccuaagcggaaagagaagguggaagagaccgaguuguaucugaaccucgaaaggauuccguggaucguuagaaaacuguuacaggugagcgagucgacagguguagcucugaagaggucaucuuggcuuauugucuugcucgugcugcuaacgguuagucuguccccagugcagagcgcccccgucggccaugggaaaaccaucgaaacuuaccaaacacgcgagggauucaccaacauaugucucuuuaugcugggcucuauccuuuucauugugagcugcuugguaaagggucugguggauuccguuucagacaguuucuucccuggguuaagcgucuguaaaacuugcucuaucggcuccauuaauggauuugaaaucgagucacacaaguguuauugcagucucuucuguugcccauacugucggcacugcagcgcagauagagagauacaucagcugcaccuuggcauuugcaagaaaaggaagacaggguccaacgugaugcuggccguguguaaacgcaugugcuucaaggcuaccaucgaagccucucgacgggcauugcccauccguucgauuaucaauacgacuuuugucauuuguauacucacccuggcgaucugcguugugagcacaucagcuguggagauggaaaaccuaccugccggaaccugggagagagaagaggaccugacuaauuucugucaucaggagugccaaguaacagaaaccgagugucucugcccguaugaagcacugguccuuaggaaacccuuguuucuggauuccauugugaagggcaugaagaacuuacucaauaguacaucucuggagacuagccuuuccaucgaggccccauggggugcuauuaacguucagucaaccuucaaaccuacggugucuacagccaauaucgcacugagcuggaguuccgucgaacaccgcgggaacaagauucuagugaccggacggagcgagucuaucaugaaacucgaagagagaacuggcguuucaugggaccuggguguggaagaugcuuccgagaguaaguugcugaccguaagcauuauggacuuaucgcagauguacucucccgucuuugaguaccucuccggcgaucgacagguggaagaguggccaaaagccacauguacuggggacugcccugaacgauguggaugcaccagcucaacgugccugcauaaggaguggccccacagucgcaauuggcgguguaacccaacauggugcuggggcguggggaccggauguacuugcuguggcgucgauguuaaggaccuuuucacagaucacauguuuaucaaauggaagguggaauauauuaaaaccgaggcgaucguaugcguggagcugacuucucaagaaagacaguguuccuugauagaggccgguacaagguucaaucucgggccggucaccauuacgcugagcgaaccucguaacauccagcagaagcuacccccagagaucauuacucugcaucccaaaauagaagagggauuuuucgaccuuaugcacgugcaaaagguucucucagcuaguaccgugugcaagcugcagagcuguacacauggcaucccuggugacuugcagauuuaccacaucggcaaucuguuaaaaggggaucgccucaacggacaucugauucacaagaucgagccacacuuuaacaccuccuggaugucuugggacggcugcgaucuugacuauuacuguaauaugggggauuggcccagcugcacauauacuggagucacccagcauaaccacgcagccuucgugaaucuguugaacauagaaacggacuacacaaaaacuuuucauuuccacuccaagcggguuaccgcucacggcgauacaccucaacucgaccugaaagccagaccgaccuauggugcaggggagaucacugugcuagucgaaguagcggauauggagcugcauaccaagaaaguggagguuucaggacuuaaguucgccucucucgcuugcacaggcuguuacgccugcaguucggguauuagcuguaaggugaggauccacgucgacgaaccagaugagcugacggugcauguaaaauccucugaccccgauguggucgcagcuucaacuagcuugauggcccgaaaguuagaauuuggcaccgacuccacauucaaagcauuuagugccaugccuaagaccucucugugcuucuacauuguugagcgggaauauuguaaaagcugcucagaggacgauacuaagaaguguguggacacaaaacucgagcagccccaguccauccugauagaacacaaggggaccauuaucggaaaacaaaaugauacgugcacugcuaaggcgaguuguuggcuugagagcgugaaaucauuuuucuacggccugaagaacauguugggguccgucuuuggaaauuucuuugugggcauccuacuguuccucgccccauuuguucugcuugcauuauucuucauuuuugguuggaagauccuguucugcuuuaaauguugccgcagaacaagggggcucuuuaaguaucggcauuugaaagacgaugaagagaccggauaccgaaagauaauugaaagacugaacucuaaaaagggcaagaaucgccuccuggacggcgagaggcuugcugaucguaaaaucgccgagcuguuuagcaccaagacucacauuggguga

SEQ ID NO: 10306 - RNA, 5067 nt, Artificial Sequence
  derived and/or modified CDS sequence (opt3) from CCHFV(Ast199)__KX056051.1__GP
augcccaucaacauuaugcacacccugcucgugugcuucauacuuuaccugcaguugagcggcuuagggggagcccauguccaauccaaugcuacagagcacaacgguacuaauacgaccacaguuccuggcacuucucagucaccaaagccgcccgcaaguaccacacugccucauaccccagaaagcuccacugugaaacuaacaacccccacgucugagacugaagggucgggagagaccacaccuccacccaacacuacccagggccucccuccaccggguacaacccccgaaagaccugccacgacugcgacaaccacuucaagcacagacaauaugaacaguaccacgcagguaaccgauaauacaccaacuuccaccgugucuaucagccccuccucaaacccuaguaugccaagcacaucucaagggauucacuaucccgucaggucccugcuuucagugagcaguccgaagacuguuaccacaccuacccccaugucuccaggagagauguccccugagacuagcucgcagcauucugcuaugucccggauccccacgcuguacacagccgcacaggugucaaccgaaaauacuaaccgcaguaccccacgacagagcgaguccucugcccaacccgcuacacagagcccuaccacuuuuccagcacagacaauuccguugaugucagccgcucccaaagccauccaggacaugcacccuaguccaacgaaucguuccaagagaaaccucgaagucgagauaauccugacccugagccaaggccucaaaaaguauuacggcaagauuuuaaaacugcuucacuugacucuggaggaagauacagaggggcuacucgaaugguguaagaggaaucugggaucuaacugcgacgaugacuucuuucagaaacggaucgaggaguucuuuauuaccggugagggcuauuucaaugaggugcuucaguuuaagacacccucaacucugaguccuaccgaaccaagccauguacgcuugcccacggcggagccguucaaauccuacuuugcaaagggguuccucucuaucgauucgggauauuuuagcgccaaguguuacccuagauccucaaccaguggccugcaauuaauaaacguuacacagcacccagcuaggauugccgaaacucccgguccuaaaaccacaucucugaagacuaucaacugcauuaaucuccgggcaagcguguucaaagagcaucgcgaagucgagaucaacgugcuucugccccagaucgcugugaauuuguccaacugucacgucguuauuaauucacacgugugcgacuacagccuagauaccgacgggccaguacgacugccuagaauacaucacgagggaacguuuauccccggcacauauaagauugugaucgauaaaaagaacaaacucaaugacagguguucucuggucaccaacugcgugauaaagggccgggaaguucguaaggggcaguccgugcuucgccaauacaaaacugagauuaagaucggaaaagccaguacagguagcagaaagcuguugucugaagaaccaggcgaugacuguaucuccaggacccagcuccugaaaacugaaaccgcggagauucaugacgauaauuaugggggaccgggcgacaagaucacaauuugcaacgguucaacgauagucgaucagcgguuagggagugagcugggcuguuacaccaucaaucgaguaaagagcuucaaacuaugcgaaaacucggccacuggaaagacaugcgagauugacuccaccccuguaaaaugucgccagggcuucugccucaagaucacacaagaagggagaggacacguuaaacugucuagggguagcgaggugguccuugaugcaugugacucaaguugcgagaucaugauucccaagggcacuggggauauauugguggacuguuccggaggccagcagcauuuucugaaggauaaucucaucgaccuggguugcccacacauuccccuucuggggaaaauggcuaucuauauuugucggaugucuaaccacccucgcaccacgauggccuucuuguuuugguucagcuuuggcuacgucaucacaugcauauucuguaaggcucucuuuuauucccugaucauuaucggaaccuuaggcaaaaagauuaaacaguacagagaacugaagccacaaacuugcaccaucugugagacagcccccgugaaugcaauagaugccgaaaugcaugaccuaaacugcucauacaacauuugcccuuauugugcuagcaggcucaccagugacgggcuggcgcgucacguuacucagugcccgaagcggaaagagaagguggaagagacagagcuuuacuugaaucuggaacgaaucccauggauuguaagaaaacuccugcaggucucugaguccacgggaguggcauuaaagagguguagcuggcugaucguucuuuuggugcuccugaccgucucgcuaucacccgugcagucugccccuguaggucauggcaaaacuauagaaacauaucaaacccgcgagggguucacuaacaucugccuguuuaugcucggaaguauucuguucaucguguccugucuuguuaagggcuuggucgauagcgugucugacagcuuuuucccaggucuguccgugugcaaaacauguucaauugggaguaucaauggcuuugaaauagagagccacaagugcuacuguucuuuauucugcugucccuauugccggcacugcuccgcugauagagagauucaucagcuccaccugggaaucuguaagaaaaggaagaccggcucaaacgucaugcuugccguuugcaaacgcauguguuucaaggcaacgaucgaagccagucgacgggcucuguugauucguagcaucauuaauacuaccuuugugauaugcauccucacacuggccauuugugugguauccaccucugcagucgagauggaaaaccuaccugcggggacuugggagagagaagaggaccugacaaauuucugccaucaggagugucaagugaccgaaacagagugccucuguccguacgaagcucugguucuuaggaaacccuuguuucuggauucgaucgugaagggaaugaagaacuuacucaauagcacuucacuggagaccucccuuaguauugaggccccauggggcgcaaucaacguccagucuacguucaaaccuacagugagcaccgccaauauagcucuguccuggucaucuguugaacaccgcgguaacaagauccuagugacugggcggagcgagaguauuaugaaacucgaagagagaaccggaguauccugggaccugggcgucgaagaugccagcgagucuaaguugcugacagugucaaucauggacuuaucccagauguauagucccguguuugaguaccucagcggugauaggcaggucgaagaguggccaaaagcaacuugcaccggcgacuguccugaacgaugcgggugcacgucgucuacaugucugcauaaggaguggccccacucccgcaauuggcggugcaacccaaccugguguuggggaguuggcacugggugcacauguugcggaguggauguaaaggaccuuuucaccgaucacauguuuauuaaauggaagguggaauacaucaaaacugaggcuauagucuguguggagcugacaagccaagaaagacagugcucauugauugaggccggcaccagguucaaucucgguccgguuacgaucacucugagugaaccucguaacauccagcagaagcuacccccagagauuauaacccugcaucccaaaaucgaagagggguuuuucgaccuuaugcacgugcaaaagguccucucugcguccacaguguguaagcugcagagcugcacccauggcauuccuggagacuugcagaucuaucacauugguaaccuguuaaaaggcgaucgccucaaugggcaucugauccacaagauagagccacacuuuaacacaucauggaugaguugggacggaugugaucuugacuacuauugcaauaugggcgauuggcccagcugcacuuacaccgggguuacgcagcauaaccacgccgcuuucgugaaucuguugaacaucgaaacagacuauacuaaaaccuuucauuuccacuccaagcgggucacagcacacggagauaccccucaacucgaccugaaagccagaccgacuuacggcgcuggugagauuaccgugcuaguggaaguugccgauauggagcugcauacaaagaaaguggaggucucugggcuuaaguucgcaagccucgcguguacgggaugcuaugccuguuccucaggcaucucuugcaaggugaggauucacguagacgaaccagaugagcugacugugcaugucaaaaguucggaccccgauguuguggcugccagcaccuccuugauggcacgaaaguuagaauuugguacagacucuaccuucaaggcuuuuucagccaugccuaaaacuagccuguguuucuacaucguggagcgggaauacugcaaauccuguagugaggacgauacaaagaagugcgucgacaccaaacucgagcagccccagucuauacugauugaacacaagggcacgaucaucgggaaacaaaaugauacuuguacagcaaaggccagcugcuggcuugagucagugaaauccuuuuucuauggacugaagaacauguugggcaguguuuuugggaauuucuuuguaggcauucuacuguuccucgcuccauuugugcugcuugucuuauucuucaucuuuggauggaagauacuguucuguuuuaaaugcugccgcagaaccaggggucucuucaaguaccggcauuugaaagacgaugaagagaccggguaucgaaagauuaucgaaagacugaacagcaaaaagggaaagaaucgccuccuggacggcgagaggcuugcggaucguaaaauugccgagcuguuuucuacuaagacacacaucggcuga

SEQ ID NO: 10307 - RNA, 5067 nt, Artificial Sequence
  derived and/or modified CDS sequence (opt3) from CCHFV(Saf)__KX013487.1__GP
augcccaccaacaucaugcacacacugcucgugugcuucauucuuuaccugcaguuguuaggccuugggggagcccauggucaaagcaaugcuacugagcacaacggcacgaauaccacaacugcaccuuccaccucucagucaccaaagccgcuagucaguacagcgcccccucaugcccucgaaagcuccaccauaaaaccaacuacacccgcuucugagaccgaagggucgggagagacgacuccuccacccaacaccacacagggcccuucaccaccggaaacuacccccgagagaccugccacaaccgcaacgagcacuccaaguacagacaauaccaacuccacuacacacguuaccgauaauaaccccacgucuaccaucagcacauccccuucaaguagcccaucuacucccuccaccccgcaggguauucaucacccugccaggaaucugcuuucagugagcagucccaagacagcuacuaccccaacaccuaccucucccggggagaucuccagcgaaacuucgucucugcacuccgcaaugucacggacgaguacauuguauaccgccacucaaguaagcaccgagaacgcuaaucauuccgccccacgccagucugaaagcucagcgcagcccacaaccacaaguccuaugacuuccccagcacagagcauucucgugaugucugccgcuccgacggccauccaaaacauacaccccucaccuaccaaucgaaguaaacguaaccuggagauggagaucauucugacucucagccagggauuaaagaaauacuauggcaagauccugaagcuguugcaucugacacuagaagaggacaccgaaggccuccuggagugguguaaaagaaaucuuggguccaacugcgaugacgacuuuuuccagaagaggauugaagaguuuuucaugacaggagaggguuacuuuaacgaaguccugcaguucaaaacuuugucuacccucucgccaacggagcccagccacgcacggccuccaaccguggaacccuuuaaguccuauuucgcuaaaggcuuucugucaaucgauaguggguacuucucugccaaguguuauccgcgcagcuccacaucaggauuacaacugauaaauguuacucagcacccugcgagaauugccgagaccccaggccccaagacaacuagccucaaaaccaucaacugcauuaaucuuagggcaucuguguuuaaggaacaucgggagaucgagaucaacguccuguugccucagauugcugugaaucuauccaacugucacguaguuauaaauagucaugugugcgauuacagccuggacacggauggucccguccgccucccacacauccaucacgaagggacauucauuccuggaaccuacaaaaucgugauagacaaggagaacaaacugaaugaucgauguacucuugugacaaacugcgucauuaagggcagagaaguuaggaaaggccaaucugugcugcggcaguauaagaccgagaucaagaucgggaaagccuccacuggaucacguaaguugcucagugaggaacccggugacgauuguauuagccgcacccagcuguuaagaacagagacggcugaaauccacgacgacaauuacggcgggccaggagauaaaauuaccauaugcaacggcucgacuaucguagaccagaggcuggguuccgagcuaggguguuauacaauuaaucgggugaagucuuuuaaacucugcgaaaacagcgccaccggcaagacaugcgagaucgauucaacuccggucaagugucgacaaggauucugccugaaaaucacccaggagggccgcgggcaugugaagcugaguagaggauccgaaguuguguuggacgcaugugauucuagcugcgaggucaugauuccuaaagguacgggcgacauacugguggauuguuccgggggacagcagcacuaccucaaggacaaucugaucgaucuuggcugcccccauauuccacuguuggguaaaauggccaucuauauuuguaggaugucaaaccacccccggacaaccauggcuuuccucuuuugguucagcuuuggguacguaaucacuugcauauucuguaaggcgcuguuuuauaguuuaaucauuaucggcacccugggaaagaaaauuaagcaauaccgcgaacuaaaaccucagacaugcacuaucugugagaccgcaccaguuaacgccauagacgcugaaaugcacgaucucaauugcucuuacaacauuugccccuauugugccuccagacugacaagcgacggccuugcaaggcaugugccucagugcccgaagcguaaagagaaggucgaggaaacggaguuguaccugaaucucgaacggaucccauggauugugcgaaagcuguuacaggucucggagucaaccgggguggcccugaaaagaucuaguuggcuuaucguuuugcucgugcugcuaacuguaucccugagccccguccaaucugcuccugugggacacgguaagacaauagaaaccuaucagacuagggagggcuucacaagcaucugucucuuuaugcugggguccauucuuuucuugguuucaugccuggugaaaggauuagucgacagugugagcgauuccuuuuucccaggccucucuguauguaagaccugcucaaucgguaguauuaacggguuugagaucgaaagccauaaauguuacugcucccuguucuguugccccuauugucgccacugcucugccgaccgggagauacaucagcuucaccugucgauuugcaagaaaagaaagacgggcagcaaugugauguuggcaguuuguaagaggaugugcuuucgcgcgacuaucgaggcuucacgacgggcccuccugauccguuccauuaucaacaccacauucgucauuuguauacuaacccugacuaucugcguggugaguacaucugcagucgaaauggaaaaucucccuagcggaaccugggagagagaggaagaucugacaaacuucugucaccaggagugccaaguuacugaaaccgagugucuuugcccguacgaggccuuggugcugaggaaacccuuauuuuccgacucaauugugaagggcaugaaaaaucuccugaacucuacgagccuugaaacaagucuguccaucgaggcuccauggggagccauuaauguacagagcaccuucaagccuacugucucuaccgcaaacaucgcucuaucaugguccaguguggaacaucgcgggaauaaaauacucguuacaggccggagcgagucgaucaugaagcuggaagagagaacuggugugucuugggauuugggggucgaggacgccuccgaaagcaagcuguuaaccgugucaauuauggaucucagucagauguauucucccguuuuugaguaccuguccggagacaggcaaguggaagaguggccaaaagcgacguguacaggcgauugcccugaacgaugugguugcaccagcucaacuugccuucacaaggaguggccccauagucgcaacuggcgguguaauccaacauggugcuggggcguagggaccggauguacuugcuguggcgucgacgugaaagaucuguucacagaccacauguuugugaaguggaaagucgaguacaucaagaccgaagccauuguuugcguggaguugacgagccaggaaagacaguguucccucaucgaggcugggacuagguucaaccugggaccgguaaccauaacacuaucugaaccucguaacauucagcaaaagcugcccccagagaucaucacccuucaucccaaaguggaggaaggcuuuuucgaucucaugcacguccagaaggugcugagcgcauccacaguuugcaaauugcagucauguacucacgguauuccuggggaccuucagguguaucauauaggaaauuuacucaagggcgaccgcgucaacggucaccugauccauaaaauugagccacacuuuaauaccucuuggaugaguugggauggcugcgaccuugauuacuauuguaacaugggggacuggcccucgugcacguacacaggagugacucaacacaaucaugccgcuuucguuaaccuguugaauaucgaaaccgauuauaugaagacauuucacuuccauagcaagcgggugaccgcccacggcgacacuccucagcucgaucugaaagcaagaccgaccuacggggcgggagagauuacaguccuaguagagguggccgacauggaacugcauacgaagaaaguugagaucuccggccuuaaguuugugucucucgcuugcacugguuguuaugccugcucaagcgggauauccuguaaagucaggauccacguggaugaaccagacgagcugaccguacacgugaagaguucugaucccgacgucguugcagcuagcacaucauugauggcccgaaaauuagaguucggaaccgauuccacuuucaaggcauuuagugccaugccuaagacaagccugugcuucuacauuguggaacgggaguacuguaaaucuugcuccgaagaggacacccagaaguguguggacacgaaacucgaacagccccaaucaauccugauugagcauaagggcacuaucauagguaaacagaacgauacaugcaccgcuaaggcgagcuguuggcuugaaucggucaagucuuucuuuuauggccugaaaaauauguuggggaguguguuuggaaacuucuuuauuggcauccuacuguuccucgccccauuuguucugcuuguauuauucuuuauguucggguggaagauccuguucugcuuuaaauguugccgcagaaccaggggacucuugaaguaccggcaccugaaagacgaugaggagacuggcuaucgaagaauuaucgaacgccucaauaacaagaaggguaaaaauaggcugcuugacggggagcgucuggcagaucggaagauagcugaauuguucuccacaaaaacccauauuggauga

SEQ ID NO: 10308 - RNA, 5067 nt, Artificial Sequence
  derived and/or modified CDS sequence (opt3) from CCHFV(Min)__KX013481.1__GP
augcccaccaacaucaugcacacacugcucgugugcuucauucuuuaccugcaguuguuaggccuugggggagcccauggucaaagcaaugcuacugagcacaacggcacgaauaccacaacugcaccuuccaccucucagucaccaaagccgcuagucaguacagccccgccucaugcgcucgaaagcuccaccauaaaaccaacuacacccgcuucugagaccgaagggucgggagagacgacuccuccacccaacaccacacagggcccuucaccaccggaaacuacccccgagagaccugccacaaccgcaacgagcacuccaaguacagacaauaccaacuccacuacacacguuaccgauaauaaccccacgucuaccaucagcacauccccuucaaguagcccaucuacucccuccaccccgcaggguauucaucacccugccaggaaucugcuuucagugagcagucugaagacagcuacuacccccacaccaaccucuccuggggagaucuccagcgaaacuucgucuuugcacuccgcaaugucacggacgaguacacucuauaccgccacucaaguaagcaccgagaacgcuaaucauuccgcgccccgccagucugaaagcucagcccagccaacaaccacuagccccaugacauccccugcacagagcauucuggugaugucugccgcuccaaucgccauacaaaacauccacccgucacccacgaaucgaaguaaacguaaccuggagauggagauuauccucaccuuaagccagggacugaagaaauacuauggcaagauucuuaaguugcugcaucuaacucucgaagaggacacagaaggccugcuugagugguguaaaagaaaucugggguccaacugcgaugacgacuuuuuccagaagaggaucgaagaguuuuucaugaccggagaggguuacuuuaacgaagucuugcaguucaaaacacucucuacucugucgccuaccgagccaagccacgcacggcccccuacgguggaaccauuuaaguccuauuucgcuaaaggcuuuuuaucaauagauaguggguacuucucugccaaguguuauccccgcagcuccaccucaggacugcaacucauuaauguuacacagcacccggcgagaaucgccgagacuccuggcccaaagaccacaagccuuaaaacuauuaacugcaucaaucugagggcaucuguguuuaaggaacaucgggagaucgagauuaacgucuugcuaccccagauagcugugaaucuguccaacugucacguaguuaucaauagucaugugugcgauuacagccucgacaccgaugguccuguccgccugccccacauuuaccaugaagggacguucaucccaggaacauauaaaauagugauugacaagaaaaacaaacuuaaugaucgauguacccuggugacuaacugcgucaucaagggcagagagguuaggaagggccaaucuguguugcggcaguacaagacagaaaucaaaauugggaaggccuccaccggaucacguaaacuccugagugaggaaccuggugacgauuguaucagccgcacucaguuacugagaaccgagacagcugagauucacgacgacaauuauggcgggcccggagauaagauaacgaucugcaacggcucgaccauuguagaccagaggcuagguuccgaacucggguguuacacuaucaaucgggugaaaucuuuuaagcugugcgagaacagcgccacaggcaagaccugcgaaaucgauucaacaccagucaaaugucgacaaggauucugccuuaagauuacucaggagggccgcgggcacgugaaauugaguagaggauccgagguugugcuggacgcaugugauucuagcugcgaagucaugauaccgaaggguaccggcgacauccucguggauuguuccgggggacagcagcauuuccugaaagacaaucuuauugaucugggcugcccucacauccccuugcucgguaagauggccauuuauaucuguaggaugucaaaccauccacggacgacaauggcuuuucuguucugguuuagcuucggguacguaauaaccugcaucuuuuguaaggcguuauucuauagucugauuaucauuggcacucuagggaaaaagaucaaacaauaccgcgagcucaagccccagaccugcacaauaugugaaacugcaccuguuaacgccauugacgcugagaugcacgaucugaauugcucuuacaacaucugcccauauugugccuccagacuuaccagcgacggcuuggcaaggcacgugccccagugcccuaaacguaaggaaaaggucgaggagacagaacuguaccucaaucuggagcggauuccguggaucgugcgaaaauuacugcaggucucggaaucaacggggguggcccuuaagagaucuaguugguugauaguucuccuggugcuacugaccguaucccucagcccaguccaaucugcucccgugggacaugguaaaacuaucgagacauaucagaccagggaaggcuuuacuagcauuugucuguucaugcuuggguccaucuuguuucugguuucaugcuuagugaagggacucgucgacagugugagcgauucuuucuuuccuggccuguccguauguaaaacaugcaccauugguucaaucaacggguucgagauagagagucacaaguguuacugcagccuguuuuguugcccauauugucgccauugcuccgccgaccgggaaauucaccagcugcauuugucuaucugcaaaaagagaaagacgggcucgaaugugaugcucgcaguuuguaaaaggaugugcuuccgcgcgacuaucgaggcuagccgacgggcccugcuaauucguucaaucauuaacaccacauucgucauauguauccugacccucacuauuugcgugguguccacaagugcagucgaaauggagaaucugcccucuggaaccugggaaagagaggaggaucuuacaaacuuuugucaccaggaaugccaaguuacugagaccgaauguuugugcccuuacgaggcccugguguuaaggaagccccucuuccuggacagcaucgugaaaggcacgaagaaucuucugaacuccacaucacuagagaccucucucagcauugaagcucccuggggagccaucaauguacagaguacuuuuaaaccaaccgucuccacagcaaacauagcucugagcuggucuucaguggagcaccgcggaaauaagaucuugguuacuggccgguccgaaaguauuaugaagcuggaggaaagaaccggugugagcugggauuuaggggucgaggacgccucggagucuaaacuccugacgguguccaucauggaucuuagccagauguauucaccuguuuucgaauaccugaguggagacaggcaaguggaggaauggcccaaggcgacauguaccggcgauugcccagagcgaugugguugcacuucuuccacaugcuugcauaaagaauggccucacagccgcaacuggcgguguaaucccaccuggugcuggggcguagggacuggauguacaugcuguggcgucgacgugaaggaucucuuuaccgaccauauguucgugaaauggaaggucgaguacauuaagacggaggccaucguuugcguggaacugacuucacaggagagacaguguagucuaauagaagcugggaccagguuuaaccugggaccaguaacaauuacccuuagcgagccgcguaacauccagcaaaaacucccucccgaaaucauuacacugcacccaaagguggaggagggcuucuuugauuugaugcauguccagaaagugcuguccgcaucuacuguuugcaaguuacagagcuguacccacgguauacccggggaccuccagguguaucacaucggaaaucugcuuaaaggcgaccgcauuaacggucaucugauccacaagauugaaccucauuucaauacguccuggaugucaugggauggcugcgacuuggauuacuauuguaacaugggggacuggccaucuugcacauacacuggagucacccaacacaaucacgccgcuuuugugaaccuccugaauaucgagacagauuauaccaagacuuuccauuuucacaguaaacggguuaccgcccauggcgacacaccccagcuagaucugaaggcaagaccuacguacggggcgggagaaauaacugugcuugucgagguagccgacauggagcuccacaccaaaaagguggaaaucucgggccugaaauucgcuagcuuggccugcacagguuguuaugcaugcuccucugggauuucauguaagguuaggauccauguggaugagccggacgaauuaaccguccacgugaaaagcuccgauccagacguaguggcugccaguacuucucugauggcacgaaagcucgaguucggaacagauagcaccuuuaaggccuucucagcuaugcccaaaacgucccugugcuuuuacauugucgaacgggaguacuguaagaguugcagcgaggaagacacucagaaauguguugacacaaaacuugagcagccucaaucuauccugauagaacacaagggcaccauuaucgguaagcagaacgauaccugcacugcgaaggccuccuguugguuggagucagugaaaaguuucuuuuauggccuaaagaauaugcuggggucgguguucggaaacuuuuucaucggcauucuccuguuucuugcacccuucgucuuacuggugcucuuuuucauguucggguggaaaaucuuguuuugcuucaaguguugccgcagaacaaggggacugcucaaauaccggcaucugaaggacgaugaagagaccggcuaucgaagaauaauugagcgccuuaauaacaagaaagguaagaauaggcuguuggacggggaacgucuagcugaucggaaaaucgccgagcuguuuucuacaaagacucacauuggauga

SEQ ID NO: 10309 - RNA, 5067 nt, Artificial Sequence
  derived and/or modified CDS sequence (opt3) from CCHFV(Mamon)__KX013478.1__GP
augcccaccaacaucaugcacacacugcucgugugcuucauucuuuaccugcaguuguuaggccuagggggagcccauggucaaagcaauacuacggagcacaacggcaccaauacaacuaccgcuccuuccacaucucagucaccaaagccgcuagucaguaccgcacccccucaugcccucgaaagcuccacuauaaaaccaacaacccccgcgucugagacggaagggucgggagagacuaccccuccacccaacaucacacagggcccuucaccaccggaaacuacccccgagagaccugcuacaaccgccacgagcacuccaaguacagacaauaccaacuccacuacacacguuaccgauaauaaccccacgucuaccauuagcacauccccuucaaguagcccaucuacucccuccaccccgcaggguauccaucacccugcaaggaaucugcuuucagugagcagucccaagacagccacuaccccaacaccuaccucucccggggagauuuccagcaaaacuucgucucugcacuccgcuaugucacggacgaguacauuguauaccgcaacucaaguaagcaccgaaaacgccaaucauuccgcuccacgccagucugagagcucagcccagcccacaaccacaaguccuaugacuuccccagcgcagagcauccucgugaugucugcagccccgacggcuauacaaaacauccaccccucaccuaccaaucgaaguaagcguaaccuggaaauggagauuauccugacucucagccagggacugaaaaaguacuauggcaagauucugaaacuuuugcaucugacacuagaggaagacaccgagggccuccuggaaugguguaagagaaaucuuggguccaacugcgaugacgauuucuuccagaaaaggaucgaggaauuuuucaugacaggagaggguuacuuuaacgagguccugcaguucaagacuuugucuacccucucgccaacggaacccagccacgcccggccuccaaccguggagcccuuuaaauccuauuucgcaaagggcuuucugucaauagacaguggguacuucucugcuaaguguuauccgcgcagcuccacaucaggauuacaacugauuaauguuacucagcacccugccagaaucgcggaaaccccaggccccaaaacaacuagccucaagaccauuaacugcaucaaucuuagggccucuguguuuaaagagcaucgggaaaucgagauuaacguccuguugccucagauagcagugaaucuauccaacugucacguaguuaucaauagucaugugugcgauuacagccuggacacggauggucccguccgccucccacacauuuaccaugaggggacauucaucccuggaaccuauaagauagugauugacaaaaagaacaaacugaaugaucgauguacucuugugacaaacugcgucaucaagggcagagaaguuaggaagggccaaucugugcugcggcaguacaaaaccgagaucaagauugggaaggcuuccacuggaucacguaaguugcucagugaggaacccggugacgauuguaucagccgcacccagcuguuaagaacagaaacggccgagauucacgacgacaauuauggcgggccaggagauaaaauaaccaucugcaacggcucgacuauuguagaccagaggcuggguuccgagcuaggguguuacacaaucaaucgggugaagucuuuuaagcucugcgaaaacagcgcuaccggcaaaacaugcgagaucgauucaacuccggucaagugucgacaaggauucugccugaaaauuacccaggaaggccgcgggcacgugaaacuuaguagaggauccgagguugugucugacgccugugauagcuccugcgaggucaugauaccuaaagguacgggcgacaucuugguggauuguucagggggacagcagcauuuccugaaggacaaucucauugaucugggcugcccccacaucccacuucuggguaagauggcaauuuauaucuguaggaugagcaaccauccccggacaaccguagccuuuuuguucugguuuaguuucggguacguuauaacuugcaucuuuuguaaagcucucuucuauucucugauuaucauuggcaccuuaggaaagaaaaucaagcaauaccgcgaacugaaaccucagacaugcacuauaugugagaccgcgccagugaacgcaauugacgccgaaaugcacgaucuaaauugcuccuacaacaucugccccuauugugcuagcagacucacaucggacggccuggccaggcacgucccucagugcccgaagcguaaggagaaaguggaagagacggagcuuuacuugaaucuggaacggauuccauggaucguccgaaagcucuuacaggugucagagucuaccgggguugcauuaaaaagaaguuccuggcugauagugcuuuugguacuccugacugucagccuaucucccgugcaaagcgccccuguuggacaugguaagacaaucgaaaccuaucagacuagggagggcuuuacauccauuugucuguucaugcucgggucaauccuguuucuugugaguugcuuggucaaaggacugguggacagcguaucugauuccuucuuuccaggcuuaucaguguguaagaccugcaguauugguagcaucaacggguucgaaauagagucccacaaauguuacugcucucucuuuuguugccccuauugucgccauugcucggcugaccgggagauucaccagcugcaucuuagcaucugcaagaagagaaaaacgggcucaaauguuaugcuggccgucuguaagaggaugugcuuccgcgcaacuaucgaagcgucccgacgggcuuugcucauucguaguaucauuaacaccacauucgugauauguauccugacccuaacuauuugcguggucucuacaagcgccguugagauggaaaaucugccuuccggaaccugggagagagaagaggaucucacaaacuuuugucaccaggagugccaagugacugaaaccgagugucugugcccguacgaagcacuuguguugaggaaaccccuguucuuagacucaaucguaaagggcaugaaaaaucuccugaacucuacgagccuugagacaagucuguccauugaggccccauggggagcuaucaauguccagagcaccuuuaagccuacugugucuaccgccaacauagcacuaucaugguccaguguugaacaccgcgggaauaagauccucgugacaggccggagcgagucgauuaugaaacuggaagagagaacuggugucucuugggauuuggggguggaagacgcuuccgagagcaagcuguuaaccguuucaaucauggaucucagucagauguauucucccguguucgaguaccuguccggagacaggcaaguagaagaguggccaaaagccacguguacaggcgauugcccugaacgaugugguugcaccagcucaacuugccuucauaaggaguggccccacagucgcaacuggcgguguaauccaacauggugcuggggcgucgggaccggauguacuugcuguggcguggacgugaaagaucuguuuacagaccauauguucgucaaguggaagguugaauacauuaaaaccgaggcgaucgugugcguagaguugacgagccaggaaagacaguguucccucauagaggccgggacuagguuuaaccugggaccggugaccauuacacuaucugaaccucguaacauccagcaaaagcugcccccagagaucauuacccuucaccccaaagucgaagagggcuucuuugaucucaugcaugugcagaagguucugagcgcuuccacagugugcaaauugcagucauguacucacgguauaccuggggaccugcaggucuaucacaucggaaauuuacucaagggcgaccgcgugaacggucaucugauucacaagaucgagccacauuucaauaccucuuggaugaguugggauggcugcgaccuugauuacuauuguaacaugggggacuggcccucgugcacguacacaggaguuacucaacacaaucacgcagccuuugugaaccuguugaauauugaaaccgauuauacaaaaaccuuccauuuucacagcaagcgggucacugcucauggcgacaccccucagcucgaucugaaagccagaccgacauacggggcaggagagaucacgguacugguggaaguugcggacauggagcugcacacuaagaaaguggagauauccggccuuaaguucgccucucucgcuugcaccgguuguuaugccugcucaagcgggaucuccuguaaagucaggauucauguggaugaaccagacgagcugacaguacacgugaagaguucugaucccgacgucguugcagcuagcaccucauugauggcccgaaaguuagaauuuggaacugauuccacauuuaaagcauucagugccaugccuaagaccagccugugcuuuuacaucguggagcgggaauacuguaaaucuugcuccgaggaggacacgcagaaguguguggacacuaaacucgaacagccccaaucaauucugaucgagcacaagggcacaauaauugguaagcagaacgauaccugcaccgcuaaaacuagcuguuggcuugaaucggucaagucuuucuuuuauggccugaaaaauauguuggggaguguguucggaaacuuuuucaucggcauccuacuguuucucgcgccauucguucugcuuguauuauuuuucauguucggguggaagauucuguuuugcuucaaauguugccgcagaacaaggggacucuugaaguaccggcaucugaaggacgaugaggaaaccggcuaucgaagaaucauagagcgccucaauaacaaaaaggguaaaaauaggcugcuugacggggagcgucuggccgaucggaagauugcagaauuguuuuccacaaaaacucacaucggauga

SEQ ID NO: 10310 - RNA, 5067 nt, Artificial Sequence
  derived and/or modified CDS sequence (opt3) from CCHFV(K340_6)__KX013475.1__GP
augcccaucaacauuaugcacacccugcucgugugcuucauacuuuaccugcaguugagcggcuuagggggagcccauguccaauccaaugcuacagagcacaacgguacuaauacgaccacagcaccuggcacuucucagucaccaaagccgcccgccaguaccacacugccucauaccccagaaagcuccacuguuaaacccacaaccccuacgucugagacugaagggucgggagagaccacaccacccccuaacacuacccagggccuaccaccgacagguaccacgcccgaaagaucagcgacuacagcuaccagcacuagcuccacagacaauaugaacucuaccacacaggugaccgauagcacaccuacuuccaccguaucaacaaguccaaguucuuccucaagcaugcccaguacuucucaagggauccaccauccugugaggucccuccugagcgucucgucuccaaagaccgugacaacccccacuccgauguccccuggagagaugucacccgagacgaguagccagcacuccgccaugucucggguuccaacacuuuauaccgcaacucaggugagcaccgaaaauacagaccgcucaaccccucgacagagugaguccagcguccaacccgccacucagucuccaauuacaucacccgcucagacgauccuguugaugagugcagccccuaaagcuauucaggauaugcacccaagcccgaccaaccguuccaagagaaaucucgaaguggagaucauacugacucugucucaaggccucaaaaaguacuauggcaagaucuuaaaacugcuucauuugacacuggaggaagacaccgaggggcuacucgaaugguguaagaggaaccugggaucgaauugcgaugacgauuucuuccagaaacggauugaggaauuuuucaucacaggugagggcuacuuuaacgagguacuucaguucaagacucugagcaccuugucccccacggaaccuucacacguucgccucccaaccgccgagcccuuuaaaaguuauuucgcgaagggguuucugucuauugacagcggauacuucuccgcaaaguguuauccuagaucaagcacaucuggcuuacaacugaucaaugugacucagcauccagccaggauagcugaaacccccgguccgaaaacaacuucccucaagaccauuaacugcaucaaucuucgggccagugucuuuaaagagcaccgcgaaguggagauuaacgugcuguugccucagaucgcagucaaccuaagcaauugucacguugugaucaacucucauguaugcgauuacucccuggacacggaugggccagugcgacuccccagaauacaccaugagggaacauucauuccuggcaccuacaagaucgucauugacaggaaaaauaagcugaacgaucgguguucacuugugacuaauugcguuaucaaaggccgugaagugcgcaaggggcagaguguccugagacaauauaagacagagauaaaaauuggaaaggcuagcaccgguucgaggaaauugcucuccgaggaacccggcgacgacuguaucucucggacucagcuguuaaagaccgaaacagccgagauccacgaugacaacuacgggggaccaggcgauaaaauuacgaucugcaaugguagcaccauuguggaccagcgacuggggucagagcuaggcuguuauacuauaaaccgcguaaagaguuuuaagcucugcgaaaauuccacaaccggaaaaacaugcgagaucgauucuacuccuguuaaguguagacagggcuucugccugaaaauuacccaagaagggaggggacaugugaagcugagccgggguuccgaggucguguuggacgcgugugauucaagcugcgagaucaugauccccaaaggcacgggggacauucuggucgauuguaguggaggccagcagcacuuccucaaggacaaccugauagaucuugguugcccacacaucccgccucuggggaagauggccauuuacaucugucgcaugucuaaucaucccagaacaaccauggcauuuuuguucugguuuuccuucggcuaugugauuacuugcaucuuuuguaaagcucucuucuacagccugauaaucauuggaaccuuaggcaagaaaaucaagcaguauagggaacugaaaccacaaacaugcacuauuugugagaccgcccccguuaacgcuaucgacgccgaaaugcacgaccuaaauugcucguacaacauaugcccuuacugugcaucacgucucacaucugaugggcuggcccggcaugugacgcagugcccaaagcgaaaggagaaaguagaagagaccgagcuuuauuugaaucuggaaaggauucccuggaucgucagaaagcuccuucaggugagugaguccacuggaguugcuuuaaaacgcagcucuuggcugauugugcuuuugguccuccugacagugagccuauccccuguacagucagcgccggugggucacggcaagaccaucgaaacuuaccaaacacgggagggguuuaccaguauaugucuguucaugcucggaagcauccuguuuauuguuucuugccuugucaaaggcuugguggacuccgugucagauaguuucuuuccaggucugagcgucuguaagacgugcuccaucgggucuauuaacggcuucgaaaucgagucgcacaaauguuauugcagcuuauuuuguugccccuacuguagacauugcucagcagacagggagauacaccagcuccaucuguccauuugcaagaagcgcaaaacuggaaguaacguuaugcuugccguguguaagcgaaugugcuucaaagcuaccaucgaagccucucggcgugcacuguugaucagaagcauuaucaauacaaccuucgugauguguauucucacucuggccauaugcguagucuccacaucagcuguggagauggaagaucuaccugccggcaccugggagagggaagaggaccugacaaacuuuugucaccaggagugccaaguuacugaaaccgagugucucugcccauaugaagcacuggugcuucgcaagcccuugucucuggauagcaucgucaaagggaugaagaauuuacucaacaguacgucccuggagacaagccuuucuauugaggcgccuuggggagcuaucaaugugcagucaaccuucaagccgacuguuuccaccgccaacauugcacugaguuggagcucgguggaacaucggggcaauaaaauccuaguaacagguagaucugaguccauaaugaagcucgaagagaggacuggggucagcugggaccugggaguggaagaugccucagagaguaaauugcugaccgugucuaucauggacuuaucccagauguacagccccgucuuugaguaucucucaggcgaucgacagguugaagaguggccaaaggcuacguguacaggugacugcccugaacgcuguggcugcaccaguagcacuugccugcacaaagaguggccccacucccggaacuggagauguaauccaacauggugcuggggugugggaaccggcuguacuugcugugggguagaugugaaggaccuuuucacagaccauauguuuauuaaguggaaagucgaauacaucaagaccgaggccauugugugcguugagcugacgucucaagaaaggcaguguagcuugaucgaggcaggaacucguuucaaccucggcccugugaccauaacacuguccgaaccccgcaauauucagcagaaacuaccaccggagaucaucacccugcacccuaagauugaagagggguuuuucgaucuuaugcauguccaaaaagugcucucagcuucuacaguuugcaagcugcagaguuguacucacgggauacccggagacuugcagaucuaccauauuggcaaccuguuaaagggugaucgggugaauggccaccucauccacaaaauugagccacauuuuaacaccucguggaugagcugggacgggugcgaucuggacuauuacuguaauaugggagauuggcccuccugcacguauacaggcgucacucagcacaaccaugccgcguucguaaaccuucugaauaucgaaaccgacuacacaaagaccuuucacuuccacucuaaaagagugacugcccauggggauaccccucaauuggaccucaaggcuaggccaacauauggagcaggcgagauaacgguucugguggaagucacugauauggagcuacacaccaaaaagguggagaucucaggucugaaauuugccagccuuacaugcaccggguguuacgcuugcuccaguggaauuucuuguaagguacgaauccauguggacgaacccgaugagcucacuguccacguuaagagcucagacccugacgugguggccgcauccacaagucugauggcgcggaaauuggaauuuggcaccgauagcacguucaaggccuuuucugcuaugccgaaaacuuccuuaugcuucuauauugucgagcgcgaauacuguaagucaugcagcgaggacgauacgaaaaaguguguggacaccaagcuggagcagccacagucgauccucauagaacauaaagguaccauuaucggcaagcaaaacgauacuugcacagccaaagcaucuuguuggcuggagaguguuaaguccuuuuucuacgggcuuaaaaauaugcugggaagcguauuuggcucauucuuuguggggaucuugcuauuccuggcucccuuuguccuccuggugcuuuucuuuauguucggauggaagauuuuauucugcuuuaaguguugcagaaggacccggggccuguucaaauaucgacacuuuaaggacgaugaagagacagguuacagacgcaucauagaaaggcucaacuccaaaaaggggaaaaaucguuugcuggacggagagcggcucgccgauagaaagauugcagagcuguucucuacuaagacgcacaucggcuga

SEQ ID NO: 10311 - RNA, 5067 nt, Artificial Sequence
  derived and/or modified CDS sequence (opt3) from CCHFV(K323_27)__KX013472.1__GP
augcccaucaacauuaugcacacccugcucgugugcuucauacuuuaccugcaguugagcggcuuagggggagcccauggucaauccaaugcuacagagcacaacggcacuaauacgaccacagucccugggacuucucagucaccaaagccgcccgcaaguaccacacugccucauaccccagaaagcuccacuguuaaacuaacaacccccacgucugagacugaaggaucgggcgagaccacaccuccacccaacacuacccagggucucccucugccagggacaaccccggaaagaucagccacgacugcgacaagcaccaguuccacugacaauaugaacucuacaacccaggugacggauaauacccccacaagcacuguauccaucucaccuaguagcucuccauccaugcccucaaccagccaaggcauucaccauccugugaggagucuucugucugucuccagcccaaagacagugacuacccccacaccgaugucgccuggagagaugucucccgagaccuccucacagcacagugcuaugagccggaucccaacuuuguauacggccacacagguuuccaccgaaaacacugaccgcucuaccccucgacagagcgagucaagugugcaacccgcaacacaguccccaauuaccagccccgcccagacuauccuccugaugucugcugcaccuaaagccauacaggauaugcacccaucaccgacaaaucguaguaagagaaaccuggaagucgagaucauucucacguuaagccaaggccugaaaaaguacuaugggaagauccuuaaauugcugcaucuaacccucgaggaagacacugagggacugcuugaaugguguaagaggaaucuggguuccaacugcgaugacgacuuuuuccagaaacggauugaggaauuuuucaucacaggcgagggguacuuuaaugagguguugcaguucaagacccucucuacacugucgcccacugaaagcucccacguacgcuuaccuaccgcugagccauuuaaaucauauuucgccaagggauuucugaguauagauucuggcuacuucagcgcgaaguguuaucccagauccucaacgagcggucuccaacuuauuaacguuacccagcauccugcaaggaucgccgaaacaccagggcccaaaacuaccucucugaagacaauuaauugcaucaacuugcgggcuuccguguuuaaagagcaccgcgaagucgagaucaacgugcuacugccgcagauugccgugaaucucaguaacugucacgucguuauaagcucucaugugugcgauuacucccuggacacugauggaccuguacgacuuccaagaauccaccaugagggcaccuucauucccggcacguacaagaucgugauagacaggaaagauaagcugaaugaccgguguucauuggucacaaacugcgugauuaaagggcgugaaguucgcaagggacagagugugcucagacaauauaagaccgagaucaaaaucgguaaggcaagcacuggcucgaggaaacuguuauccgaggaaccuggggacgauuguauuucucggacacagcugcuaaagaccgaaacugcugagauccacgacgauaauuacggaggccccggugacaaaauuaccauaugcaacgggagcacaaucgucgaucagcgacucggcucagagcugggauguuauacgauuaaucgcgugaagaguuuuaaguuaugcgaaaacuccgccaccggcaaaacuugcgagaucgacucuacaccaguaaaguguagacagggguucugcuugaaaaucacccaagaaggaaggggucauguuaagcugagccggggcuccgaggugguccucgaugcgugugacucaagcugcgagauuaugauaccuaaagggacaggagauauccugguggacuguaguggcggucagcagcacuuccuuaaggauaaucugauugacuuggggugcccccacaucccacuccugggcaagauggccauuuacaucugucgcaugucuaaccauccgagaacuaccauggcauuuuuauucugguuuuccuucggauaugucauaacgugcaucuuuuguaaagcucuguucuaccuacucauuaucauuggcacacuggggaagaaaaucaagcaguauagggaacuuaaaccucaaaccugcacuauaugugagaccgcccccgugaaugcuauugacgccgaaaugcacgauuugaacugcagcuacaauaucugcccauacugugcaucgcgucugacaucagacggacucgcccggcauguuacucagugccccaagcgaaaggagaaaguggaagagaccgagcuguauuuaaaccuggaaaggauuccuuggaucguaagaaaacuuuugcaggucucugagaguacagguguggcucucaagcgcuccagcuggcugacgguucuacuggugcuccugaccgucucucuuagcccagugcaguccgcgcccguaggccacgggaauacuauagaaacauaccaaacccgggagggauuuacuucaaucuguuuguucaugcugggcaguauuuuauuuaucgugagcugccucguuaagggucuggucgauucuguguccgacucauucuuuccugggcuuaguguguguaaaacaugcagcauuggcuccaucaacggauucgaaauagagucucacaaguguuauugcucgcuguuuuguugcccgcauuguagacacaggagcgcagaucgcgagauucaucaguugcaccucucaaucugcaaaaagcgaaagaccggcuccaacgucaugcuggccguuugcaaacggauguguccaaaggcuacgaucgaagccagucguagagcacuacccauuaggucuaucauuaauacuacccuggugaugugcauacucacacuggccaucugugugguaagcaccuccgcugucgagauggaagaccuuccugccgggacuugggagcgcgaagaggauuugacaaacuucugccaucaggagugucaagugaccgaaacagagugccuguguccauacgaagcauuaguucuccggaaaccccuguuccuugacucaauugcgaagggaaugaaaaaucugcuaaacucuacuagccucgagaccagucuguccaucgaggcuccuuggggcgccauuaaugugcagagcacguuuaagccgacagucucuaccgcaaacaucgccuugucaugguccaguguggaacacagagguaauaagauacugguuacugggaggagcgagucgaucaugaaauuagaggaacgaaccggagugucuugggaucucggcguagaagacgcuuccgagagcaagcugcuuacagucucaauuauggaucugagucagauguauucucccguguucgaguacuuguccggugaccgccagguggaagaguggccaaaagccacuugcaccggcgauuguccugaacggugcggguguacgagcucaacaugccuccacaaggaguggccccauaguagaaacuggaggugcaauccaaccugguguuggggagucggcacugggugcacauguugcggaguugacgugaaagaccuguuuaccgaucacauguucaucaaguggaagguagaauauauuaaaacugaggcaaucgugugugucgagcuaacaggccaagaacgucagugcagccugauagaggcugguacccgcuuuaaccuugggccugugacgauuacucucuccgaaccccggaauauccagcagaagcugccaccggagaucauuaccuugcauccuaaaauagaagagggauucuuugaccugaugcacguucaaaagguguuaucugccagcacagucuguaaacuccaguccugcacccauggcauccccggugaucugcagauuuaccacaucggcaaccuucugaagggggacagagugaauggacacuugauucauaagaucgagccacacuucaacacaucauggaugucuugggauggcugugaccucgauuacuauugcaauaugggggacuggcccaguuguacuuacaccggaguuacgcagcauaaccacgcggccuuugugaaccugcuaaauauagaaacagauuauacuaaaaccuuccacuuucauucgaagagggucacagcucacggcgacaccccucaacuggaucuuaaagcacgaccaacuuacggugccggggagaucaccguacucguggaaguugcugacauggagcugcauacaaagaaaguggagauuagcggauugaaguucgccuccuuaacgugcacuggcugcuaugcauguucuucagguaucagcugcaaaguccggauucacguggaugaacccgacgagcugaccguacaugugaaguccagugacccugaugucguugcggccucuacaagccucauggcucgcaagcuggaauuuggcaccgacucaacuuucaaagccuucuccgcaaugccgaagacaagucuuuguuuuuacaucguggagagagaauauugcaaaagcuguucugaggaugacaccaagaaaugcguggauacgaagcuggagcagccacaguccauauugauugaacacaaggggacuaucaucggaaaacaaaacgacacauguaccgcuaaggccucaugcuggcuagagagcgucaaaucguucuuuuacggccugaagaauaugcucgggucuguguucggauccuuuuucguuggcauucugcuuuuucuugcacccuucguacugcucguguuguuuuucauguuugguuggaaaauccuguucuguuucaagugcuguaggcggacccgagggcucuuuaaguacagacaccugaacgaugacgaagagacuggauaucgcaggauaauugaacgucuuaauaguaaaaagggcaaaaaccggcuguuggauggcgagagacuagccgacaggaagaucgcugagcuguucagcacaaaaacccauauuggguga

SEQ ID NO: 10312 - RNA, 5067 nt, Artificial Sequence
  derived and/or modified CDS sequence (opt3) from CCHFV(K315_14)__KX013469.1__GP
augcccuucaacaucaugcacacccugcucgugugcuuuauucuuuaccugcaguugagcggcuuagggggagcccauggucaauccaaugagacagaacacaacggcacuaauacgaccacagucccugggacuucucagucaccaaagccgcccgcuaguaccacacugcagcauaccccugagagcuccacuguuaaacuaacaaccccaacgucugaaacugagggaucgggcgaaaccacacccccuccaaacacuacccagggucugcccccuccagggacaaccccggagagaucagcaacgacugccacaagcaccaguuccacugacaauaugaacucuacaacccaagugacggauaauacccccacaagcacuguauccauaucaccuaguagcucuccauccaugcccucaaccagccagggaauccacuauccuauuaggagucugcuuucuguguccagcccaaagacagucacuacccccacaccgaucucgccuggcgagaugucucccgaaaccuccucacagcauagugcgaugagccggauuccaacucuguacacggcuacacagguguccaccgagaacacuaaucgcucuaccccucgacaaagcgaaucaaguguucagcccgccacacaguccccaaucaccagccccgcacagacuauauugcucaugucugccgcuccuaaagcaauccaagacaugcacccaucaccgacaaaccguaguaagagaaaucuggagguggagauuauccugacgcucagccagggccugaaaaaguauuacgggaagauucugaaacuuuugcaccugacccuagaagaggauacugaaggacuccuggagugguguaagaggaaccuugguuccaauugcgacgaugacuucuuucagaaacggaucgaagaguucuuuauaacaggcgagggguauuucaacgaaguccugcaauuuaagaccuugucuacacucucgcccacugagccuagccaugugcgccugccaaccgccgaacccuucaaauccuacuuugcuaagggauucuuaucaauugauaguggcuauuuuucugccaaguguuacccuagaagcuccacgucaggucugcagcucaucaauguaacccagcacccagcgaggauugcagagacacccgggccgaaaacuaccagccuuaagacaaucaacugcaucaaccugcgggccucuguuuucaaagaacaucgcgagguggagauuaaugucuugcuaccucagauagcugugaaccuguccaauugucacguggucaucaacagucacguuugcgacuacagccucgauacugacggaccagugcgacugcccaggauucaucacgaaggcaccuuuaucccuggcacguauaagauaguaauugauaaaaagaauaaacuuaacgacagauguucucuggugacaaauugcgucaucaaggggcgggaggugcguaagggacaauccguuuugcgccaguacaaaaccgaaaucagaauugguaaggccucaacuggcaguaggaaacuccugagcgaggaacccggggaugacuguaucucgcggacacaguuacugaagaccgagacugcagagauucaugacgauaacuauggaggcccaggugacaaaauaaccaucugcaauggguccacaguggucgaucagcgacuaggcucugaacucggauguuacacgauuaaccgcguaaagagcuucaagcugugcaaaaauucagcuaccggcaagacuugcgagaucgacaguacaccugugaaauguagacaaggguucugccuuaagaucacccaggaaggaaggggucacguuaaauugucccggggcucugaggugguccuggaugugugugacagcuccugcgagauuaugauacccaaggggacaggagauauccucgucgacuguucaggcggucagcagcauuuucugaaggauaaccuuauugaccuggggugcccacacaucccguugcucggcaaaauggccauuuauaucugucgcaugagcaaucacccuagaacuaccauggcguuccuguuuugguucaguuuuggauacgugauaacgugcaucuucuguaaggccuuauuuuauucucugauuaucauuggcacacuagggaaaaagaucaaacaauacagggaacucaagccccagaccugcacuauaugugagaccgcaccaguuaacgcuauugaugccgaaaugcaugaccugaauugcuccuacaacaucugccccuauugugcuagccgucuuacaucggagggauuggcccggcacgugacucagugcccuaagcgaaaagaaaagguagaggagaccgaacuguaccucaaccuggagaggauuccauggaucgucagaaaauuacuccaggugucagaaucuacagguguugcacuuaagcgcaguuccugguugauagugcuccugguccuacugacggugagccucucucccguacaaagcgccccugugggccaugggaaaaccaucgagacuuaucagacacgggaaggauucaccuccauuugucuguuuaugcuuggcucaaucuuguucauuguuaguugccuggucaaggguuuaguguacagcgugucugacuccuuuuucccggggcucucagucuguaaaacuugcaguaucggcagcauaaauggauuugagauugagucccacaaguguuauugcucucuguucuguugcccauacuguagacacugcucggcugauagggaaauccaucagcuucaccugagcaucugcaagaaacgcaagacaggcucaaacguuauguuggcgguguguaaacgaaugugcuucaaggcaaccauugaggccucccggcgugcucuccugaucagaaguauuauaaauacgacuuuugugaucuguauucuaacccuggccaucugcguagucucuacaagcgcaguggaaauggaggaccuccccgccgggaccugggaaagggaggaggaucugacuaacuucugucaucaagaaugccagguuacagagaccgaaugucuuugcccuuaugaggcuuuggugcugcgcaaaccauuauuucucgacuccauugucaagggaaugaagaaacugcuuaauucaacaucucuggagacuagccuaaguaucgaagcccccuggggcgcaauaaacgugcaguccaccuucaagccuacgguuagcacagcgaauaucgcucucucuuggucauccguggagcaccgggguaacaaaauucugguaaccgggagaagugaaagcaucaugaaguuggaggaaaggacuggagucucgugggaucugggcguggaggacgccucugaguccaaauuacucaccgugagcauuauggaucugucacagauguacaguccggucuuugaauaccuuucuggugaccgacaaguugaggaauggcccaaggcaacauguacuggcgauugcccagagcgcugugggugcaccuccagcacgugccugcauaaggaauggccucacucacggaauuggagauguaaccccacauggugcuggggagugggcaccggguguacuugcuguggaguagacgugaaagauuuguucacagaccacauguuuaucaaguggaaagucgaguauauaaagaccgaggccauugugugcguugaacucacuucucaggagaggcaguguagccugaucgaagcuggcacacguuucaaucuagguccagugaccaucacgcuguccgagccucgcaacauucagcaaaaacuucccccagaaauaaucacucuccauccgaagauugaggagggguuuuucgaucugaugcacguccagaagguguugucugccagcaccguuugcaaacugcaguccuguacacauggaaucccuggcgacuuacagauuuaccacaucgguaaucuccugaagggcgaccgggugaacgggcaucuuauacacaaaaucgaaccccacuuuaauaccucauggaugucuugggauggaugcgaccuggauuauuacuguaacaugggcgacuggccaaguugcacauauacuggggucacccaacauaaccacgcagcuuucguaaauuugcucaacauugagacggauuacacaaagacuuuucauuuccacucgaaaagagugaccgcccacggagacacaccccagcuggaucuaaaggcgaggccuaccuauggcgccggugaaaucacuguucugguggaggucgcugacauggagcuucauaccaaaaagguggaaauuagcgggcucaaguucgcaucccugacaugcacgggauguuacgccugcaguucaggcaucagcuguaaaguacgaauacacguggaugagccagacgaauugacuguccauguuaaguccagugaucccgacgugguggcugccucuaccagcuuaauggcacggaaacuggaguuugguacagauucaaccuucaaggcguuuuccgccaugccuaaaacaagucucugcuucuacauugucgaacgcgaguauuguaagagcugcucugaggacgacacuaagaaauguguggauaccaagcuggaacagccgcaauccauccuuaucgagcacaaaggcacgauuaucgggaagcagaaugacacuugcacagcuaaagccucauguuggcuggaaagcguuaagucguuuuucuacggauugaagaacaugcuaggcucuguauuugggaguuucuuugugggaauauuacucuuccuggcaccauuuguccuuuuagugcuguucuucauguuuggcuggaaaauucucuucugcuuuaaguguugcagaaggacccgggguuuguucaaauaucgacaucugaaggaugacgaggaaaccggguacagacgcaucauugagaggcucaauuccaaaaagggaaagaaccgucugcuugauggcgagcggcuggcugacagaaaaaucgccgaauuguuuagcacuaagacacacauaggcuga

SEQ ID NO: 10313 - RNA, 5067 nt, Artificial Sequence
  derived and/or modified CDS sequence (opt3) from CCHFV(K229_243)__KX013466.1__GP
augcccaccaacaucaugcacacacugcucgugugcuucauucuuuaccugcaguuguuaggccugggaggagcccaaggucagagcaaugcuacugagcauaacgaaacgaauaccacaacugcaccuuccaccucucagucaccaaagccgcccgucaguacaaccccuccacacgcccuagagagcuccacuauaaaacccacaaccccugcgagagaaacggagggcucuggggaaacuaccccacccccuaacacaacucagggaccaucgccgcccgaggcuaccccugagaggccagccacaaccgcaacgucaacucccagcacagacaauaccaacaguacuacacauguuaccgauaauaacccuacguccaccaucucuacaagcccauccucaagucccagcacuccguuuaccccucaaggcauucaccaucccgcccggaaucuccugucuguguccucaccaaagacagcuacuaccccuacacccaccagcccacgcgaacuuaguucugagacuuccagccugcacucggcaaucucucgaacguccacauuguauaccgccacucagguaucaaccgaaaacgcuaaucacagugcgccccgucagagcgaguccucugcccagccuacaaccacuagcccaaugacaucaccggcacaaaguauucucgugauguccgccgcucccacggccauccagaacauacauccuagcccaaccaauagaucuaaaaggaaccuggagauggaaaucauucugacucucucacaggguuuaaagaaauacuaugggaagauccugaagcuguugcaccugacacuagaggaagacaccgagggacuccuggaaugguguaaacggaaucuuggcaguaacugcgaugacgauuucuuucagaagcgcauugaggaguucuuuaugacaggcgaaggguacuucaacgagguccugcaauuuaaaacuuugagcacccucucccccacggaaccuucucaugcaagaccacccgcuguggagccguucaagucguauuuugccaaaggauuccugagcaucgacuccgguuacuuuucagcgaaguguuauccuaggaguucuaccagcggcuuacagcugauaaauguuacacagcacccagcccggauugcagaaacucccgggccuaagaccacaucccucaaaacuaucaacugcauuaaucuucgcgcuucaguguucaaggagcaccgagagaucgaaaucaacguccuguugccccaaauugccgugaaucuaagcaacugucauguaguuauaaauucucacgugugcgauuacucccuggacaccgauggaccagucagacucccucauaucuaccacgagggcacguuuauucccgguacauauaaaaucgugauagacaagaaaaacaagcugaaugauagguguacccuugugacuaacugcgucauuaaagggcgggaaguucguaagggacagagugugcugcgccaguacaagacagagaucaaaaucggcaaggcuagcaccggcucuagaaaauugcucuccgaggaaccaggggacgauuguauuucaaggacucagcuguuacggaccgagacagccgaaauccaugacgacaauuauggagguccgggcgauaagauuacgauaugcaacgggaguaccaucguagaccaacgacugggaagcgagcuaggcuguuacacuauuaaucgcgugaaaucguucaagcucugcgaaaacuccgcaacagguaagaccugcgagaucgauucuacaccugucaaauguagacagggguucugccugaagaucacucaggagggcaggggacacgugaaacuuagccggggcucagaaguuguguuggacgccugugauaguuccugcgaggucaugauucccaaggggaccggagacauacugguggauuguucugguggccagcaacacuuucucaaagacaaucugaucgaucuugggugcccacauauuccccuguugggaaagauggcuaucuauauuugucgcaugagcaaccacccuagaacgacaauggcguuccucuuuugguucuccuuuggcuacguaauuaccugcauauucuguaaggcacuguuuuauucauuaaucauuaucgguacucuggggaaaaagauuaaacaguacagggaacuaaagccacagaccugcacaaucugugagacugcccccguuaacgcuauagacgccgaaaugcaugaucucaauugcagcuacaacauuugcccuuauugugcaagucgucugaccucugacggccuugcccggcacgugccgcagugcccaaaacgaaaggagaaggucgaggaaacagaguuguaccugaaucucgaaagaauccccuggauugugaggaaacuguuacaagucuccgagagcacgggaguggcucugaagcgcucgucauggcuuaucguuuugcucgugcugcuaaccguaucucugaguccuguccaguccgccccagugggccacgggaaaacuauagaaacauaucagacccgggagggauucacuagcaucugucucuuuaugcuggguucuauucuuuucuugguuagcugccuggugaagggcuuagucgacuccgugucagauagcuuuuuccccgggcucaguguauguaaaacaugcucuaucggauccauuaacggcuuugagaucgaaucacauaaguguuacugcagucuguucuguugcccuuauuguagacacugcagcgcagacagggagauacaucagcuucaccuguccauuugcaaaaagcgcaagaccgguucuaaugugauguuggcgguuuguaaacgaaugugcuuccgggcuacgaucgaagccucgcguagagcacuccugaucaggagcauuaucaacacuaccuuugucauuuguauacuaacacugaccaucugcguggugucaacuuccgccgucgagauggaaaaucucccggcugggacaugggagcgcgaggaagaucugaccaacuucugucaucaagagugccagguuacagaaacugagugucuuugccccuacgaggccuuggugcugcggaagccauuauuucucgacaguauugugaaaggcaugaagaaucugcuuaacucuaccagccuggaaacgucccuaucaaucgaggcaccuuggggagcuauuaauguacagucuacauucaaacccaccgucagcacugccaacaucgcgcucaguugguccagcguggaacacagaggcaauaagauacugguuaccgggaggucugagucaaucaugaaguuggaggaacgaacaggaguguccugggaucugggcgucgaggacgccagugaaagcaaauuacucacugugucgauuauggaucugucucaaauguauuccccaguuuuugaguaccuuagcggugaccgccagguggaagaguggccuaaggcuaccuguacgggggauugccccgaacgguguggaugcacaucaaguaccugccugcacaaagaguggccacauucuagaaacuggagguguaauccgacuuggugcuggggcguagguacaggcuguaccugcuguggggucgacgugaaggauuuguucacugaccacauguuugugaaauggaaggucgaguacaucaagacagaagcaauuguuugcguggagcucaccucccaggaacgucaguguagccugaucgaggccggaacgcgcuucaaccuaggcccuguaacuauaacccugucagaaccccggaacauucaacagaaacuuccacccgagaucaucacacuccauccuaagguggaggaaggguuuuucgaucugaugcacguccagaaaguguugagugcuagcaccguuugcaagcugcaguccuguacacauggaaucccaggcgacuuacaaguguaucacauagguaaucuccugaaaggggacagagucaacggacaccuuauccauaagauugagccccacuuuaauacuucuuggaugagcugggauggcugcgaccuggauuacuauuguaacaugggugacuggccuuccugcaccuacacgggcgugacacagcauaaucacgccgcauucguuaacuugcucaauaucgaaacugauuauaccaagacauuucacuuccauucaaaaagggugaccgcgcacggggacacuccgcagcuggaucuaaaggcccgaccaaccuacggagcuggcgagauuacaguccugguagagguggccgacauggaacuucauacgaaaaagguugagaucucugggcucaaauucgcaagucuggcuugcacuggauguuaugccugcucgagcggcauauccuguaaggugcggauccacgucgaugaacccgacgaguugaccgugcauguaaaaucuucagauccugacguggucgcagccagcacauccuuaauggcucgcaagcuggaauuugguaccgauaguacuuucaaggcguuuucugccaugcccaaaacaagccucugcuucuacauuguugagaaggaguacuguaaaucaugcuccgaagaggacacccagaaguguguggacacgaaacuggaacaaccacagaguauccuuauugagcacaaggggacuaucauaggaaagcagaacgauacaugcaccgcaaaagcuagcuguuggcuggaaucugugaaguccuuuuucuauggcuugaaaaauaugcuagguucagucuuuggcaacuucuuuauugggauccuucucuuccugaccccuuuugugcuuuuaguucuguucuucauguuuggauggaagauccucuucugcuuuaaauguugcagaaggacucggggcuugcugaaguaccgacaccucaaggacgaugaggagacaggguauagacgcauuaucgaaaggcugaauaacaaaaaggggaaaaaucgucuucuggacggcgagcgguuggccgauagaaagauagccgaacuauucagcaccaaaacacauauugguuga

SEQ ID NO: 10314 - RNA, 5067 nt, Artificial Sequence
  derived and/or modified CDS sequence (opt3) from CCHFV(K229_194)__KX013463.1__GP
augcccaucaacauuaugcacacccugcucgugugcuucauacuuuaccugcaguugagcggcuuagggggagcccauggucaauccaaugcuacagagcacaacggcacuaauacgaccacagucccugggacuucucagucaccaaagccgcccgcaaguaccacacugccucauaccccagaaagcuccacuguuaaacuaacaacccccacgucugagacugaaggaucgggcgagaccacaccuccacccaacacuacccagggucucccuccaccggggacaacccccgaaagaccugccacgacugcgacaucaaccagcaguacugacaauaugaacuccacaacccaggugacggauaauaccccaaucucuacaguaagcauuucccccucaaguagcccuucuaugccauccacuucacaaggaauccacuaucccgugaggagccugcuuagugucucuuccccgaagaccgugacaacuccuacccccaugagcccaggcgagaugucgccugagacaucuucccagcauucagcuaugagucggauucccacccuguacacugccacgcagguuagcacagaaaacaccaaucgcuccacuccacgacagucugagagcucagcacaacccgccacccagaguccuacaaccuccccaacucagacaaucuugcucaugagcgcugcaccgaaagccauacaggacaugcaccccucuccuacgaaccguucaaagagaaaucuggaaguggagaucauucugacccucagucaaggccugaaaaaguauuacgggaagauccugaaacuuuugcaccugacucuagaggaagauacagagggacuccuggaaugguguaagaggaaccuugguagcaauugcgacgaugacuuuuuccagaaacggauugaggaauuuuucaucaccggcgagggguauuuuaacgagguccugcaguucaagacauugaauacucucuccccaaccgaacccucucaugugcgccugccuacggcugagccauuuaaaucguacuucgccaagggauuuuuaagcguagauuccggcuauuucucagcgaaguguuaccccagaaguucuaccagcggucugcaacucauaaacguuacacagcacccggcaaggauugccgaaacuccugggccaaaaaccacaucccuuaagacuaucaacugcauuaaucugcgggcuucaguguuuaaagagcaucgcgaagucgagaucaacguguugcuaccccagaucgccgugaaucugagcaacugucacgucguuauuaauucucacgugugcgacuacucccucgauaccgacggaccuguacgacugcccagaauacaucacgagggcacguucaucccaggcacauauaagauugugaucgauaaaaagaacaaacuuaaugacagguguagucuggucaccaacugcgugauaaaggggcgggaaguucguaagggacagagcguguugcgccaauacaaaacugagauuaagaucgguaaagcaucuacaggcuccagaaagcuccugucagaagaaccuggggaugacuguaucaguaggacccaguuacugaaaacugaaaccgcugagauucaugacgauaauuauggaggccccggugacaagaucacaauuugcaacgggagcacgauagucgaucagcggcuaggcucggagcucggauguuacaccaucaaucgagugaaguccuuuaaacugugcgaaaacucugccacuggcaagacaugcgagauugacagcaccccaguaaaaugucgccagggguucugccuuaagaucacacaagaaggaagaggucacguuaaauugucaaggggcagugaggugguccuggaugcgugugacuccucuugcgagaucaugauuccgaaggggacuggagauauacucguggacuguagcggcggucagcagcauuuccugaaggggaaucuuaucgaucugggcugcccucacauucccuugcucggaaaaauggccaucuauauuugucggauguccaaccacccacgcaccacgauggcauuucuguucugguuuucauucggcuacgucaucacaugcauauuuuguaaggcuuuauucuauagccugaucauuaucgggacccuagggaaaaagauuaaacaguacagagaacucaagccccaaacuugcaccaucugugagacagccccugugaaugcuauagacgccgaaaugcaugaucugaacugcaguuacaacauuugcccauauugugcaucuaggcuuacuuccgacgguuuggcccgucacguuacccagugccccaagcggaaagagaagguggaagagacagagcuguaccucaaucuggaacgaaucccuuggauuguaagaaaauuacugcaggucagcgagucgacgggcguggcucuuaagaggucaucuugguugaucguucuccuggugcuacugaccgucagucucuccccggugcagagcgcgccaguagggcauggaaaaacuauagaaacauaucaaacccgcgagggcuuuacuaacaucugucuguucaugcuugguucuauuuuguuuaucgugagcugccugguuaagggguuagucgacuccgugucagauaguuucuuucccggccucagcguguguaaaacaugcucuauuggauccaucaauggcuucgaaauagagucacacaaguguuacugcagucuguuuuguugcccuuauugucggcacugcagcgcagacagagagauucaucagcuucaccuggggaucugcaagaaaaggaagaccggauccaacgucauguuggccguuuguaaacgcaugugcuucaaggcuacgaucgaagccucucgacgggcacuccugauucguucgaucauuaauacuaccuucgugauauguauccuaacacuggccauuugcgugguaagcaccucagcugucgagauggaaaaccucccagccggcacuugggagagagaagaggaucugacauccuuuugucaucaggagugccaagugaccgaaacagagugucuuugccccuacgaagcauugguucugaggaaaccuuuauuccucgacaguaucgugaaggguaagaaaaaucugcuuaacucuacuagccuggagaccucccuaucaauugaggcgccguggggagcuaucaauguccagucuacguuuaagcccacagugagcaccgccaacauagcacucaguugguccagcguugaacaccgcggaaauaaaauccuggugacuggccggucugagucaauuaugaaguuggaagagagaaccgguguauccugggaucugggcgucgaagacgccagugagagcaaauuacucacagugucgaucauggaucugucucagauguauuccccaguguucgaguaccuuagcggggacaggcaggucgaagaguggccuaaggcuacuuguaccggagauugccccgaacgauguggcugcacgucaaguacaugccugcauaaggaguggccacacucucgcaacuggcgguguaauccuaccuggugcuggggaguugggacuggcuguacaugcugugguguggacguaaaagauuuguuuaccgaccacauguucauuaaguggaaaguggaauacaucaagacugaggccauagucugcguggagcucacaucccaagaaagacaguguagccugauugaggcagggaccagguuuaaccuaggacccguuacgaucacucugucagaaccacguaauauccagcagaaacuuccgccugagauuauaacccuccaucccaagaucgaagagggcuucuuugaucugaugcacgugcaaaaggucuugagugcuagcacagugugcaaacugcaguccuguacccaugguauuccaggcgacuuacagaucuaucacauugggaaccuccugaagggagaccgccuuaacggccaucugauccacaaaauagagccccacuucaauacaucuuggaugagcugggaugggugcgacuuggauuacuauuguaacaugggagacuggccuuccugcacuuacaccggcguuacgcagcauaaucacgccgcguuugugaaccuccugaauaucgaaacagauuauacuaagaccuuccauuuucacucaaaacgggucacagcccacggugacaccccacaacuagaucugaaggcuagacccacuuacggggcaggagagauuaccguacuuguggaaguugccgacauggagcuccauacgaaaaagguggagaucucuggccugaaguucgcuaguuuggccugcacagguuguuauucgugcagcuccggcauuucuuguaaagucaggauccacguggaugaaccugacgaguuaacuguacaugugaagucaagcgauccggacgucguugcagcguccaccagucugauggcccgaaaacucgaguucgggacagauucuaccuuuaaggcuuucagcgccaugccaaaaacuucacugugcuuuuacauaguggagcgggaauacuguaaguccugcagugaggacgacacaaagaaauguguggauaccaaacuugagcagccccagagcauucugaucgaacacaaaggaacgaucauuggcaagcaaaacgacacuugcacagcaaaggcuucuuguugguuggaguccgucaagucauucuuuuaugggcuaaagaauaugcugggaagcguguucggcaacuuuuucguugguauccuccuguuucuugccccuuucguauuacuggugcucuuuuucauguucggguggaaaauauuguuuugcuucaaguguugccgcagaaccaggggacuguuuaaauaccggcaucucaaggaugacgaagagaccggcuaucgaaaaauuaucgaaagauuaaauucgaagaagggcaaaaaccgccuucuggauggggagagguuggcagaccguaagauugccgagcuauucucuacuaaaacacacaucggauga

SEQ ID NO: 10315 - RNA, 5067 nt, Artificial Sequence
  derived and/or modified CDS sequence (opt3) from CCHFV(Gaib)__KX013445.1__GP
augcccgugagcaucauguacauuccucuggucuaugccguuauauaccuccagcuuuauggccugggcggagcucacgguuuguuaaacaagaccgagcaaaaugaaacaggcaucacugcaacgcaugggagagugcagggaccaccguccgccucuauuacccugcccguaacaccugacccacuaucagcgacuagcgcugccagcaccuccggccccgaggguucuggggaagugccuacaucgccaucaaccaucacucagggacucacaagcagugagaacacaccccagcugccuacggcaacugauaccggcauuuccucuacaagcaucauagacgucuccacucaaaccgccggcgauacaucaaccccaacggcucacacuagccuuccgaauagccccucugcaccuuucacaucccaggacaccaggcauacugugcgggggcuguugacaguuaccucaacgaaaagcgaugaagccaguacccucacagacccaaaggaggcuucuacugaggcccgcucccccagcccuucgaucucucgaaccccaacacccuccccgacugugcaggcgucaaccgaaaacaauacaccuaguacuccccgucagccagagccuacuacgagacccgcacugccaagccccacaaccuccccuacucaaccaucucugagccagucagccaccagugcugccauucaggauaugcacccgucccccacaaacaggagccggcgcaaucucgaaauggagaucauuuuaacccugucucagggacuuaaaaaguacuaugguaaaaucuugaagcugcuagaccucacucuggaggaagauacagagggccuucuggaauggugcaagagaaacuuggaccucacgugugaugagaacuuuuuccugaaaaggauagaagaguuuuucuuaucaggggagggacauuuuaaugaaguccugcaauucaaggcaccuaguaccaugagcuccacugagccaacacacgcugggcccccuaccguggaaccauuuaaaucuuacuucgccaaggguuuucucucgauugacagcggguauuucuccgcgaaaugcuacccccggacaucaaauaguggacuucagcugaucaacguaacucagcacaccgcccgcauugcagauacgccgggcccuaagaucaccaauguuaagacaaucaacuguauuaauuugaaggcuucuguguuuaagaaacaucgagaggucgaaauaaacgugcuacugccacaaaucgccgugaaccucagcaauugccacguccugauuaagucccauguuugugacuacucacuuaacuucgacggcauggugagacugcccaggauccaccacgaggggacuuuuauaccuggaaccuauaaaauuguaaucgaucggaagaauaaacagaacgaccguugcacauuggugacuaauugugucaucaagggucgcgaggugagaaagggccagagcgcucucaggcaguaccggaccgaaauuaaaaucggggaggccucuauuggaucccgacgccuguuaagugaagagagcucugaugacugcauauccagaacgcaacugcuaaggacagaaaccgcagagauccauaacgauaauuauggcggucccggggacaagauuacuaucuguaacggcucaacaaucguugaucagcggcucggaagugagcugggcugcuacaccauuaaucgcgugaaaaguuucaaacuuugugaaaacucggccacugggaaauccugcgagauagacucuaucccagucaagugcagacagggauucuguuugaagauuacccaggaagguaggggccacgugaaacugagccgugggucagagguaguucucgaugcuugcgacaguuccugugagaucaugauuccuaagggaacaggcgauauccugguggacugcucuggugggcaacagcauuuucuuaaagacaaucugauagauuugggcugucccaacaucccacuccugggaaagauggcgauuuauaucugccggaugagcaaucacccgaaaacgaccauggcauucuuauuuugguucuccuuuggcuacgucauuacuuguaucuucugcaaggccauauuuuaucugcuaauuaucguggggacacucggaaagaaauucaagcaguaccgagaacugaaaccucagaccuguacaauuugcgagacuacccccgucaacgcuaucgacgccgaaaugcaugaucuuaauuguucauacaacauaugcccauauugcgcaagcagauugacgagugacggucuggccaggcacgugguucacugucccaagcgcaaagagaagaucgaagagacagagcucuaccugaacuuagaacgggugccuuggguagucagaaagcugcuucaagugucugaguccaccggcguugcuuugaaaaggagcucguggcucauugugcugcuaguccugcucacugugucacugucuccaguacagagugcccccaucgggcauggaaagaccauugaaacauaucagacucgcgagggcuacaccuccaucugccuuuuuguguugggugggauacuguucauuguuagcuguuuaaugaaaggccucgucgauucugugggaaauaacuuuuucccuggccugacaaucugcaagacguguagcaucuccucaauuaauggguuugaaaucgagagucacaaaugcuauuguagccuucugugcuguccguacugccgacauuguucugcagaccgggagauucaccaguugcaccucuccauaugcaagaaacguaagaccggaucaaacgugaugcuggcggucugcaagagaaugugucuaaggguuacuacagaagugaguaaucgcgcucuguucauccggagcauuaucaacaccacuuucgugauuugcauccucauacuggccguaugugucaucuccacaucugcaguggagauggaaaaucuuccagccggcaccugggagagagaagaggauuugacgaacuuuugccaucaagagugucagguuacugaaaccgagugccugugucccuaugaggcuuuagugcucaggaaaccucuguucucggacagcauugucaaggguaugaaaaaucuucugaacucaacaucccuagaaaccagucucucuaucgaggccccauggggagcaauuaaugugcagagcacuuuuaagcccacaguuuccaccgcuaacaucgcccugucauggucuagcauagaacaccgagggaauaaaauuuuggugaguggccgcuccgagagcaucaugaagcuggaggaacggacagguaucucuugggauuuaggcguagaagacgcgucagaguccagacuccugacugucagugugauggaucuuagccaaauguacucgccuguguucgaguaccugucuggggacaggcaggucgaagaguggccgaaggcuaccugcacgggagauugucccgaacguugcggcuguacauccaguaccugcuugcauaaagaguggccacacucacgcaacuggcggugcaauccuacuugguguuggggaguugggaccggcugcacauguugcggucucgacgugaaggaccuguuuacugauuauauguucguaaaauggaagguggaauacauuaaaaccgaggccauagucuguguggagcuaacgagucaggaaagacagugcucucugaucgaggcagggacaagguuuaaccuuggacccguuaccauuacucucuccgaaccacgaaacauccaacagaagcugccucccgagauuaucacauugcauccacggauagaagagggcuucuuugaccugaugcacgugcagaaggucuuaagcgccucaaccguguguaaacuccagaguugcacucacgguguuccgggcgaucugcaaguguaucauaucgggaaucuucugaagggagacaaagucaacggccacuugauucauaagaucgagccucacuucaauacaagcuggauguccugggaugggugugaccucgauuacuauugcaacaugggagacuggcccucuuguaccuacacgggcguaacucagcauaaucacgcugccuuugugaaccugcuaaauauugaaaccgauuauaccaaaaacuuccacuuucauagcaagcgcguuaccgcacacggugacacaccacagcuggaucuuaaggcgagacccacuuacggggccggagagaucaccgugcucgucgaaguggcugacauggagcugcauacgaaaaagauagagauuuccggcuugaaauucgccucauuaacaugcacugguugcuacgcauguucuaguggcaucucgugcaagguaaggauccacguggaugaaccugacgagcugaccguccacguuaaaagcgaagacccagauauuguggcugccuccucuucacucauggcacggaagcuggaguucgggacagacagcaccuuuaaagccuucuccgcuaugcccaagaccagucuuuguuuuuauaucguggaacgagaguacugcaagucuuguagcagagaggauacccagaaaugcgucucaacaaagcuggaacaaccucaguccauauugauugagcauaaaggaacgaucauuggcaagcagaauaacacuuguaccacaaaaaccacuugcuggcuagaaaguguuaagagcuucuuuuaugggcugaagaauaugcucucuuccaucuucggaaacguguuuguaggcauauucucauuucuggcgccguucauucuuuuaauccuguuuuucauguucgguuggcgcauccucuuuuguuucaaaugcuguaggcguacacggggguuguuuaaguacagacaccugaaagacgaugaggaaaccggauauaggcgcauuaucgagcgacucaauaacaagaaaggcaagagcaagcugcuugacggcgagagacuggccgaucggaaaauugcagaauuguucucgacgaagacucauauaggguga

SEQ ID NO: 10316 - RNA, 5067 nt, Artificial Sequence
  derived and/or modified CDS sequence (opt3) from CCHFV(Kosova Hoti)__EU037902.1__GP
augcccaucaacauuaugcacacccugcucgugugcuucauacuuuaccugcaguuguuaggccugggaggagcccauggucaaagcaaugcuacagagcacaacggcacuaauacgaccacagcaccugggacuucccagucuccaaagccgcccgccucaaccacaccuagucaugcgccagaacccagcaccaucaaacuaacuacaccuaccuccgagacggaaggaucuggcgagacuaccccacccacaaacacuacccaggacucgccuccacucgaaacaaccccggagagaucagcuacgacugccacaagcaccagugguacugauaauaugaacuccacaacccagaugacggacaauacccccacaucuacugucagcaccucccugucaaguagcccuucuacaccauccacuucacaagggaugcaccaucccguuaggagccuucugagugugucuuccccuaagaccgcaacaaccccaacucccaugagcccgggagagaugucgucugaaacguccucacagcacagugccaugagccggacaccuacaccccacacugcuacccagguauccacagagaacgcaaaucgcucuaccagccgacagucagaaaguuccgcccaaccagcuacucagagcccugugacaucucccgcccagucaauuuugcucaugagugcgacgccaaccacuauccagaacauucaucccagcccuacaaaucguuccaaaagaaaccuggagauggagaucauacugacccucucucaaggcuuaaagaaauauuacggcaagauccugaaacuuuugcaccugacacuagaagaggauacugaagggcuccuggagugguguaaaaggaaucuuggaucgaacugcgacgaugacuuuuuccagaagcggauugaagaguuuuucaucaccggugagggcuauuuuaaugaaguccugcaguucaaaacguugagcaccccauccucaacagagccgagucaugcacgccuccccacugccgaaccuuuuaagucuuacuucgcuaaaggguuucugagcauugauuccggauauuucucagccaaguguuacccaagaagcucuaccuccggcuuacaacugaucaacgugacacagcaccccgcaaggauagcugagacuccugguccaaagaccacgagucucaaaacaauuaacugcaucaaucuucgggccagcguuuuuaaggaacaccgcgagguggagauuaacguccuguugccccagaucgcggugaaucuaucuaacugucauguaguuaucaauucccacgugugcgacuauucacuggauaccgacgggccgguccgacucccuagaauuuaccaugaaggaacuuucaugccaggcacauacaaaauagugaucgauaggaagaacaaacugaaugaccgguguacccuugugacuaacugcgucauuaagggccgugagguucgcaaagggcagagugugcugagacaauauaagaccgaaaucaagauaggaaaagcccccacagguagcaggaaguugcucucggaggaaccuggcgaugacuguauuucccggacgcagcuguuacgaaccgagacugcagagauccacgacgauaauuacgggggacccggcgacaaaaucacaauuugcaacgguucuaccaucguagaucagcgccuggggagcgaacuaggcuguuauacaauuaauagagugaagucauuuaaacucugcgagaacagugcuacuggaaagaccugcgaaauagacuccacgccagucaaguguaggcagggcuucugccugaaaaucacacaaaaggggcggggacaugugaaacuuucucgcgguagcgagguuguguuggaugccugugacuccaauugcgaggucaugauuccuaagggcaccggggauauccugguggacuguucaggaggccagcagcacuuccucaaagauaaccugaucgaccuugguugcccccacauuccacuguuggggaagauggcuauauacaucuguagaaugagcaaucauccgaagacuaccauggccuuucucuucugguuuaguuucggcuauguaauuacaugcaucuuuuguaaagcacuguucuacucuuuaauuaucauaggaacucugggcaagaaaaucaagcaguauagggaacuaaaaccucaaaccugcacaauuugugagacggcccccguuaacgcuaucgaugcggaaaugcacgaccucaacugcuccuacaauauuugcccauacugugcaagccgucugaccucggacgggcuugcccggcaugugaagcagugccccaagcgaaaagagaaggucgaagagacugaguuguaucugaaccucgaaagaaucccuuggguggucaggaaacuguuacaggugucagagucuacaggaguugcucugaagcgcaguuccuggcuuauaguguugcucguacugcuaaccgucagccugucuccagugcagagcgcccccguuggucacggcaaaacuauugaaacauaccaaacccgggagggguuuacguccaucugucucuucaugcugggaucaauucuuuuuaucgugaguugcuuggucaagggccugguggauagcguaucugacuccuucuuuccugguuuaucaguguguaaaacuugcaguauagggagcaucaauggcuucgaaauugagucccacaaguguuauugcucucucuuuuguugcccguacuguagacauugcucggcagauagggagauccaccagcugcaucuuaacauuugcaagaaacgcaagaccggaagcaauguuaugcuggccgucuguaaacgaaugugcuuccgggcuacaaucgaagccucacguagagcauugcucauaagguccauuaucaacaccacuuucgugaucuguauucugacacuaaccaucugcguggucaguacaucugcgguugagauggaaaaucugccagcuggcacuugggagcgcgaagaggaccucaccaacuuuugucaccaggagugccaagugacggaaacagagugucugugccccuaugaagcccuuguguugcggaagccucuguucuuagauagcauuguaaaagggaugaagaaucuccugaacuccaccucacuugagacuucucugagcauagaggcaccauggggagccaucaauguccagaguaccuuuaagcccacaguguccacugcuaacauugcccuaagcuggucuucaguugaacauagaggcaauaaaauccucgugaccgguagguccgagaguauuaugaagcuggaggaacgaacggggaucagcugggacuugggagucgaagaugcaucggagucuaaacuguuaacaguguccauaauggaccucagccagauguacucaccuguuuucgaguaucugaguggcgaucgccagguggaagaguggccgaaggcuaccuguacuggugacugcccccaacgguguggcugcacaucuuccacuugccuucacaaagaauggccacacagcagaaacuggagguguaauccuaccuggugcuggggaguaggaacaggcuguaccugcuguggggucgaugugaaggaccuguuuacggaucauauguucgugaaguggaaagucgaguacaucaagacugaagccauuguuugcguggaguugaccucacaggagcgucaguguagucucaucgaagcgggaacacgcuuuaaccugggccccguaaccauuacacuaagcgagccacggaacauccagcaaaaacugccucccgaaauaauuacucuucacccaaagaucgaggaagguuucuuugaccucaugcaugugcagaaaguccuguccgccucuaccgugugcaaguugcagagcuguacgcacgggaucccgggagaccugcagguuuaccauauuggcaauuuacucaagggugauagagugaacggccaccugauacacaaaaucgagccucauuucaauacauccuggaugucaugggacgggugcgaucuugacuauuacuguaacaugggagauuggcccucuugcacuuauaccggcgucacacaacacaaucaugcugcauuugugaaccuguugaauauugagaccgacuacacuaagaccuuccacuuucacaguaaaaggguuacagcccauggggauacgccacagcucgaccugaaggcucgacccacuuauggagccggcgaaaucaccgugcuagucgagguagcagauauggaacugcacaccaaaaagguggagauuucgggucuuaaauucgcgagccucgccugcaccggguguuacgcuugcuccucuggaaucucauguaagguucggauacauguggacgagccugaugaacugacuguccacguaaagagcuccgacccagaugugguggccgcaggcacaaguuugauggcucgcaaauuagaguucgguaccgacucuacguuuaaggccuucagcgcaaugcccaaaacuucacugugcuuuuauaucgucgaaaaggaguacuguaaauccugcagugaagacgauacaaagaaguguguugacaccaaacucgagcagccucaaagcauucugaucgagcauagaggcaccauuaucgggaagcagaacgauacuugcacagccaaggcuucuuguuggcuugaauccgugaagucauucuuuuacggacugaaaaauauguugggcagcguguucgggaacuuuuucauagggauucuacuguuucucgcgccguucguccugcuuguguuauuuuucauguucggcuggaagauccuguuuugcuucaaguguugcaggcggacccgaggucucuuuaaauauagacacuugaaggacgaugaggaaacaggguaccgcaggaucauugagcgucugaauaacaaaaaggggaaaaaucggcuccuggacggcgaaagacuugccgauaggaagaucgcagagcuguucucgacuaagacgcacauaggcuga

SEQ ID NO: 10317 - RNA, 5067 nt, Artificial Sequence
  derived and/or modified CDS sequence (opt3) from CCHFV(Turkey200310849)__DQ211636.1__GP
augcccaccaacaucaugcacacacugcucgugugcuucauucuuuaccugcaguuguuaugucugggcggggcccauggacaacuaaauacuacggagcacaacgguaccaauaacacaacugcuccuggcgcaagccaguccccaaagccgcccaugucuaccacaccuccacaugcccccgaaucaaguaccauaaaaccuacuacaccaaucagcgaggcggaaggguccggagagaccacgucuacucccaauaccacacagggccucucgucaccugaaacuaccagcgagagaccagcuacaaccgccauuaguacguccucuacugacagcacaaacccgaccacucagaugacagauaauacccccacgcugaccgucuccacaucaccuaguagcucuccauccacucccucaaccccucaagguaucuaucacccagcaaggagccuucugaguguuucuucccccaagacagugacuaccccgacaccuaccagccccggggagaugucgucugaaacuuccucacagcauagugccaugagccggauuccaacgccucacacagcuacccgcguauccacugagaacaccaaucacucuacaccccgacagagcgaaucaagugcacagcaaaccacuccaucccccaugacaagcccugcccagucuaucuugcucaugucagcugccccaacggcggugcaggacauacauccgagucccaccaaccguagcaaaagaaaucuggagacugagaucauucugacacucucccagggauuaaagaaauacuauggcaagauccugaaacuuuugcaccugacccuagaagaggauacagaaggccuccuggaguggugcaagaggaaccuugggucuaauugugacgaugacuuuuuccaaaagcggauugaagaguuuuucaugacuggagaggguuacuuuaacgaaguccugcaguucaaaaccuugucgacgcucagcccuaccgagccaucccaugcacgccugcccacagccgaaccuuuuaagucauauuucgcuaaaggcuuuuuaaguaucgauucuggguacuucagcgccaagugcuauccaagauccucagcaagcggacugcagcucauaaaugugacucaacaccccgcuaggauugccgagaccccgggcccuaagacaacuucucuuaaaaccaucaacuguauuaaccugcgggcguccguuuuuaaggaacaccgcgagaucgagaucaauguguugcuaccacagauugccgucaaccugaguaauugccaugugguaauaaacagccacguuugugacuacucucucgauacggacggucccgugcgacugccuagaaucuaccaugaagggacauucauucccggaaccuauaaaaucgucauagauaagaaaaauaaacuuaacgacaggugcacucuggugacaaauugugugauuaagggccgggagguccguaagggccaguccguuuugcgccaguacaagaccgaaaucaaaaucgggaaggcaucaacuggauuuagaaaacuccugagugaggaaccaggugaugacugcauuagcaggacccaauuacugcggacagagacggcugagauccacgacgauaacuauggcgggccuggagacaagauuaccauauguaauggcucgacuaucguggaucagcgacuagguuccgaacucgggugcuacacaauuaaccgcguaaaaucuuucaagcugugcgagaauagcgccaccggcaagacaugugaaguggacucaacucccgucaaaugcagacagggauucugucuuaagaucacccaggagggcagggggcaugugaaauugagucggggauccgagguugugcuggaugcuugcgacucuagcugugaagucaugaucccaaaggguacgggcgauauucucguggacugcuccgggggacaacagcacuuucugaaagauaaccuuauagaccugggcuguccgcacaucccuuugcucgguaagauggccauuuauaucugccgcaugucaaaucaucccagaacaaccauggcauuccuguuuugguucagcuuuggguacguaauuacuuguaucaguugcaaggccuuauucuauucucugauaaucauuggcacccuagggaaaaagaucaaacaguacagggagcucaagccacagacauguacuauuugcgaaaccgcucccguuaacgcgaucgaugcagagaugcacgaccugaauugcuccuacaacauauguccuuauugcgccagccgucuuacaucggacggcuuggcucggcaugugacgcaauguccaaaacgaaaggaaaaggucgaggagaccgaacuguaccucaaccuggagaggauucccuggaucgugagaaaauuacugcaggucucagaaucuacugggguggcccuuaagcgcaguuccugguugauuguucuccuggugcuacugacaguaagccucucuccuguccagagcgcaccggugggacacgguaaaaccaucgagauauaucagacucgggaaggcuuugccuccaucugccuguucaugcuugggucaauuuuguuuaucguuaguugucuggugaagggauuagucgauagcgugucugacuccuucuuuccaggccucucaguaugcaaaacauguaguauugguagcgugaauggguucgagaucgagucccacaagugcuacuguucucuguuuugcugucccuauugcagacauugcucggcugauagggaaauacaccaacuucaucugagcauuuguaaaaagcgcaagaccggcucaaacguuauguuggccgucugcaaacgaauguguuuccgggcaacgaucgaggcgucccguagagcucuccugaucaggaguauuaucaauacuaccuucgugauuugcauacuaacacugaccaucuguguggucucuacuagcgccguugaaauggagaaccucccugcaggaacaugggaacgcgaggaggaccugaccaauuuuugccaccaggaaugucaggugacagagacugaaugccuuuguccauacgaggccuuggugcugcggaagcccuuauuccucgauuccauuguaaaaggcaugaagaaccugcuuaauucaaccucucuggagacgagccuaaguaucgaagcuccuuggggagccauuaacguccaauccacauuuaaaccggcagugagcaccgcuaauaucgcccucucuuggucauccguugagcauagaggaaacaagauacuggugacuggcaggagugaaagcaucaugaaguuggaggaacgaaccggugucucgugggaccuggggguggaggaugcgucugaguccaaauuacucacaguuagcauuauggaccugucacagauguauagucccguguucgaauaccuuucuggagaucgccagguagaggaauggccaaaggccacuugcaccggcgacuguccugagcggugcgguugcacguccagcacaugucugcacaaagaauggccccacucaagaaauuggaggugcaacccaaccugguguuggggcgucgggacuggaugcacauguugcggcguggaugugaaggacuuguuuaccgaucauauguucgucaaauggaagguugaguacaucaagacugaggcuauuguguguguagaacucacaagucaggagcgucaaugcagccugaucgaagcagggacccgcuuuaaucuaggaccugugacgauaacucuguccgagccccggaacauucagcagaaacuuccaccggaaaucaucacccuccacccuaagauugaggagggcuucuuugaccugaugcauguccagaaaguguugucugccagcacaguuuguaagcugcaauccugcacccacgguauacccggggacuuacagguguaucauaucggaaaucuccugaaaggcgauagagucaacggucaccuuauucacaagaucgaaucacauuucaacacaucuuggaugaguugggacggcugugaucuggacuacuauugcaauaugggggauuggccaucgugcacuuacaccggagugacgcagcacaaccaugcugccuuuguuaauuugcucaacauugagacagacuauacuaagaccuuccacuuucacagcaaaagggugacagcacauggcgauacaccccagcuggaccuaaaggcgcgaccuacuuacggggccggagaaaucaccguccugguagagguggcugauauggagcuucacaccaaaaagguugaaauauccggccucaaauucgccucucuggcauguacggguugcuaugcuuguucaagcgggaucuccugcaaggugcggauucaugucgacgagccagaugaauugacugugcacguaaaaaguucugaccccgauguggucgccgcaagcaccucauuaauggcccgcaagcuggaguucggaacagacuccaccuuuaaggcuuucagugcgaugccuaaaacuagccucuguuuuuacaucguugaaagagaguacugcaagucuuguuccgaggacgauacacaaaaaugcguggacaccaggcuggaacagccgcagucaauucuuaucgagcauaagggcacgauaauugguaaacaaaaugauacuuguacagccaaggcaagcugcuggcuggaaucggugaagucuuucuuuuauggcuugaaaaacaugcuagggagugucuucggaaaucuguuuaucggcauccuccuguuccuugcuccauuuguguuacugguucucuucuuuauguucggguggaagauuuuguucuguuuuaaaugcugccggcgaaccagaggacuguucaaguaccgccaccucaaagacgaugaggaaaccggcuauaggcguaucauagagcggcugaacuccaagaaggguaaaaauagacuucuggacggggauagguuggccgaccgcaagauugccgagcuauuuagcacuaaaacacacaucggauga

SEQ ID NO: 10318 - RNA, 5067 nt, Artificial Sequence
  derived and/or modified CDS sequence (opt3) from CCHFV(Kashmanov)__DQ211631.1__GP
augcccaccaacaucaugcacacacugcucgugugcuucauucuuuaccugcaguuguuaggccuugggggagcccauggucaaagcaaugcuacugagcacaacggcacgaauaccacaacugcaccuuccaccucucagucaccaaagccgcuagucaguacagcgcccccucaugcccucgaaagcuccaccauaaaaccaacuacacccgcuucugagaccgaagggucgggagagacgacuccuccacccaacaccacacagggcccuucaccaccggaaacuacccccgagagaccugccacaaccgcaacgagcacuccaaguacagacaauaccaacuccacuacacacguuaccgauaauaaccccacgucuaccaucagcacauccccuucaaguagcccaucuacucccuccaccccgcaggguauucaucacccugccaggaaucugcuuucagugagcagucccaagacagcuacuaccccaacaccuaccucucccggggagaucuccagcgaagcaucgucucugcacuccgccaugucacggacuagcacguuguauacagcuacccaaguaagcacugagaacgccaaucauuccgcgccacgccagucugaaagcucagcacagcccaccacaaccaguccuaugacuuccccagcccagagcauucucgugaugucugcugccccgaucgcaauacaaaacauccaccccucaccuacaaaucgaaguaaacguaaccuggagauggagauuauccugacgcucagccagggauuaaagaaauacuauggcaagauucugaagcuguugcaucugacccuagaagaggacacugaaggccuccuggagugguguaaaagaaaucuuggguccaacugcgaugacgacuuuuuccagaagaggaucgaagaguuuuucaugacaggagaggguuacuuuaacgaaguccugcaguucaaaaccuugucuacacucucgccaacugagcccagccacgcuggcccuccaaccguggaacccuuuaaguccuauuucgccaaaggguuucugucaauagauaguggauacuucucugcgaaguguuauccgcggagcuccacgucaggcuuacaacugauuaauguuacccagcacccugcccgcaucgcagagacaccaggucccaagacuaccagccucaaaacaauuaacugcaucaaucuuagagcuucuguguuuaaggaacauagggagaucgagauuaacguccuguugccucagauagccgugaaucuauccaacugucacguaguuaucaauagucaugugugcgauuacagccuggacacugaugggcccguccggcucccacacauuuaccaugaaggaaccuucaucccuggcacguauaaaauagugauugacaagaaaaacaagcugaaugaucgcuguacacuugugaccaacugcgucaucaaaggccgagagguuagaaaggggcaaucugugcugaggcaguacaagacugaaaucaaaauuggaaaggcuuccacagguucacggaaauugcucagugaggaacccggcgacgauuguaucagccguacccagcuguuacgcacugagaccgccgagauucacgacgacaauuaugggggaccaggcgauaagauaacaaucugcaacgguucgacgauuguagaccagagacugggguccgaacuaggcuguuacaccaucaauagggugaaaucuuuuaagcucugcgagaacagcgcaacuggaaagacaugcgaaaucgauucaaccccggucaaaugucggcaaggcuucugccugaagauuacacaggaggggcgaggacacgugaaacuuagucgcgguuccgagguuguguuggacgccugugauucuagcugcgaagucaugauaccuaagggcacuggggacauccugguggauuguuccggaggccagcagcauuuccucaaagacaaucugauugaucuugguugcccccacaucccacuguuggggaagauggcuauuuauaucuguagaaugucaaaccaucccaggaccacgauggcguuucucuucugguuuagcuucggcuacguaauaacaugcaucuuuuguaaggcacuguucuauaguuuaauuaucauuggaacccugggcaaaaagaucaaacaauaccgggagcuaaagccucagacuugcaccauaugugaaacagccccaguuaacgcuauugacgccgagaugcacgaucucaauugcucuuacaacaucugccccuauugugcaucccgccugacuagcgacgggcuugccagacacgugccucagugcccgaaaaggaaggaaaaggucgaggagaccgaauuguaccugaaucucgagcguauuccauggaucgugcggaaacuguuacaggucucggaaucaacaggaguggcucugaagcgaucuaguuggcuuauaguuuugcucgugcugcuaacgguaucccugagccccguccaaucugccccugugggucauggcaaaaccaucgagacuuaucagacaagagaaggguuuaccagcauuugucucuucaugcugggauccauccuguuuuugguuucaugccuggugaagggcuuagucgacagugugagcgauucuuucuuuccaggucucuccguauguaaaacuugcacaauugggucaaucaacggcuucgagauagagagucacaaguguuacugcagccuguuuuguugccccuauuguaggcauugcuccgcagaccgcgaaauucaccagcuucaucugucuaucugcaaaaagcggaagaccggaucgaaugugauguuggcgguuuguaaaagaaugugcuucagggcuacgaucgaggccagccgccgagcacuccugauucggucaaucauuaacacuaccuucgucauauguauccuaacacugaccauuugcgugguguccacaagugccgucgaaauggagaaucucccuucuggcacaugggaacgugaggaggaucugaccaacuuuugucaccaggaaugccaaguuacagagacugaaugucuuugcccguacgaggcuuuggugcugagaaagcccuuauuccucgacagcaucgugaaagggaugaaaaauucccugaacucaaccucucuugagacgagccugaguauugaagccccauggggagcaaucaauguacaguccacauuuaagccuaccgucagcacugcuaacauagcccuaucuuggucauccguggagcacaggggcaauaagauccucguuaccggucgcagugaaagcauuaugaagcuggaggaacggacaggggugucgugggauuugggagucgaggacgcgucugaguccaaacuguuaacugugagcaucauggaucucucacagauguauagucccguuuucgaauaccugucuggcgacagacaaguggaggaauggccaaaggccaccuguacgggugauugcccugagagguguggcugcacauccaguaccugccuucauaaagaauggccccacucacgaaacuggcgcuguaauccaacuuggugcuggggaguagggacaggcuguaccugcuguggggucgacgugaaggaucuguuuacugaccauauguucgugaaauggaaggucgaguacauuaagacagaggcuaucguuugcguggaauugaccagucaggagcggcaguguagccucauagaagcaggaacgagauuuaaccugggcccgguaacuauuacccuauccgagccuaggaacauccagcaaaaacugcccccagaaaucauuacacuucaccccaagguggaggaggguuucuuugaucucaugcauguccagaaagugcugucugccagcaccguuugcaaguugcaguccuguacacacgggauaccuggagaccuucagguguaucacaucggcaauuuacucaaaggugaccguauuaacggccaucugauccacaagauugaaccacauuucaauacuucauggaugucuugggaugggugcgaccuugauuacuauuguaacaugggagacuggcccaguugcaccuacacgggcgucacacaacacaaucacgcugccuuugugaaccuguugaauaucgagacugauuauaccaagacauuccauuuucacucgaaacgcguuaccgcacauggggacacuccucagcucgaucugaaggcgcggccgaccuacggagccggcgaaauaacagugcuagucgagguagcugacauggagcugcacacgaaaaagguggaaaucagcggucuuaaauucgccucccucgcaugcacuggguguuaugcuuguucuucaggaauuagcugcaagguuagaauccauguggaugagccagacgaacugaccguccacgugaaauccagugaucccgacguaguggccgcaucuacuagcuugauggccaggaaguuagaguucggcaccgauucaacuuuuaaggcuuucuccgcgaugccuaaaacaagucugugcuuuuacauugucgaacgagaguacuguaagagcugcucugaggaagacacccagaaauguguugacacgaagcucgagcagccccaauccauccugauagaacacaaagguacuauuaucggcaagcagaacgauacaugcaccgccaaggcaucauguuggcuugagagcgugaaaucguucuuuuaugggcugaagaauauguugggaucuguguucggcaacuuuuucaucgggauucuacuguuucucgcuccauucguccugcuuguguuauuuuucauguucggauggaaaauccuguuuugcuucaaguguugccggcgcaccagaggccucuugaaauacaggcaucugaaggacgaugaagagacugguuaucggcgaauaauugagagacucaauaacaagaaagggaagaaucgccugcuugacggagaaaggcuggccgaucguaaaaucgccgaguuguuuaguacaaagacccacauuggcuga

SEQ ID NO: 10319 - RNA, 5067 nt, Artificial Sequence
  derived and/or modified CDS sequence (opt3) from CCHFV(Drosdov)__DQ211630.1__GP
augcccaucaacauuaugcacgcccugcucgugugcuucauacuuuaccugcaguugagcggcuuagggggagcucauagacaauccaaugcaaccgagcacaacgguacaaauacuacgaccgccccuggcacaucucagucaccaaagccgcccgucaguacuacccugccucauacaccagaagcgagcaccaucaaacuaacuacacccaccuccgagacggaagggucuggagagacuaccccuccacccaacacaacucagggccucccucugccagguaccacaccggaaaggucggcuaccacggccacuucaacaagcaguaccgacgauaugaacuccacuacacagaugaccgacaauacgcccaccucuacaguuagcauugggcuuuccucaaguccuagcaugccaucuacuucccaaggaauccacuaucccgugcggucacuguugagcguaaguucuccuaagaccgcaacaacuccaacccccauguccccgggcgaggugagcccugagacaucgucucagcauuccgccaugucacgcauucccacccucuacacugcuacgcaggucaguacagaaaauaccaaccgaagcaucccacgucaguccgagucuagcgugcaaccugcaacucagucacccauaaccaguccagcccagacaauccugcugauguccgcugcccccaccgcgauucaggauaugcacccuagccccaaaaauagaucuaagaggaaccucgaaguugagaucauuuuaacucugucacaaggccuuaaaaaguauuacgggaagaucuugaaacugcuacaccucacacuggaggaagacacggagggacuucuggaaugguguaagcggaauuuggguaguaacugcgaugacgacuuuuuccagaaacgcauagaggaauuuuucauuaccggcgagggguauuuuaaugaggugcuccaguucaagacuccgagcacacugucccccaccgaaccuucucaugucagauuaccaacagcagagcccuuuaaaucguacuucgccaagggauuucugagcaucgauuccggcuauuucucagcuaaguguuacccuaggaguucuacuagcggucuccaacuuauuaacgugacccagcacccagcccggaucgcagaaacgcccgggccgaaaaccacaucccugaagacuaucaauugcauuaacuugcgcgcuucaguauuuaaagagcaucgagaaguugagauaaacgugcuacugccucagaucgccgucaaucucagcaacugucacguggugauuaauucucacgucugcgauuacucccuggacaccgauggaccaguuagacuucccaggauccaucacgagggcgcguucauaccuggcacauauaagauugugaucgacaaaaagaacaaacugaaugaucgguguaguuugguaacuaacugcgugaucaaggggcgugaaguccgcaagggacagagcgugcucagacaauacaaaaccgagauuaagaucgguaaagccucuacgggcuccaggaagcuguuaucagaggaacccggggacgacuguauuagucggacacagcugcuaaaaaccgaaacugcagagauacaugaugacaauuauggaggcccaggugauaagaucacaauuugcaacgggagcaccaucguugaccagcgacucggcucggagcugggauguuacacuaucaaucgcgugaaguccuuuaaacuuugcgaaaacucugcuaccggcaagacaugcgagauugauagcacgccugucaaauguagacagggguucugcuugaagauaacccaagaaggaaggggucacgugaaacugucacggggcagugagguaguucucgacgccugugauuccucuugcgaggugaugauccccaaggggacuggagacauucuggucgauuguagcggcggucagcagcauuuccuuaaggacaaucugaucgauuuggggugcccacacauuccgcuccugggcaaaauggcuaucuauauaugucgcauguccaaccacccuagaacaaccauggccuuuuuauucugguuuucauucggauacgugaucacaugcaucuuuuguaaggcacuguucuauagccuaauuauuaucggcacucucgggaaaaagauaaaacaguacagggaacugaagccccaaaccugcacgauuugugagacagccccagucaaugcuaucgacgcggaaaugcaugaccuuaagugcaguuacaacauuugccccuauugugcaucucguuugaccuccgauggacuggcccggcacgugacucagugcccuaaacgaaaggagaaaguugaagagaccgagcucuaccugaauuuagaaagaaucccauggauagugaggaagcugcuucagguaagcgagucgacaggugucgcuuugaaacgcucaucuuggcucaucgugcugcuaguucugcucacugugagucugucccccguccagagcgccccugugggccaugggaagaccauugaaacauaucaaacgcgggagggauuuaccucuaucugucuuuucauguugggcagcauucuguuuaucguauccugcuuagugaaaggucucguugacucagucagugauagcuucuuuccggggcugucuguguguaagacuugcuccauaggcucaauuaacggauucgaaaucgagagucacaaguguuacugcagccuguuuuguugcccauauuguagacacuacuccgcagacagggagauccaucagcugcacuugucuauuugcaaaaagcgcaaaacaggcucgaacgugaugcucgccgucugcaagcgaauguguuucaaagcuaccaucgaagccagccggcgugcacugcuaauuagaucaauaaucaauacuacauucguuauuugcauccugauucucgcgaucugugugguguccaccagugcuguagagauggaaaaccugcccgccgggacgugggagagggaagaggaucuuacuaauuuuugccaucaggagugucaagucaccgaaacagagugcuuguguccuuaugaagcacugguguuacgcaagccacucuuccuggacucuaccguuaagggaaugaaaaaccuucugaauagcacuucccuagagacaucacucucuauagaggcccccuggggcgcuaucaacgugcagagcaccuuuaagccuacagucaguacugccaauauugcacuguccuggagcucuguggaacaccgggguaacaaaaucuugguuaccgggagaucagaguccauuaugaagcuggaagagaggacgggagugaguugggauuuaggcguagaagacgcuagcgagucgaaacuccugacagucucuaucauggaucuuucccagauguacagcccgguguucgaguaccugucaggugaccgacagguggaagaguggcccaaggcaaccugcacuggcgauuguccagaacgcugcggguguaccaguucuacaugcuugcauaaggaguggccucacucccggaauuggagaugcaaccccacuugguguuggggagucggcaccgggugcacguguugcggaguugacgugaaagaucucuuuacagaccacauguucguaaaguggaaaguggaauauaugaagaccgaggcgauagucuguguggagcugacuagccaagaaaggcagugcucacuaauugaggccggcacacguuuuaaucuggguccaguuaccaucacucuuagugaaccucgcaacauccagcagaaacucccaccagagauuauaacacugcauccgaagaucgaagagggguucuuugacuugaugcacgugcaaaagguccugagcgcuuccaccguguguaaauuacagucuugcacgcauggcauuccuggagaucuccagaucuaccacauugguaaucugcuuaagggcgaccggguuaacgggcaucugauccacaaaauagagccccacuucaauacuagcuggauguccugggauggaugugacuuggauuauuacugcaacaugggcaacuggccaucauguaccuauacaggggugacccagcauaaucacgcagccuuugucaaccuccugaauaucgaaacagacuacacuaagaccuuccauuuucacucuaaaagaguaacggcucacggagauacaccccaacuagaccugaaggccaggccuacuuauggcgccggugagauuaccgugcuuguugaaguggcggauauggagcuccauaccaaaaaggucgagaucagugggcugaaguucgccucguuggugugcacaggaugcuacgcuuguagcuccggcauuucuugcaaaguacgaauccacguggacgaaccagaugaguuaacuguccauguuaagucaagcgaccccgaugugguggccgcauccaccagucugauggcucggaaacucgaguucgguacagacucuauauuuaaggccuucagcgcaaugccuaaaacgucacuguguuuuuacauugucgaacgcgaauauugcaaguccuguagugaggacgauacuaagaaaugcguggacaccaaacuugagcagccgcagagcauccugaucgaacacaaaggcacaauuaucgggaagcaaaacgauaccuguacugccaaggcuucuugcugguuggaguccguuaagucauucuuuuacggacuaaagaauaugcugggcagcguauucgggaacuuuuucgugggaauacuccuguuucuugcgccauucgucuuacuggugcucuuuuucauguucggcuggaaaauuuuguuuuguuucaagugcuguagaaggacacggggucuguuuaaauaucgacaucucaaggacgaugaagagaccggguacagacgcaucauugaaaggcuuaauucgaaaaagggaaagaaccgucuucuggacggcgagcgguuggccgauagaaaaaucgcagagcuauucucuacgaagacucacauaggcuga

SEQ ID NO: 10320 - RNA, 5067 nt, Artificial Sequence
  derived and/or modified CDS sequence (opt3) from CCHFV(1231-CR/TI-2015)__KU161585.1__GP
augcccaucaacauuaugcacacccugcucgugugcuucauacuuuaccugcaguuguuaggccuugggggagcccaugagcaaagcaaugcuacagaccacaacagaacuaauacgaucaccgcaccuuccacaucucagaacccaaagccgcccgccucaacuaccccuccacauacacccgaaaguagcaccauuaaacuaaucacuuccacaggugaggcggaaggcucuggggagaccacgccuccacucaauacuacccagggacccuuuccuccagaaacaacuucggagcacccggcuucaaccgccacaaacaccagcaguaccaauuccaugaacucuacuacacagaugaccgauaagacucugacaagcaccgucuccacgucacuuaguauuagccccucuaccccuuccacaucacaaggcauccauuauccaauaaggagccuguugaguguuucuagcccccggacugcagccaccccuacaccaaugagcacucgcgagaugucgucugaaaccaauucccagcacucagcugugagucgaacacccaccuuccacacugcaacgcagguaagcacagagaacgacaaucguuccaccccgagacagucugaaagcucagcccaaccugcuacucagagucccaugaccuccccagcccagagcauccuccuggugucugcggcaccuacaaccauucagaacauccaucccucaccaacuaauaggaguaaacggaaccuggagauggagauuauccucacauuaccccaaggucugaagaaauacuaugggaagauacuuaaguugcugcaccuaacgcucgaagaggauaccgaaggacugcuugagugguguaaacgcaaucugggcagcaacugcgacgaugaauuuuuccagaagagaauugaggaguuuuucaucacuggcgaaggguacuuuaacgaggucuugcaguucaaaacacucuccacccugucuccuauggaaccaucgcaugccaggccgcccacagcugagccuuuuaagagcuauuucgccaaaggauuuuuauccauugacucagguuacuucagugcaaaguguuauccacggucuagcuccucaggccugcaacucaucaauaucacucagcaccccgcucgcauugccgaaaccccugggccaaagacgaccagccuuaaaacaauaaacugcaucaaucugcgagcgucuguguuuaaggagcacagagagguugaaauuaacguguugcuaccccagaucgccgucaaucuguccaacugucaugugguaauaaauagucacguuugcgauuacagccucgacacugauggaccggugaggcugccucggauuuaccaugagggcaccuucaucccagguacauauaaaaucgucauugacaagaaaaacaagcugaaugaucguuguacucuggugaccaacugcgugacgaaagggcgcgaagucagaaagggacagucuguuuugaggcaauacaagacagagaucaaaauuggcaaggcauccaccggcucacggaaacuccugagugaggaacccggggacgauuguauaagccgaacucaguuacugcgcacagagaccgcugaaauccacgacgacaauuauggagguccuggcgauaagauuacuaucugcaacgggucgaccaucguggaccagagacuaggauccgagcucggcuguuacacaauuaauaggguaaaaucuuucaagcugugcgaaaacagcgccacggguaagaccugcgagauagauucaacucccgugaaaugucggcagggguuuugccuuaagaucacacaagagggccgcggacaugucaaauugaguagaggcuccgaagugguucuggacgcuugugauucuagcugcgaggugaugauuccaaaggggaccggagacauccucgucgauuguuccgguggccagcagcacuuccugaaagacaaucuuauugaucuggggugcccucacauccccuugcucggaaagauggccauauauaucuguaggaugucaaaccauccacguacaacuauggcauuucuguucugguuuagcuucggcuacgugauuaccugcaucuuuuguaaggccuuauucuauagucugauuaucauagguacgcuagggaaaaagauuaaacaguaccgggaacucaagccgcaaacaugcaccaucugugagacugcuccuguaaacgcgauugacgcagaaaugcacgaucugaauugcucuuacaacaucugccccuauugugccucccgacuuaccagcgacggcuuggcuagacauguuacacagugcccaaaaaggaaggagaagguggaggaaacugagcuguaccucaaucuggaacgcauacccuggaucguccggaaauuacuucaggugucggagucaaccggagucgcccuuaagagaucuaguugguugauugugcuccugguucuacugacagugucccucagcccuguacagucugcaccagucggccacgggaaaacgaucgaaaccuaucaaacuagggagggauuuacaagcauuugucuguucaugcuugguuccaucuuguuuauagugucaugccugguuaagggcuuaguggagagugucagcgacucuuucuuucccgggcucuccgugugucgcacgugcucaauuggaaguaucaacggcuucgaaaucgagagccacaaauguuacugcucccuguucuguugcccuuauugucgacauugcucugccgaucgggaaauucaccagcuucaucugucgaucugcaagaaacguaagacugguagcaauguaauguuggcuguguguaagagaaugugcuuuagggccacaauggaggcaucacgccgggcgcuccugauuagauccauaaucaacaccacguucguuauuuguauccuaacucugaccauuugcgucgugaguacaucugcuguggaaauggagaaucucccggccgggaccugggagagggaagaggaccugacuaacuuuugucaccaggaaugccaagucacagagaccgagugucuuugcccauacgaagcauugguucugcgaaaacccuuauuccucgauagcaucgugaagggcaugaaaaaucugcuuaacuccacaucacuggagacuucucuaagcauagaagccccuuggggagcuaucaaugugcagaguaccuuuaagccaacgguauccacagccaacauugcacucagcuggucuucagucgagcaucgcggcaauaaaauccuggugaccgggcgguccgaaaguauuaugaaguuggaggagagaacuggaguuagcugggaccugggcguggaagaugcuucggagucuaaguuacucaccgucuccaucauggaccugagccagauguauucacccguguucgaauaccuuaguggugauaggcagguugaggaauggccuaaagccacauguacuggggacugcccggagcguuguggaugcaccucuuccacgugccugcacaaggaguggccccacagccgcaacuggcgguguaauccaacauggugcuggggcguggguaccggcuguacuugcugugggguagaugucaaagacuuguuuacagaucauauguucgugaaguggaaaguggaauacauaaagaccgaggcgauugucugcguugaacucacuucacaagagagacaguguagucugaucgaagccggaacaagguuuaaccuaggcccugugaccaucacgcugagcgagccccgaaacauucagcagaagcugccaccugagauaaucacucuccaccccaaaauugaagagggguucuuugaccugaugcauguacaaaagguguuguccgcuucuaccgucugcaaacugcagagcuguacacacggaaucccaggcgauuuacagguguaucauauugguaaucuccugaagggggaccggguuaacggacaccuuauccacaaaauagaaccgcauuucaauaccuccuggaugucaugggacggcugcgaucuggacuacuauuguaacaugggugauuggccuucuugcacauacacuggcgugacccagcacaaucaugcagccuuugucaacuugcucaauaucgagacggacuauacaaagacuuuccacuuccacaguaagcgcgugaccgcucauggggauacaccccaacuggaccuaaaagccagaccaaccuacggagcaggcgagauuacuguucugguggaagucgcggauauggagcuucacaccaagaaaguagaaaucucggggcucaaguuugccagccuggcuugcacaggauguuaugccugcuccucuggcauuucauguaaagugaggauccauguugacgagcccgaugaauugacggugcacgucaagagcuccgacccugaugugguagcagcuaguacuucuuuaauggcccggaaacuggaguucgguaccgacagcacauuuaaggcauucucagccaugccaaagaccucccucugcuuuuacauaguggagcgagaauacuguaaaaguugcagcgaggaugacacuaagaaaugugucgacacaaagcuggaacagccccagucuauucuuaucgagcauaaagggaccaucauuggaaagcaaaacgauacgugcacugcuaaggcguccuguuggcuggaaucaguuaaauccuucuuuuauggcuugaagaauaugcuagguucgguguucggcaacuuuuucaucgggauacugcucuuucuggccccuuucgugcuuuuaguccuguucuuuauguucggauggaaaauucucuuuugcuucaaguguugcagacgcacaaggggcuuguuuaaauaccgucaccugaaggacgaugaggagaccggguaucggagaaucauugaaaggcucaauaacaagaaaggaaagaaucgccugcuugacggcgagcgacuggcagauagaaaaaucgcugaauuguucucuaccaagacucacauagguuga

SEQ ID NO: 10321 - RNA, 5067 nt, Artificial Sequence
  derived and/or modified CDS sequence (opt3) from CCHFV(1-CR/HU-2015)__KU161584.1__GP
augcccaucaacauuaugcacacccugcucgugugcuucauacuuuaccugcaguuguuaggccuagggggagcccaugagcaaagcaaugcuacagaccacaacagaacuaauacgaucaccgcaccuuccacaucucagaacccaaagccgcccgccucaacuaccccuccacauacacccgaaaguagcaccauuaaacugaucacuuccacaggugaggcggaaggcucuggggagaccacgccuccacucaauacuacccagggacccuuuccuccagaaacaacuucggagcacccggcuucaaccgccacaaacaccagcaguaccaauuccaugaacucuacuacacagaugaccgauaauacucugacaagcaccgucuccacgucacuuaguauuagccccucuaccccuuccacaucacaaggcauccauuauccaguuaggagccuguugagugugucuucccccaagacugcagccaccccuacaccaaugagcacucgggagaugucgucugaaaccuccucacagcacagugcuaugagccgcacacccaccuuccacacugcaacgcagguauccacagagaacgccaaucgaucuaccccgcgucagagcgaaucaagugcucaaccugccacucagucccccaugaccagcccagcgcagucuauauuucucgugucagcagccccuacaaccauccagaacauucaucccaguccaacuaauagaagcaaaaggaaccuggagauggagaucauucugacacucccccaagguuuaaagaaauacuaugggaagauccugaaacuuuugcaccugacgcuagaagaggacaccgaaggacuccuggagugguguaaacggaaucuuggcuccaacugcgaugacgaguucuuucagaagcgcauagaggaguucuuuauuacuggcgaaggguacuucaacgagguccugcaguuuaaaacauugucuacccucucgccuacagaaccaagccaugcuagaccgcccacugccgagccuuucaaguccuauuuugcaaaaggauuccugucaaucgauagugguuacuuuucugcuaaguguuauccaaggagcuccaccucaggcuuacaacugauuaauaucacgcagcaccccgcccggaucgcggaaaccccugggccaaagacaacuagccucaaaaccauuaacugcauaaaucuucgcgccucuguguucaaggagcaccgagagguugaaaucaacgugcuguugccccagauugcagucaaucuauccaacugucaugugguaaucaauagucacguuugcgacuacagccuggauacagacggaccggugagacucccuaggauauaccaugagggcacuuucauuccagguaccuauaaaaucgucaucgauaagaaaaacaagcugaaugaccgguguacgcuugugacaaacugcgugauuaaagggcgugaaguccgcaagggacagucuguucugagacaauacaagaccgagaucaaaauuggcaaggcuuccacuggcucaaggaaauugcucagugaagaacccggggaugacuguauaagccggacacagcuguuacgaaccgagacugccgaaauccacgaugacaauuauggagguccuggcgacaagauuaccaucugcaacgggucgacaaucguggaucagcgccugggauccgagcuaggcuguuacacgauuaauagaguaaaaucuuuuaagcucugcgaaaacagcgcuaccgguaagacuugcgagauagacucaacacccgugaaauguaggcagggguucugccugaagaucacccaagagggccggggacaugucaaacuuagucgcggcuccgaagugguuuuggaugccugugacucuagcugcgaggugaugauuccaaaggggacaggagauauccuggucgacuguuccgguggccagcagcacuuucucaaagauaaucugauugaccuugggugcccucacaucccccuguugggaaagauggcaauauauaucuguagaaugucaaaccauccaaggacuaccauggccuuccucuuuugguucagcuuuggcuacgugauuacgugcaucuucuguaaggcucuguuuuauaguuuaauuaucauagguacacuggggaaaaagauuaaacaguaccgugaacuaaagccgcaaaccugcacuaucugugagaccgcgccuguaaacgcaauugaugccgaaaugcacgaccucaauugcucuuacaacaucugccccuauugugcuucccggcugacaagcgauggccuugcccgacauguuacucagugcccaaaaagaaaggagaagguggaggaaaccgaguuguaccugaaucucgaaaggauacccuggaucguccgcaaacuguuacaggugucggagucaacaggagucgcacugaagcggucuaguuggcuuauuguguugcucguucugcuaacggugucccugagcccuguacagucugccccagucggccacgggaaaaccaucgaaacuuaucaaacaagagagggauucaccagcauuugucucuuuaugcuggguuccauccuuuucauagugucaugcuugguuaagggccugguggacagugucagcgacuccuuuuuccccggguuaucuguguguaggacuugcucaauuggaaguaucaacggcuucgagaucgaaagccacaaauguuacugcucccucuuuuguugcccuuauugucgccauugcucugcugaucgagagauucaccagcugcaucuuucgaucugcaagaaacggaagacagguagcaauguaaugcuggccguguguaagcguaugugcuucagagcaaccauggaagcgucaaggcgcgcuuugcucauucgguccauaaucaacacgacuuuuguuauuuguauccugacccuaacaauuugcgucgugaguaccucugccguggagauggaaaaucugccggcagggacuugggagagagaggaagaccucacaaacuucugucaccaggagugccaagucaccgaaacagagugucugugcccauacgaggcccuuguuuugaggaaaccccuguuuuuagauagcaucgugaagggcaugaaaaaucuccugaacuccacuucacuugaaaccucucugagcauagaggcuccuuggggagccaucaaugugcagaguacguucaagccaacaguauccaccgcaaacauugcucuaagcuggucuucagucgaacaucgaggcaauaaaauccucgugacugggcgcuccgagaguauuaugaagcuggaggaacggaccggaguuagcugggacuugggcguggaggaugccucggaaucuaagcuguuaacagucuccaucauggaccucagccagauguauucacccguguuugaguaccugaguggugauagacagguugaagaguggccuaaagcgacuuguaccggggacugcccggaaagguguggaugcacgucuuccacaugccuucacaaggaguggccccacagccguaacuggcgcuguaauccaaccuggugcuggggcguggguacuggcuguacaugcugugggguagaugucaaagaccuguucaccgaucauauguuugugaaguggaaaguggaguacauaaagacugaagccauugucugcguugaguugacaucacaagaacggcaguguagucucaucgaggcuggaaccagauucaaccugggcccugugacgaucacucuaagcgaacccaggaacauucagcagaagcugccaccugagauaaucacccuucaccccaaaauugaggaaggguuuuucgaccucaugcauguacaaaaggugcuguccgcaucuacagucugcaaauugcagagcuguacccacggaaucccaggcgauuuacagguguaucauauugguaaucugcucaagggggaccgaguuaacggacaccugauccacaaaauagagccgcauuuuaauacauccuggaugucaugggacggcugcgaucuugacuacuauuguaacaugggugauuggccuucuugcacuuacaccggcgugacgcagcacaaucaugccgcuuucgucaaccuguugaauaucgaaacagacuauacuaagaccuuccacuuucacaguaagcgggugacagcccauggggauacgccccaacucgaccugaaagcacgcccaacuuacggagcgggcgagauuaccguucuaguggaggucgccgauauggaacugcacacaaagaaaguagagaucucggggcuuaaguucgcuagccucgccugcacgggauguuaugcaugcuccucuggcauuucauguaaagugagaauccauguugacgaacccgaugagcugacugugcacgucaagagcuccgacccugaugugguagcugccaguaccucuuugauggcaaggaaauuagaauuugguacagacagcaccuucaaggccuuuucagcuaugccaaagacuucccugugcuucuacauaguggagcgggaguacuguaaaaguugcagcgaagaugacacaaagaaaugugucgacaccaagcucgagcagccccagucuauucugaucgaacauaaagggacgaucauuggaaagcaaaacgauacuugcacagcgaaggccuccuguuggcuugagucaguuaagagcuuuuucuauggccugaagaauauguuggguucgguguuuggcaacuucuuuaucgggauacuacuguuccucgcaccuuucgugcugcuugucuuauuuuucauguuuggauggaaaauucuguucugcuuuaaguguugccgaagaacccgcggccucuucaaauacaggcacuugaaggacgaugaagagaccggguaucgucggaucauugagagacugaauaacaagaaaggaaagaauaggcuccuggacggcgaacgccuugcugaucgaaaaaucgccgagcuguuuucuacuaagacacacauagguuga

SEQ ID NO: 10322 - RNA, 5067 nt, Artificial Sequence
  derived and/or modified CDS sequence (opt3) from CCHFV(V42/81)__GU477490.1__GP
augcccaccaacacaaugcacacucugcucgugugcuucauccuuuaccugcaguuguuaggccuugggggagcccauguccaaccuaaugcuacggagcacaacagaaccaauacaacuaccgcaccagguacaagccauucccuaaagccgcucguuucuaccacucccccucaggccccagaaucaaguacaauuaaacccaccacgccuacuagcgagaccgaaggcuccggggaggcgacaccacugucuaacacuauacaggcucccucgucaccugaaaccacaagcgagaggccagccaccgcagugaucaguacguccggaacugacucuacaaauagcaccacucagacaaccgauaacaauccgacgaccacaguaggcacuucccccucaaguagcccuucuaccccauccacaccccaagguauucaccaucacgcccggucacuucugagcgugaccaguccugagacugucacaaccccaaagcccacuucuccgcgcgaaauguccagcgagacgucgaaccagcacucugcuaugucccgaacaccuacccaucacacugugacccagguuucaacagaaaauaccagucauagcacuccccgucagccagaguccucugcacaaccuacaagcucaagucccaugacguccccagcccagagcaccuugcucaugucugcugcccccacugcggugcagucaauccacccuaguccaacaaacagaagcaaaaggaaucuggagaccgaaauuauccugacacucucccagggguuaaagaaauauuacggaaagauacugaagcuguugcaccugacucuagaggaagacaccgagggccuccuggaaugguguaaacggaaccuuggcucuaauugcgaugacgacuuuuuccaaaagcgcaucgaggaguuuuucaugacgggggaaggauauuuuaacgagguccugcaguucaaaaccccgucgacagugagccccacugaaccuucccaugcaagauugccaaccgccgagcccuuuaagucauacuucgcuaaagguuuucucaguauugauucuggcuauuucagcgccaaguguuacuccaggucaagcacaucugggcugcaguuaaucaauguaacucaacacccugcacggauugcugaaaccccaggacccaagacgacaucccugaaaaccaucaacugcauaaaccuccgcgccaguguuuuuaaggagaaucgagagauugaaaucagcgugcuucugccgcagauugcggucaacuugucuaauugucauguggugaucaacucccacgucugcgauuauucacuagacacugauggcccuguuagacugccaaggaucaaucaugaggguacauucauucccgggaccuacaaaauagugaucgacaagaaaaacaagcucaaugaucgguguacucugguaaccaacugcgugauuaaaggacgugaaguccgcaagggccagagugugcuuagacaguacaagacagagaucaaaauaggcaaggccagcacggggucgaggaaacuguuguccaaggaaccuggagacgauuguauuucucggacccaacucaugcgaacugagacagcagagauccacgacgacaauuaugguggccccggggauaaaaucaccauuugcaacggaagcacaaucguugaccagcgccugggcucagaauuagguuguuacacuauuaauagagugaagaguuuuaagcugugcgagaacuccgcuaccgggaaagccugcgaagucgauucuacgccagugaaguguaggcagggcuucugccuaaaaauaacacaggagggacggggccacguaaagcucagccgcggguccgagguugugcuggacgcuugugauucaagcugcgaagucaugaucccuaaaggaaccggugacauucuuguggauuguaguggcgggcaacagcauuucuugaaggacaaucugaucgaucucgagugcccccacaucccacugcuuggaaagcuggccauuuauauauguagaaugucuaaccauccgaggacuaccauggcauuuuuguucugguuuggcuucgguuacgucaucacaugcauucucuguaaagcccuguuuuauuccuuaaucauuaucgggacucugggcaagaaaauaaagcaguaccgugaacuaaaaccucagaccugcacaaucugugagacggcucccgugaaugcgauugacgcagaaaugcacgaucucaacugcagcuauaacaucugcccauacugugccucgcggcugaccucagacggacuugcucgacacguuacucaaugccccaagagaaaggagaaaguggaggaaacagaguuguaccugaaucucgaaaggauuccuuggaucguacgcaagcuguuacaggucucugagaguaccggcgugguucugaaacgguccagcuggcuuauaguguugcucguccugcuaacugugucucugagcccaguacaguccgcccccguggggcauggaaagacaauugaaaccuaucagacgagagaggguuucacuucaaucugucucuuuaugcugggcaguauucuuuucaucguuagcugcauagucaaaggguugguggacucuguguccgauucauuuuucccuggacugagugucuguaagaccugcagcaucuccucuauuaacggcuuugagaucgaaucgcacaaauguuacugcagcuuauucuguugcccguauuguaggcauugcucagcagaccgcgagauucaccaacuccaucuguccaucugccgaaagcggcguacagguaguaauguuaugcuugccguguguaagagaaugugcuuuagggcuaccauagaagugucucgccgggcccuguugauuagaagcaucaucaacacuacauucguaauuuguauccucacccugacaauuugcgucguguccacuucagcaguugagauggaaaaucuaccagcggggaccugggagagggaggaagaucugacgaacuucugucaccaggagugccaggugacagaaaccgagugucucugccccuacgaggcucugguccuucgaaaaccuuuguuucuggacucuauagugaagggcaaaaagaauuuacucaacagcaccagucuggaaacuucccuuagcaucgaggccccauggggagcaauuaauauccaaucuacauucaaacccacuguuucagccgcuaacauugcccuguccuggaguagcguggaacaccgcggcaauaagauccuaguaucggggcggucugaguccauaaugaagcucgaagagagaaccggagucagcuggaaccugggcguggaggaugcaucagaaaguaaauugcugacggugucuaucauggacuuaucccagauguauagcccugucuuugaguaccucucaggugauaggcagguugaagaguggccgaaggcuacauguaccggggacugccccgaacguuguggaugcacaaguagcacuugccugcauaaagaguggccacacucccgcaauuggcgguguaacccuaccuggugcuggggcguggguacuggcuguacaugcugugggguagaugugaaggaccuuuucauugaucauauguuugucaaauggaagguggaguauaucaagaccgaagccauuguuugcguggagcugacgucucaggaaagacaauguagcuugaucgaggcgggaacuagguucaaucucggccccgucaccauaacacuguccgaaccacgaaacauucagcagaaacuaccucccgagaucaucacccugcacccaaagauugaggaaggguuuuucgaccuuaugcaugugcagaaaguucucucagccucuacagugugcaagcugcaaaguuguacucacggaauaccgggcgauuugcaggucuaccacaucgguaaccuguuaaaaggggaccggguaaauggacaucucauucacaagaucgagccucauuuuaacaccucguggaugagcugggacggcugcgaucuggacuacuauuguaauaugggugauuggcccuccugcacguacacaggcgugacucagcacaaccacgcugcauucguuaaucuucugaacauugaaaccgacuauacaaagaccuuucauuuccacucuaaacgcgugacugcccauggggagaccccacaguuggaucucaaggcuagacccgccuacggagcaggcgagaucacaguccugguggaaguagcggacauggagcuacacacgaaaaagguggaaauaucagggcugaaauuugccagccuugcuugcacuggauguuaugccugcuccaguggcaucucuuguaaggucaggauucauguugaugagccugacgaacucaccgugcacgugaaaagcaaugauccagacgucguggcagcuucaacaucccugauggcccggaaguuggagagugguaccgauagcacuuucaaggcauucucugccaugcccaaaacauccuuaugcuuuuacaucguugagcgagaauauuguaagucaugcagcgaggacgauacccaaaaauguguagaaacgaagcuggagcagccucagucgauucucaucgaacacaaagggacuauaauuggaaagcaaaacgacacaugcaccgcuaaggcgucuuguuggcuggagagugugaaauccuucuuuuacggccuuaagaauaugcuggguagcgucuucggcaacuuuuucaucgggaucuugcuauuucuggccccguucgugcuccugguuuuguuuuucauguuuggauggaaaauuuuauucugcuucaaguguugcagacgcaccaggggccuguuuaaauaccgucaucucaaggaggacgaagagacuggguaucggagaaucauagaaaggcuuaauucaaagaaaggaaagaaccgccugcucgauggcgagcgacuggcagacagaaaaauugcugaacuuuucuccacaaagacccacaucgguuga

SEQ ID NO: 10323 - RNA, 5067 nt, Artificial Sequence
  derived and/or modified CDS sequence (opt3) from CCHFV(ROS/HUVLV-100)__DQ206448.1__GP
augcccaccaacaucaugcacacacugcucgugugcuucauucuuuaccugcaguuguuaggccuugggggagcccauagacaaagcaaugcuacugagcacaacgguacgaauaccacaacugcaccuuccaccucucagucaccaaagccgcuagucaguacagccccgccucaugcgcucgaaagcuccaccauaaaaccaacuacacccguuucugagaccgaaggcucgggggagacgacuccuccacccaacaccacacagggaccuucaccaccggaagcuacucccgagaggccuaccacaaccgccacgagcacuccaaguacagacaauaccaacuccacuacacacgugaccgauaauaaccccacgucuaccaucagcacauccccuucaaguagcccaucuacucccuccaccccgcagggcauucaucacccugcacggaaucugcuuucaguaagcagucccaagacagccacuaccccaacaccuaccucucccggugagaucuccagcgaaacuucgucucugcacuccgcuaugucacgcacgaguacauuguauaccgcaacucaagugagcaccgagaacgccaaucauuccgcuccacgacagucugaaagcucagcccagcagacaaccaccagucccaugacauccccugcgcaaagcauucucgucaugucugcagccccaacggcuauccagaacauacacccgucacccaccaaucguaguaaaagaaaccuggagauggagaucauucugacucucagccagggguuaaagaaauacuauggaaagauccugaaacuuuugcaucugacacuagaagaggacaccgaaggccuccuggagugguguaaaaggaaucuuggcuccaacugcgaugacgacuuuuuccagaagcggauugaagaguuuuucaugacaggggagggauacuuuaacgaagugcugcaauucaaaacuuugucuacccucucgccuacggagccaagccacgccagacccccuaccguugaaccauuuaaguccuauuucgcaaaagguuuucugucaaucgauaguggcuacuucucugcuaaguguuauccccgcuuaagcacauccgggcugcagcucauaaaugugacucagcacccggccaggauugcggagaccccuggaccaaagacaacuucacuuaaaaccaucaacugcauuaaucugcgggccagcgucuuuaaggaacaucgcgagaucgagaucaacguguugcuaccccaaauugcaguaaaucugucuaacugucacguugugauaaauucccaugucugcgauuacagucucgacacggauggcccugugcgacugccccacaucuaccaugaagguacauucauuccagggaccuauaaaaucgugauagacaagaaaaacaaacuuaaugauagauguacucuggucacaaacugcguuauuaagggaagggaggugcggaagggccagagcguauugcgucaguacaagaccgaaaucaaaaucggcaaggcuucuacugggucccgcaaacuccugucagaggaaccuggagacgauuguauuaguagaacccaguuacugaggacagagacggccgagauccacgacgacaauuaugguggccccggggauaagauuaccauaugcaacggaagcacuaucguggaccaacggcuaggcucggaacucgguuguuacacaauuaaucgagucaaauccuuuaagcugugcgagaacucugcuaccgggaagacaugcgaaaucgauagcacuccagugaaaugucgccagggcuucugccuuaagaucacccaggagggaagaggccacguuaaauugucaagggggagugaggugguccuggacgccugugauuccucuugcgaagugaugauuccgaagggaacgggugacauacucguagauuguagcggcgggcagcaacauuuccugaaagacaaucuuaucgaucugggaugcccucacauucccuugcucggcaagauggcaaucuauauuugucggauguccaaccauccacgcacaaccauggccuuucuguucugguuuucauucgguuacguuaucacuugcauauuuuguaaggcuuuauucuauagccugaucauuaucgggacccuaggcaaaaagauuaaacaguacagagagcucaagccccagacaugcacuaucugugaaaccgcgccugugaacgcaauagacgccgagaugcacgaucugaauugcaguuacaacauuugcccauauugugcuucuaggcuuacauccgacggauuggcccgucacgucccccagugcccuaaacggaaggaaaagguggaggagacggaacuguaccucaaucuggagcgaaucccguggauugucagaaaauuacugcaagugagcgaaucgaccggcguugcacuuaagaggucaucuugguugaucgugcuccugguacuacugacugucagucucuccccagugcagagcgcccccguugggcauggaaaaacaauagagaccuaucagacucgcgaagguuuuacaucuaucugucuguucaugcuuggcagcauuuuguuucugguguccugcuuagucaaggggcucguggacucaguaagugauagcuucuuuccuggacugucuguguguaaaaccugcuccaucggcucaauuaacgguuucgagaucgagagucacaaguguuacugcagccuguuuuguugcccauauugucggcauugcuccgcugacagagaaauacaccagcugcauuugucuauuugcaaaaagaggaagacggggucgaauguuaugcucgccgucuguaaacgcaugugcuuccgagcaacuaucgaggcgagccggcgugcucugcuaaucagaucaauuaucaacaccacauucgugauuuguauacugacccucacuaucugcguggucuccacaagugccguugaaauggagaaucugcccucuggcaccugggaaagggaggaggaucuuacaaacuuuugucaccaagaaugccaggugacugagaccgaauguuugugcccuuacgaggcacugguguuacgcaagccccucuuccuggacagcauuguaaaaggaaugaagaaucuucugaacuccacgucacuagagacaucucucagcaucgaagcccccuggggcgcuauuaauguccagaguaccuuuaaaccaacuguguccaccgccaacaucgcacugagcuggucuucaguugagcaccgggggaauaagauauuggugacaggaagauccgaaaguaucaugaagcuggaggaaaggacuggcgucagcugggauuuagguguggaggacgcuucggagucuaaacuccugaccguuuccauuauggaucuuagccaaauguauucaccuguguucgaauaccugaguggggaccgacagguagaggaauggcccaaggccacguguacaggagauugcccagagcgcuguggcugcaccucuuccacuugcuugcauaaagaauggccucacagccggaacuggagauguaaucccacauggugcuggggugucggcaccggguguacuugcuguggaguggacgugaaggaucucuuuacagaccauauguucgucaaauggaagguugaguacaucaagaccgaggcgauugugugcguagaacugacgucacaggagaggcaguguagucuaaucgaagccggcacucguuuuaaccuggggccagugaccauaacacuuagcgagccgcgcaacauucaacagaaacucccucccgaaaucaucacccugcacccaaaggucgaggagggauucuuugauuugaugcaugugcagaaaguucuguccgcuucuacagugugcaaguuacagagcuguacucacggcauucccggugaccuccaagucuaucacauagggaaucugcuuaaaggagaccgggugaacggccaucugauccacaagauugaaccucauuucaauaccuccuggaugucaugggaugguugcgacuuggauuacuauuguaacaugggcgacuggccaucuugcacguacacagggguuacucagcacaaucacgcagccuuugugaaccuccugaauaucgagaccgauuauacaaagaccuuccauuuucacaguaaaagagucacugcucauggagacacuccccagcuagaucugaaggccaggccuacauacggcgcaggggaaauuacgguacuuguggagguugcggacauggagcuccacacuaaaaagguggaaaucucgggacugaaauucgccagcuuggcuugcaccggcuguuaugccugcuccucugguauaucauguaagguccgaauccauguggaugagccggacgaauuaacaguacacgugaaaagcuccgauccagacgucguugcagcuaguaccucucugauggcccggaagcucgaguucgggacugauagcacauuuaaggcauucucagccaugcccaaaaccucccugugcuuuuacauuguggaacgcgaguacuguaagaguugcagcgaggaagacacgcagaaauguguggacacuaaacuugagcaaccucagucuauccugauugaacacaagggaacaaucauaggcaagcagaacgauaccugcaccgcuaaggcguccuguugguuggagucagucaagagcuucuuuuauggucuaaagaauaugcugggcucgguguucgggaacuuuuucauuggaauccuccuguuucuugcccccuucguuuuacugguacucuuuuucauguucggcuggaaaaucuuguuuugcuucaaguguugcagaaggacucgggggcugcucaaauaccgacugcuuaaggacgaugaagagacaggauauagacgcauuaucgagaggcugaauaacaagaaaggcaagaaucguuugcuagacggugaacggcuggcagauagaaaaauagcugagcucuuuucuaccaagacacauauuggguga

SEQ ID NO: 10324 - RNA, 5067 nt, Artificial Sequence
  derived and/or modified CDS sequence (opt3) from CCHFV(5180-R-2011)__KR814874.1__GP
augcccaccaacaucaugcacacacugcucgugugcuucauucuuuaccugcaguuguuaggccuggguggagcccauagacaaagcaaugcuacugagcacaacgguacgaauaccacaacugcaccuuccaccucucagucaccaaagccgcccgucaguacagccccuccauaugcgcccgaaagcuccaccauaaaaccuacuacaccagcuucugagaccgaaggcucgggggagacgacucccccuccaaacaccacacagggaccgucacccccugaagccacuccagagaggcccgcaaccacagccaccagcacgccuaguacugacaauacaaacuccaccacucaugcuacagauaauaacccaaccucuacgaucagcaccucccccucaaguagcccgucuacaccuuccacuccccagggcauucaccauccagcacggaaucuacucucaguuagcaguccuaagaccgccacaacucccaccccaacaucucccggugacaucuccagcgagaccucgucucugcacuccgcuaugucacgcacuccuacgcuucacacagccacccaagcgaguacugaaaacgcaaaucauagcgccccacgacaguccgagucuagcgcucagcagaccacaaccucaccgaugacuagccccgcccaaccuauucuggugauguccgcagcuccaacagccauccagaacauacaccccagcccuacgaaucguucuaaaagaaacuuggaaauggagaucauucucacccugucacaggggcugaagaaauacuauggaaagauccucaaguuacugcaucuuacuuuggaggaagauacagagggccugcuagaaugguguaaaaggaaucucggcaguaacugcgacgaugacuuuuuccagaagcggauugaggaauuuuucaugaccggggagggauacuuuaacgagguacugcaauucaaaacacuuagcacucuguccccaaccgaacccucucacgcgcgcccgccuacgguggagccauuuaagucguauuucgccaaaggguuuuugagcaucgauuccggcuacuucucagcaaaguguuaucccagacucaguaccucugggcugcaguuaauaaaugucacacagcacccugcuaggauugccgaaacucccggaccaaagaccacaagccugaaaacuaucaacugcauuaaucuccgggcuuccguguuuaaggagcaucgcgaaaucgagaucaacguucuucugccucaaauugccgugaauuugucaaacugucacgucgugauaaauagccauguaugcgacuacucucuagauaccgacggccccguucgacugccacacaucuaccaugaggguacguucauuccggggacauauaaaaucgugauagauaagaaaaacaagcucaaugacagauguacccuggucacuaacugcgugauuaaaggaagggaaauccggaagggccaguccgugcuucgucaguacaagacagagaucaaaauuggcaaggcaaguaccgggagccgcaaacuguugucugaggaaccuggagaugacuguaucuccagaacucagcuccugaggaccgaaacagccgagauucacgacgauaauuaugguggccccggggacaagauaacgaucugcaacggaucaaccauugucgaucaacgguuaggcagugagcuggguuguuacacuaucaaucgaguuaaaaguuuuaagcuaugcgaaaacucggcuacagggaagaccugcgagaucgacuccacaccagugaaaugucgccagggcuucugccucaagauuacucaggaaggaagaggccacguaaaacugucuagggggagcgaggugguccuugaugcgugugacaccucaugcgaggugaugauacccaagggaacgggugauaucuugguugacuguaguggcgggcagcaacauuuccugaaagauaaucucauugaccugggaugcccucacaucccacuucugggcaagauggcaauuuauaucugucggauguccaaccauccccgcacaaccauggccuuuuuguucugguuuucuuucgguuacgugauaacuugcaucuuuuguaaggcucucuucuauagccugauuaucauugggaccuuaggcaaaaagaucaaacaguacagagaacugaagccucagacaugcacuauaugugagaccgccccggucaacgcaauugaugccgaaaugcacgaccuaaauugcuccuacaacaucugcccauauugugcuucaaggcucacaagcgacggacuggcccgucacgugccccagugcccuaaacggaaggagaagguagaagagacggagcuuuacuugaaucuggaacgaaucccauggauuguuagaaaacuccugcaagugagugagucuaccggcgucgcauuaaagagguccagcuggcugauagugcuuuugguccuccugacugugucgcuaucacccguucagucugcgccuguggggcauggaaaaacaaucgaaaccuaucagacucgcgaggguuuuacaaguguaugucuguucaugcucggcuccauucuguuucuugucagcugcuuggugaaggggcugguugauucugugagcgacuccuucuuuccgggauuaucagucuguaaaaccugcaguaucggcagcauuaacgguuucgaaaucgagucucacaaguguuacugcucccucuuuuguugccccuauugucggcauugcucagcugauagagagauacaccagcugcaucuuaguauuugcaaaaagaggaagauggggagcaaugugaugcuggccguauguaaacgcaugugcuuccgagcaacgaucgaagccucccggcgugcuuugcucaucagaucuauuaucaacacuaccuucgugauuuguauacugacacuaaccaucugcguugucucgacuagcgccguggagauggaaaaucugccaucaggcacaugggagagggaagaggaccucaccaacuuuugucaccaagagugccaggugacagaaacugagugucugugcccuuacgaagcacuugucuugcgcaagccccuguucuuagauuccauuguuaaaggaaugaagaaucuccugaacaguaccucucuugagacgagccuguccaucgaggcuccauggggcgccauuaaugugcagucaacauuuaaaccuaccgugucuacugcgaacaucgcccuaagcuggaguuccguagaacaccgggggaauaagauacucgucaccggaagaagcgagucuaucaugaagcuggaagagaggacaggcgugucaugggacuuggguguugaagaugcuuccgagaguaaacuguuaacugugagcauuauggaccucucgcaaauguauucucccgucuucgaguaccuguccggggaucgacagguggaagaguggccaaaggcaaccuguacgggagacugcccggaacgcuguggcugcacaagcucaaccugccuucauaaagaguggccucacagucggaacuggagauguaaucccacuuggugcugggguguuggcacaggguguaccugcuguggaguggauguaaaggaccuguuuacugaucauauguucgucaaauggaagguggaauacaucaagacagaggccauugugugcgucgaguugaccucucaggaaaggcaguguucccucaucgaggcuggcacgcguuuuaaccuggggccaguuacuauaacccuaagcgaaccccgcaacauucaacagaaacugccuccagagaucaucacacuucaccccaagguggaagagggauucuuugaccucaugcauguacagaaagugcugucagccaguaccgucugcaaguugcagagcuguacacacggcauuccuggugaccugcaaguguaucacauagggaauuuacucaaaggagaucggguuaacggccaucugauccacaagauugagccgcauuucaauacuuccuggaugucuugggacgguugcgaucuugacuacuauuguaacaugggcgauuggccaagcugcaccuacacgggggugacacagcacaaucacgcagcguuugucaaccuguugaauaucgaaacugacuauaccaagacauuccauuuucacuccaaaagagugaccgcccauggagauacuccccagcucgaccugaaggcuaggccuaccuacggcgccggggagauuacaguucuaguggaagucgcagauauggagcugcacacgaaaaagguagagaucucaggacuuaaauucgcuucucucgccugcacuggcuguuaugcaugcaguucggguauaagcuguaaggugcgaauccauguugacgaacccgaugagcugaccgugcacgucaaauccaacgacccagaugugguagccgcuucuacaucauugauggcgcggaaguuagaauuugggaccgacagcacuuuuaaggccuucuccgcaaugccuaaaacaagucugugcuuuuacauuguggagcgcgaauacuguaagucuugcagcgaggaggacacccagaaaugugucgauacgaagcucgaacaaccccagucaauccugauugagcacaaaggaacuaucauaggcaagcagaaugacacaugcaccgcuaaggccuccuguuggcuugaaaguguuaagagcuucuuuuauggucugaaaaacauguugggcucuguguucgggaauuucuucauuggaauccuacuguuucucgccccauucgugcugcuugucuuauuuuucauguucggcuggaaaauccuguuuugcuucaaguguugcagaaggacccgggggcucuugaaauaccgacugcucaaggaugacgaggaaacuggauauagacgcauuaucgagaggcugaacaauaagaaaggcaagaaccgucuucuggauggugagcgguuggcugacagaaaaauagcagaacuauuuuccacaaagacccauauuggguga

SEQ ID NO: 10325 - RNA, 5067 nt, Artificial Sequence
  derived and/or modified CDS sequence (opt3) from CCHFV(5170-R-2011)__KR814873.1__GP
augcccuucaacaucaugcacacccugcucgugugcuuuauucuuuaccugcaguugagcggcuuagggggagcccauggucaauccaaugagacagaacacaacggcacuaauacgaccacagucccugggacuucucagucaccaaagccgcccgcuaguaccacacugcagcauaccccugagagcuccacuguuaaacuaacaaccccaacgucugaaacugagggaucgggcgaaaccacacccccuccaaacacuacccaggguuuacccccuccagggacaaccccggagagaucagcaacgacugccacaagcaccaguuccacugacaauaugaacucuacaacccaagugacggauaauacccccacaagcacuguauccauaucaccuaguagcucuccauccaugcccucaaccagccagggaauccacuauccuauuaggagucugcuuucuguguccagcccaaagacagucacuacccccacaccgaucucgccuggcgagaugucucccgaaaccuccucacagcauagugcgaugagccggauuccaacucuguacacggcuacacagguguccaccgagaacacuaaucgcucuaccccucgacaaagcgaaucaaguguucagcccgccacacaguccccaaucaccagccccgcacagacuauauugcucaugucugccgcuccuaaagcaauccaagacaugcacccaucaccgacaaaccguaguaagagaaaucuggagguggagauuauccugacgcucagccagggccucaaaaaguauuacgggaagauucugaaacuuuugcaccugacccuagaagaggauacugaaggacuccuggagugguguaagaggaaccuugguuccaauugcgacgaugacuucuuucagaaacggaucgaagaguucuuuauaacaggcgagggguauuucaacgaaguccugcaauuuaagaccuugucuacacucucgcccacugagcugagccaugugcgcuuaccuaccgccgaaccauucaaauccuacuuugcuaagggauuccugucaauugauaguggcuauuuuucugccaaguguuaccccagaagcuccacgucaggucuccagcuuaucaauguaacccagcacccugcgaggauugcagagacaccagggcccaaaacuaccagccugaagacaaucaacugcaucaacuugcgggccucuguuuucaaagaacaucgcgagguggagauuaauguccuacugccgcagauagcugugaaccucuccaauugucacguggucaucaacagucacguuugcgacuacagccuggauacugacggaccugugcgacuuccaaggauucaucacgaaggcaccuuuauccccggcacguauaagauaguaauugauaaaaagaauaaacugaacgacagauguucuuuggugacaaauugcgucaucaaggggcgggaggugcguaagggacaauccguucuccgccaguacaaaaccgaaaucaagauugguaaagccucaacuggcaguagaaagcuguuaagcgaggaaccuggggaugacuguaucucgaggacacagcugcuaaaaaccgagacugcagagauucaugacgauaacuauggaggccccggugacaagauaaccaucugcaauggguccacaauuguggaucagcggcucggcucugaacugggauguuacacgaucaaccgagucaagagcuucaaacuuugcgagaauagugcuaccggcaagacuugcgaaaucgacaguacaccagugaaaugucgccaaggguucugcuugaagauuacccaggagggaagaggucacguaaaacuguccaggggcucugagguugugcucgaugucugugacagcuccugcgaaauaaugaucccuaaggggacaggagauauucugguggacuguucaggcggucagcagcauuuucuuaaggauaaccugaucgacuuggggugcccccacauuccacuccugggcaaaauggccaucuauauaugucggaugagcaaucacccgcgcacuaccauggcguucuuauuuugguucaguuuuggauacgucaucacgugcauuuucuguaaggcccuguuuuauucucuaaucauuaucggcacacucgggaaaaagauaaaacaauacagagagcugaagccucagaccugcacuauuugugaaaccgcacccgugaacgcuaucgaugccgagaugcaugaccuuaauugcuccuacaacauuugcccauauugugcuagcagguugacaucggaaggacuggcccgucacguuacucagugccccaagcggaaagagaagguggaggaaaccgagcucuaccugaacuuagaacgaaucccuuggauaguaagaaaacugcuucaggucucagagucuacagguguggcauugaagaggaguuccuggcucaucguucugcuagugcugcucacggucagccugucuccagugcaaagcgcccccguaggccaugggaaaaccauugaaacuuaucagacacgcgagggauucaccuccaucugucuuuuuauguugggcucaauucuguucaucgugaguugcuuaguuaagggucucgucgacagcgugucugauuccuuuuucccugggcugucaguguguaaaacuugcaguauaggcagcauuaauggauuugagaucgaaucccacaaguguuacugcucucuuuucuguugcccguauugucggcacugcucggcugacagagagauccaucagcugcacuugagcauuugcaagaaaaggaagacaggcucaaacgucaugcucgcgguuuguaaacgcaugugcuucaaggcaaccaucgaagccucccgacgggcucugcuaauucguaguauaaucaauacgacuuuugugauuuguauccugacccucgccauuugcgugguaucuacaagcgcagucgagauggaagaucugccagccgggaccugggagagagaggaagaccuuacuaacuucugucaucaagagugccaggugacagaaaccgaguguuugugccccuacgaggcucugguuuuaaggaaaccucucuuucuggauuccaucgugaagggaaugaagaaucuucugaacucaacaucucuagaaacuagccucaguauagaggccccauggggcgcaaucaauguccaguccaccuucaaacccacggugagcacagcgaacauugcucugucuuggucauccguugaacaccgcgguaauaagaucuuggugaccgggcggagugagagcauuaugaaacuggaagagagaacuggaguaucgugggacuuaggcgucgaggaugccucugaauccaagcuccugaccgugagcaucauggaccuuucacagauguauaguccuguguuugaguaccugucuggugauaggcaagucgaagaguggccgaaagcaacauguacuggcgacugccccgaacgaugugggugcaccuccagcacgugcuugcauaaggaguggccacacucacgcaacuggcgguguaauccuacauggugcuggggaguuggcaccggguguacuugcuguggaguggauguaaaggaccucuucacagaucacauguuuauaaaauggaagguggaguacauuaaaaccgaagccaucgucugcguggagcugacuucacaggaaagacaguguagccuaaucgaggcuggcacaagguucaaccugggucccguuaccauuacgcuuuccgaaccacguaauauacagcaaaagcucccucccgagaucauuacucugcauccaaaaaucgaggaaggguuuuucgacuugaugcacgugcagaagguccugucugccagcaccgugugcaaguuacaguccuguacacauggcauuccgggagaccuccagaucuaucacauagguaaccugcuuaaaggcgaucgcguuaaugggcaucugauccacaagauugagccucacuuuaacaccucauggaugucuugggacggaugcgauuuggacuacuauuguaacaugggcgauuggcccaguugcacauacacuggggugacccaacauaaucacgcagcuuucgucaaccuccugaauaucgaaacggacuauacaaaaacuuuucauuuccacucgaagcggguaaccgcccacggagauacaccacagcuagaccugaaagcgagacccaccuacggcgccggugagauuacugugcuuguugagguggcugauauggaacuccauaccaagaaagucgagaucagcgggcugaaguucgcauccuugacaugcacgggauguuaugccuguucuucaggcauaagcugcaaggugaggauucacguagacgaaccugaugaguuaacugugcaugucaaauccagugacccagauguuguggcugccucuaccagccugauggcacgaaagcucgaauuugguacagacucaaccuucaaagcguuuuccgccaugcccaagacaagucugugcuucuacaucguggagcgggaguacuguaaaagcugcucugaagacgauacuaagaagugugucgacaccaaacuugagcagccucaauccauccugauugaacacaagggcacgaucauagggaaacagaacgauacuugcacagcuaaggccucauguugguuggagagcgugaaaucguuuuucuauggacuaaagaauaugcugggcucuguuuuugggaguuucuuuguaggcauucuccuguuccuugcaccguuuguguuacugguccucuucuucauguuuggauggaagaucuuguucugcuuuaaauguugccgcagaaccaggggucuguucaaguaccggcaucucaaagacgaugaagagaccggguaucgaagaauuaucgagcgccugaacuccaagaaaggaaagaauaggcuucuggacggcgaacguuuggcugaucggaagauagccgagcuauuuagcacuaaaacacacauuggcuga

SEQ ID NO: 10326 - RNA, 5067 nt, Artificial Sequence
  derived and/or modified CDS sequence (opt3) from CCHFV(4701-ST-2009)__KR814872.1__GP
augcccaucaacauuaugcacacccugcucgugugcuucauacuuuaccugcaguugagcggcuuagggggagcccauggucaauccaaugcuacagagcacaacggcacuaauacgaccacagcaccugggacuucucagucaccaaagccgcccgccaguaccacacugccucauaccccagaaagcuccacugucaaacuaacaacccccacgucugagacugaaggaucgggcgagaccacaccuccacccaacacuacccagggucucccucugacagggaccacgccagaaagaucagcgacuacagcuaccagcacuagcuccacagacaauaugaacucuaccacgcagguuaccgauaauacaccgacuagcaccguguccaucucacccaguaguucuuccucaaugccuagcacaccacaaggaacucaccaucccguaaggagucuucugucuguguccagcccuaagaccgucacaaccccaacucccaugucgccgggcgagaugucuccugagacguccucacagcacagugccaugagccgggugcccacauuguauaccgcaacucagguuuccaccgaaaacacagaccgcucuaccccacgacagagcgagucaagugugcaaccugccacucagucccccauuacaagcccagcucagacgauccuccugaugucugcagcccccaaagcuauucaggauaugcacccuucaccaaccaaucguaguaagagaaaccuggaagucgagaucauacucacuuuaagccaaggccugaaaaaguacuaugggaagauccuuaaauugcugcaucuaacacucgaggaagacaccgagggacugcuugaaugguguaagaggaaucuggguuccaacugcgaugacgacuuuuuccagaaacggauugaggaauuuuucaucacaggcgagggguacuuuaaugagguguugcaguucaagacucucucuacccugucgccgacggaacccagccacguacgcuuaccuaccgccgagccauuuaaauccuauuucgcgaagggauuucugucaauugauaguggcuacuucucugcaaaguguuaucccagaagcuccacaucaggucuccaacuuaucaacguuacucagcauccugccaggauagcugaaaccccagggcccaaaacaacuagccugaagaccauuaauugcaucaacuugcgggccucuguguuuaaagagcaccgcgaagucgagauuaacgugcuacugccgcagaucgcagugaaucucuccaacugucacgucguuaucaauagucaugugugcgauuacagccuggacacggauggaccuguacgacuuccaagaauccaccaugagggcacauucauacccggcaccuacaagaucgugauugacaggaaaaacaagcugaaugaucgguguucuuuggucacuaacugcgugaucaaagggcgugaaguucgcaagggacaguccgugcucagacaauauaagacagagauaaaaauugguaaggcuucaaccggcaguaggaaacuguuaagcgaggaaccuggggacgacuguaucucgcggacucagcugcuaaagaccgaaacagccgagauccacgaugacaauuacggaggccccggugauaaaauuacgaucugcaacggguccaccgucguggaccagcgacucggcucugagcugggauguuauacuauuaaucgcguaaagagcuuuaagcugugcgaaaacucagcgacaggcaaaaccugcgagauagauaguacaccaguuaaguguagacagggguucugcuugaaaaucacucaagaaggaaggggucaugugaagcugucccggggcucugaggucgugcucgacgccugugauagcuccugcgagauuaugaucccuaaagggaccggagacauccuggucgauuguucaggcggucagcagcacuuccuuaaggacaaucugauugauuuggggugcccccacauaccacuccugggcaagauggcaaucuacauuugucgcaugagcaaccauccgagaacgacaauggcuuuucuuuucugguuuaguuucggauaugugauuaccugcaucuuuuguaaagcccuguucuacucucuaauuauaaucggcacucucgggaagaaaauuaagcaguauagggaacugaaaccucaaaccugcacaaucugugagacugcucccguuaaugccauugacgcagaaaugcacgaccuuaacugcuccuacaauaucugcccauacugugccagccguuugaccucggauggacuggcucggcaugugacacagugccccaagcgaaaggagaaaguagaagagacggagcucuaucugaacuuagaaagaauaccuuggauugucaggaagcugcuucaggugucagagucuaccgguguugcguugaaacgcaguuccuggcucaucgugcugcuaguccugcucacugugagccugucuccaguacagagcgcacccgugggccacgggaagacaauugaaaccuaccaaacucgggagggauuuacauccaucugucuuuucauguugggcucaauacuguuuaucguuaguugcuuagucaaaggucucguggacagcgugucugauuccuucuuuccugggcugucagucuguaagaccugcaguauuggcagcaucaacggauucgaaauugagucccacaaauguuauugcucuuuauuuuguugcccguacuguagacauugcucggccgacagggagauccaccagcugcauuugagcauaugcaagaagcgcaaaacgggcucaaauguuaugcucgcuguguguaagcgaaugugcuucaaagccacuauugaagcaucccggcgugcccugcuaaucagaaguaucauuaacaccacauucgugauguguauccugacccucgcuauuugcguagucucuacuagcgccguggagauggaagaucugccagcagggacaugggagagggaagaggaccuuaccaauuuuugucaccaggagugccaaguuacagaaacugaguguuugugccccuaugaagcgcugguguuacgcaagccucucuuccuggauuccauagucaaaggaaugaagaaccuucuuaauucaaccucucuagagacgagccucaguaucgaggcuccauggggcgccauuaacgugcaguccacauuuaagcccaccguuagcacugcaaauaucgcccugucuuggucauccguggaacaucgggguaacaaaauuuugguaaccgggagaagugagagcaucaugaagcuggaagagaggacaggagucucgugggacuuaggcguggaagaugcuucugaguccaaacuccugacugugagcauaauggaccuuucacagauguacaguccugucuucgaguaucugucuggugaucgacagguugaagaguggccgaaggccaccuguacgggcgacugccccgaacgcugugggugcacauccucaaccugcuugcacaaagaguggccacacagccggaauuggagauguaacccuacuuggugcuggggagugggcacaggguguaccugcuguggaguagaugugaaggaccucuuuacugaccauauguucaucaaguggaaagucgaauacauuaagacagaggcaaucgugugcguugagcugaccagucaagaaaggcaguguagccuaauugaggcuggcacgcguuuuaaucugggucccgugacuaucacccuuuccgaaccacgcaacauacagcagaaacucccucccgagauuaucacacugcacccaaagaucgaagagggguucuuugauuugaugcauguccaaaaagugcugucugccagcaccguuugcaaguuacaguccuguacacacggcauuccgggagaccuccagauauaccauaucgguaaucugcuuaagggcgaucgggugaacgggcaccugauucacaaaaucgagccucauuucaauacuucauggaugucuugggacggaugcgauuuggacuauuacuguaacaugggcgauuggcccaguugcaccuauacgggggucacacagcacaaccaugcggccuuuguaaaucuccugaacauugaaacugacuacaccaagacauuccacuuucacucgaaaagagugaccgcucauggagauacuccacaacuagaccugaaggcaaggcccaccuauggcgccggugagaucacaguucuuguggaagucgcugauauggagcuccacacgaaaaagguggagauaagcgggcugaaauucgccuccuugacuugcaccggauguuacgcauguucuucaggcaucagcugcaagguacggauucauguggacgaaccugaugaguuaacaguccacguuaaguccagugacccagacgugguggcggccucuaccagccugauggcucgaaaacucgaguucgguacugauucaacauuuaaggccuucuccgcaaugcccaaaaccagucugugcuuuuauaucgucgaacgcgaauacuguaagagcugcucugaggacgauacgaaaaaguguguggacacuaaacuugagcagccucaguccauucugaucgaacauaaaggcacaauaauugggaagcaaaaugauaccugcaccgcuaaagccucauguugguuggagagcguuaagucguucuuuuacggacuaaagaacaugcugggcucuguauucgggggauuuuucgugggcauccuccuguuucuugcaccguucgucuuacuggugcucuuuuucauguucgguuggaagaucuuguuuugcuucaaguguugcagaaggacucgggggcuguuuaaauaucgacaccucaaggacgaugaagagacaggauacagacgcauuaucgaaaggcugaauaguaaaaagggcaaaaaccgucuucuggacggcgagcgguuggccgauagaaagauagcugagcuauucuccaccaagacacacauuggguga

SEQ ID NO: 10327 - RNA, 5067 nt, Artificial Sequence
  derived and/or modified CDS sequence (opt3) from CCHFV(4574-ST-2008)__KR814870.1__GP
augcccaccaacaucaugcacacacugcucgugugcuucauucuuuaccugcaguuguuaggcccugggggagcccauggucaaccaaaugcuacugagcacaacagaacgaauaccacaacugcaccgagcaccucccagucucccaagccuccagucucaacagcgcccccucaugcccuggagaguccaaccauaaaaagcacuacacccaccuccgagacggaaggcucuggggagacuaccucgccuccaaacacaacucagggaccgucacuacccgaaaccacaccuaagaggccagcuaccacggccacuagcacacccaguaccgacaauacuaacuccacaacccacguuacggauaauaacccuaccucuacaaucagcacuuccccaucaaguagccccucuaccccguccacaccucggggcauucaucaccccgcacgcaaucuccugucagugagcaguccaaaaacugccaccacaccuacccccacuucuccaggugagaucuccagcgagacgucgucucuucacuccgcuaugucacgaacaaguacccuguauacugcaacccaggccagcacagaaaacgcuaaucauuccgcgccccgucaaucugagagcccugcccagccaaccacuacaucauugaugacgaguccggcacaguccauucucguaaugagcgccgcucccaccgccauccagaacauacacccuucuccaacuaauagaucaaagaggaaccuggaaauggagaucauucugacacucagucaagggcugaaaaaguacuauggaaagauccugaaacuuuugcaucugacccuagaggaagacacagagggccuccuggaaugguguaagcggaaucuuggcagcaacugcgaggaugacuuuuuccagaaacgcauugaagaguuuuucaugacuggggagggauacuuuaacgaagugcugcaguucaagaccuuguccacgcucucucccaccgagccuucgcacgcaagaccacccacagucgaaccguuuaaaagcuauuucgcuaaggguuuucuguccaucgauucaggcuacuucagugccaaguguuauccuaggucuagcacuuccggguuacagcugauaaaugugacccaacacccagcgcggauugccgagacacccggaccuaaaacuaccucacucaagacgaucaacugcauuaaucuucgcgcaagcguuuuuaaagaacaucgagagaucgagaucaacgugcuguugccccagauugcugucaaucuaucuaacugucacgugguaauaaauucccauguuugcgacuacagucuggauacagacggcccagugagacucccucacaucuaccaugaagguaccuucauucccgggacuuauaagaucgucauagauaaaaagaacaaacugaaugacagguguacacuugugaccaacugcgugauuaagggacgggagguccguaagggccagagcguucugcgccaauacaaaacugaaaucaagaucggcaaagugucuaccggguccagaaaguugcucucagaggaaaguggagaugacuguauuagcaggacacagcuguuacggacggagaccgccgagauccacgaugacaauuaugguggcccaggggacaaaauuacuauaugcaacggaucgacaaucguagaucagcgacugggcuccgaacuagguuguuacaccauuaaucgcgugaagucuuuuaagcucugcgagaacagcgcuacagggaaaacuugcgaaaucgacucaaccccggucaaguguagacagggcuucugccugaaaaucacgcaagagggaaggggccacgugaaacuuagucggggguccgagguuguguuggaugccugugacucuagcugcgaagucaugauuccuaaaggaacaggugauauacugguggacuguuccggcgggcagcagcauuuccucaaggauaaucugaucgaccuuggaugcccccacauuccacuguugggcaagauggcaaucuauauuugucgcaugucaaaccaucccagaaccacuauggccuuucucuucugguuuagcuucgguuacguaauaaccugccuguuuuguaaggcuuuauucuauagucugaucaucauugggacacuaggcaagaaaaucaagcaguacagggagcuccguccucaaacuugcaccauuugugaaacagcgccaguuaacgcaaucgaugccgagaugcacgaccugaauugcucuuacaacauaugccccuauugugcuucccggcuuacgagcgauggauuggcccgacacgugccucagugcccgaaaagaaaggaaaaggucgaggagaccgaacuguaccucaaucuggagaggauuccauggaucgugcgcaaauuacugcaggucucggaaucaacuggcguggcacuuaagcggucuaguugguugauuguucuccuggugcuacugacaguaucccucagccccguccagucugccccuguggggcauggaaaaaccaucgagacuuaucaaacaagagaagguuuuaccagcauaugucuguucaugcuuggcuccaucuuguuucugguuucaugcuuagugaaggggcucgucgacagugugagcgacucuuucuuuccaggacuguccguauguaaaacgugcucaauuggcaguaucaacgguuucgagauugagagccacaaguguuacugcucccuucuguguugccccuauuguaggcauugcucugcugaucgcgaaauccaccaguugcaucucucgauaugcaaaaagcgaaagacugggagcaaugugaugcuggccguuuguaaacggaugugcuuucgugcaaccauugaggcgucaagaagggcucuacugauccgcuccaucauuaacacaaccuucgucaucuguauucucacucugacaauaugcguggugaguaccucugccgucgaaauggagaaucuuccuagcggcacaugggaaaaggaggaggacuugacuaacuucugucaccaggaaugccagguuaccgagacggaaugucugugcccguacgaggcauuagugcuccggaaaccccuguuucuugauuccaucgugaagggaaugaaaaaucugcuaaacucaacaucucucgagaccagccugaguauugaagccccauggggcgcuaucaauguacaauccacuuucaagccuaccgucagcacagccaacauugcauugucuuggucauccguggagcacagagggaauaagauccugguuacuggaaggagugaaagcauaaugaaauuagaggaacgaaccggcgugucgugggaccucggugucgaggaugcuucugaguccaagcugcuuacggugagcaucauggaccugucacagauguauagucccguuuuugaauacuugucuggggaucgccagguggaggaauggccaaaagccacauguaccggagacugcccugagcgguguggcugcacuuccagcacaugccuccauaaggaauggccccacucaagaaacuggagguguaauccaaccuggugcugggguguaggcacuggguguacaugcuguggagucgaugugaaagaccuguucaccgaucauauguuugugaaguggaaggucgaguacauuaaaacggaggcgaucguuugcguggaacuaaccagucaagagcgucaguguagccugauugaagccggcacucgcuucaaccuugggccgguaacaaucacccucuccgagccucggaacauacagcagaagcugcccccagaaauuaucacauugcaccccaaaguggaggagggauuuuucgaccugaugcauguccaaaagguguuaucugcuagcacuguuugcaaacuccaguccuguacccacggcaucccuggugauuuacagguguaucacauugggaaucuucugaagggagacagagucaacggccauuugauacacaagaucgaaccacauuuuaauacgucauggaugucuugggacgguugcgaucucgacuacuauuguaacaugggcgauuggcccaguugcacauacacuggggugacccagcacaaucacgcagccuucguuaaccugcuaaauauugagacagacuauaccaaaacuuuucauuuccacucgaagagggugaccgcucauggagauacaccucaacuggaccuuaaagcccgaccgacguacggcgcaggggaaaucacuguccucguagagguggcggauauggagcugcacaccaagaaaguugaaauuagcggauugaaguuugccuccuuagcuugcacaggcuguuaugccuguucuucagguaucagcugcaaagugcggauacaugucgacgagccagaugaacugaccgugcacguaaaguccagugaccccgauguggucgcagcuucuacuagccucauggcccgcaagcuggaguucgggacagacucaaccuucaaagcauuuuccgccaugccuaagacgagucuuugcuucuacaucguugaaagagaguacuguaaaagcugcucugaggaagauacucagaaguguguggacacaaaacuggagcagccccaguccauuuugaucgaacacaagggaaccauuaucggcaagcaaaacgauaccugcacugcuaaagcgucauguuggcuagagagcgugaagucguuuuucuauggucugaaaaauaugcucggcucugucuuugggaacuucuuuauaggcauucugcuuuucuuagccccauuugugcugcucguuuuguucuuuauguucggauggaagauccuguucugcuuuaaauguugcaggcgggcacgagggcuccugaaguacagacaucuuaaggacgacgaagagacaggauaucgcaaaaucauugagaggcugaauaacaagaaaggcaagaaucguuugcuagauggugaacggcuggcugacagaaaaaucgccgaacucuucaguaccaagacacacauaggguga

SEQ ID NO: 10328 - RNA, 5067 nt, Artificial Sequence
  derived and/or modified CDS sequence (opt3) from CCHFV(4495-ST-2008)__KR814869.1__GP
augcccaccaacaucaugcacacacugcucgugugcuucauucuuuaccugcaguuguuaggcccugggggagcccauggucaaccaaaugcuacugagcacaacagaacgaauaccacaacugcaccgagcaccucccagucucccaagccuccagugucaacagcgcccccucaugcccuggaaaguccaaccauaaaaagcacuacacccaccuccgagacggaaggcucuggggagacuaccccuccaccgaacacaacucagggacccucgccuccagaaaccacacccgagaggccugcuaccacggccacuucaacaccaagcaccgacaauacuaacaguacaacccacguuacggauaauaaccccaccuccacaaucucuacuagcccguccucaaguccuagcacccccucuacaccacggggcauucaucacccugcacgcaaucuacucuccgugucaagccccaagacugccaccacaccaacccccacaaguccuggugagaucucuuccgaaacgagcucgcugcacucugcuaugucccgaacaucaacccuuuauacugcaacccaggccaguacagagaacgcuaaucauagcaccccacgucaauccgaaucuccggcccagcccacuacaacgagccugaugaccuccccugcgcagaguauuuugguaauguccgcagccccaacugcuauccagaacauacaccccagcccuacaaauagaucuaaaaggaaccucgagauggagaucauucugacccugucacaagggcucaagaaauacuauggaaagaucuuaaagcugcuucauuugacacuggaagaggacacugaaggccuacucgagugguguaaacggaaucugggcaguaacugcgaugacgacuuuuuccagaagcgcauugaagaguuuuucaugaccggggagggauacuuuaacgaagugcuucaguucaaaacgcugagcaccuuguccccaacagagcccucucacgccagaccgccuacugucgaaccauuuaagucguauuucgcaaaagguuuucucagcaucgauuccggcuacuucucagcuaaguguuaucccaggaguucuaccagcgggcugcaguuaauaaaugugacacaacacccugcccggauugcggagacucccggaccaaagaccacgucccugaaaacaaucaacugcauuaaucuccgcgccucaguuuuuaaggaacaucgagagaucgagaucaacgugcuucugccucagauugcagucaauuugagcaacugucacgugguaauaaauucucauguuugcgauuacucccuagacaccgauggccccgugagacugccacacaucuaccaugaagguacuuucauuccggggacauauaaaaucgucauagacaagaaaaacaagcucaaugauagguguacccuggugacuaacugcgugauuaaaggacgggagguccguaagggccagaguguucuucgccaauacaagaccgaaaucaaaaucggcaaggugagcacagggucuagaaaacuguuguccgaggaaucaggagacgauuguauuaguaggacgcagcuccugcggaccgagacugcugagauccacgacgacaauuaugguggcccuggggauaagauuacaauaugcaacggaagcaccaucguagaccagcgauuaggcucggaacuggguuguuacacaauuaaucgcgugaaauccuuuaagcuaugcgagaacucugccacugggaagaccugcgaaaucgauagcacgcccgucaaauguagacagggcuucugccucaagaucacacaagagggaaggggccacgugaaacugucacgggggagugagguugugcuugacgcuugugauuccucuugcgaagucaugauuccaaagggaaccggugacauauugguggauuguagcggcgggcagcagcauuuccugaaagacaaucucaucgaucugggaugcccccacauuccucuucugggcaagauggccaucuauauuugucgcauguccaaccauccaagaacuaccauggcauuuuuguucugguuuucauucgguuacguaaucacaugccucuuuuguaaggcccuguucuauagcuuaauaaucauugggacucugggcaaaaagaucaaacaguacagggagcuacguccccaaaccugcacaauuugugaaacggcuccuguuaacgcgaucgacgcagagaugcacgaucucaauugcaguuacaacauaugcccguauugugccucucggcugaccuccgacggacuugcucgacacgugccacagugccccaagagaaaagaaaaggucgaggagacugaauuguaccugaaucucgagaggauuccuuggaucgugcgcaagcuguuacaggucagcgaaucgacaggcguggcccugaaacggucaucuuggcuuauuguuuugcucgugcugcuaaccguaagucuguccccaguccagagcgcacccguggggcauggaaagacuaucgagacauaucaaaccagagaagguuuuacgucuauaugucucuucaugcugggcagcauccuauuuuugguuuccugccuggugaaaggguuagucgacucagugagugauagcuucuuuccuggacucucuguauguaagacuugcuccauuggcucaaucaacgguuucgagauugagagucacaaauguuacugcagccugcuuuguugcccguauuguaggcauugcuccgccgaccgcgaaauccaccagcugcauuugucuauaugcaagaaacgaaagaccgggucgaaugugaugcucgcuguuuguaagcggaugugcuuucgugccacaauugaggcaagcagaagggcgcugcuaauccgcucaaucauuaacaccacuuucgucaucuguauucugacacucaccauaugcgugguguccacaagugcugucgaaauggagaaucugcccucuggcacuugggaaaaagaggaggaucuuaccaacuucugucaccaggaaugccagguuacggagacagaauguuugugcccauacgaggcccugguguuacggaagccucucuuucuggacagcaucgugaaaggaaugaagaaucuucugaacuccaccucacuagagacuucucucagcauugaagcacccuggggcgccaucaauguacaaaguaccuucaaaccaacagucuccacugcuaacauugcccugagcuggucuucaguggagcacagagggaauaagaucuugguuaccggaagguccgaaaguauaaugaagcuggaggaacgaacgggcaucagcugggauuuagguguggaggacgcaucggagucuaaacuccugacagucuccauuauggaucuuagccagauguauucaccuguguuugaauaccugaguggggaccgccagguugaggaauggcccaaggcuaccuguacuggagauugcccagagcgguguggcugcacaucuucaaccugcuugcauaaagaauggccgcacagcagaaacuggagguguaauccuacuuggugcuggggugugggcacaggguguaccugcuguggaguagacgucaaggaucucuucacggaccauauguuugugaaauggaagguggaguacaucaagacugaggccauugucugcguugaacugaccucacaagagcgucaguguagucuaaucgaagcgggcacacgcuucaaccuggggcccgugaccauaacacuuagcgagccacggaacauucagcagaaacugcccccugaaaucaucacucuccacccaaagguagaggagggauuuuucgauuugaugcaugugcaaaaaguccuguccgccucuaccgugugcaaguuacagagcuguacgcacggcauucccggugaccuccagguuuaucacauagggaaucugcuuaaaggagacagagugaacggccaucugauccacaagauugaaccucauuuuaauacauccuggaugucaugggaugguugcgacuuggauuacuauuguaacaugggcgacuggccgucuugcacuuacaccggggucacacagcacaaucacgcugcauucgugaaccuccugaauaucgagaccgauuauacuaagaccuuucauuuccacaguaaaaggguuacagcccauggagacacgccacaacuagaucugaaggcucgacccacuuacggcgccggggaaauuaccgugcuugucgagguagcagacauggagcuccacacuaaaaagguggaaaucucgggacugaaauuugcgagcuuggccugcaccggcuguuaugcuugcuccucugguauaucauguaagguucggauccauguggaugagccugacgaauuaacuguccacgugaaaagcuccgaucccgacguaguggccgcaaguacaucucugauggcucgcaagcucgaguucgggaccgauagcacguucaaggccuuuucagcaaugccaaaaacuucccugugcuucuacauugucgaaagagaguacuguaagaguugcagcgaggaagacacacagagguguguugacaccaaacuugagcagccucagucuauccugauugaacacaagggaaccaucauaggcaaacaaaacgauacuugcacagccaaggcuuccuguugguuggagucagucaagagcuuuuucuauggucuuaaaaauaugcugggcucgguguuugggaacuucuuuauuggaauccuccuguuccuugcgcccuuuguguuacugguccucuucuuuauguucggcuggaagaucuuguucugcuuuaaauguugccggcgagccagagggcugcucaaguaccgccaucugaaagacgaugaagagaccggauauaggaagauuaucgagcgucuuaauaacaagaaaggcaagaaucggcuguuggacggugaaagacuagcagauaggaaaauagcugagcuguucucuacaaagacucacauuggguga

SEQ ID NO: 10329 - RNA, 5067 nt, Artificial Sequence
  derived and/or modified CDS sequence (opt3) from CCHFV(3809-ST-2007)__KR814867.1__GP
augcccaccaacaucaugcacacacugcucgugugcuucauucuuuaccugcaguuguuaggccucgggggagcccaaggucagagcaaugcuacugagcauaacgaaacgaauaccacaacugcaccuuccaccucucagucaccaaagccgcccgucaguacaaccccucuacacgcccucgagagcuccacuauaaaaccaacaacccccgcgagagaaacggagggcucuggggaaacuaccccuccacccaacacaacucagggaccuucgccaccggaggcuacccccgagaggccugccacaaccgcaacgucagccccaagcacugacaauacaaacaguaccacucauguuacagauaauaaccccaccuccacgaucucuaccagcccuuccucaaguccaagcacacccuuuacuccgcaaggcauucaccauccugcucggaaucugcuuucuguguccucacccaagaccgcaacaacuccaaccccuacaagccccggugaacugaguucugagaccuccagcuugcacucggccaucucucgcacuuccacgcucuauacagcuacccagguaucaacugaaaacgccaaucacagugcgccacgacagagcgaguccucugcacagcccaccacaaccagcccuaugacuucaccagcccaaaguauucuggugauguccgcugccccgacagcaauccagaacauacaucccagcccuacgaaucguucuaaaagaaaccuggagauggaaaucauucucaccuuaucacaggggcugaagaaauacuauggaaagauccuuaaguugcugcaccuaacucucgaggaagacacagagggccugcuugaaugguguaaaaggaaucugggcaguaacugcgaugacgauuucuuucagaagcggauugaggaguucuuuaugaccggggaaggauacuucaacgaggucuugcaauuuaaaacacucagcacucuguccccaaccgaacccucucaugcucgcccuccagccguggagcccuucaagucguauuuugcgaaagguuucuuaagcaucgacuccggcuacuuuucagccaaguguuauccgagaaguucuacgagcgggcugcagcucauaaauguuacccagcacccugcaaggauugcugaaacaccaggacccaagacuaccucccuuaaaacaaucaacugcauuaaucugcgggccucaguguucaaggagcaccgcgagaucgaaaucaacgucuugcuaccucaaauugcugugaaucugagcaacugucauguaguuauaaauucucacgugugcgauuacucccucgacacugauggccccguccgacugccacauaucuaccacgaggguaccuuuauuccugggacguauaaaaucgugauagacaagaaaaacaagcucaaugauagauguacacuggugaccaacugcgucauuaaaggaagggaaguucggaagggccagaguguguugcgucaguacaagacugagaucaaaaucggcaaggccagcacagggucucgcaaacuccuguccgaggaacccggagacgauuguauuucaagaacccaguuacugaggacugagaccgcagaaauccaugacgacaauuaugguggcccaggggauaagauuacaauaugcaacggaaguacgaucguagaccaacggcuaggcagcgagcucgguuguuacaccauuaaucgagugaaaucguucaagcugugcgaaaacuccgccacugggaagacaugcgagaucgauucuaccccggucaaaugucgccagggcuucugccuuaagaucacacaggagggaagaggccacgugaaauugagcagggggucagaaguugugcuggacgcuugugauaguuccugcgaggucaugauuccuaagggaacuggugacauacucguggauuguucuggcgggcagcaacacuuucugaaagacaaucuuaucgaucugggaugcccccauauuccauugcucggcaagauggcgaucuauauuugucggaugagcaaccacccccgcaccacgauggcauuccuguuuugguucuccuuugguuacguaaucacaugcauauucuguaaggccuuauuuuauucacugaucauuaucgggacccuaggcaaaaagauuaaacaguacagagaacucaagccucagacuugcaccaucugugagacagcuccaguuaacgccauagacgcagaaaugcaugaucugaauugcagcuacaacauuugccccuauugugccaguaggcuuacuucugacggauuggcucgucacgugccucagugcccgaaacggaaggagaaggucgaggaaaccgagcuguaccucaaucuggaacgaaucccauggauugugagaaaauuacugcaagucuccgagagcacaggcguggcccuuaagaggucgucaugguugaucguucuccuggugcuacugacgguaucucucagucccguccaguccgcaccuguggggcacggaaaaaccauagaaacuuaucagacacgcgaggguuucaccagcaucugucuguuuaugcuuggcucuauuuuguuccugguuagcugcuuagugaaggggcucgucgacuccgugucagauagcuuuuucccaggacugaguguauguaaaacuugcucuaucggcuccgugaacgguuuugagauugaaucacauaaguguuacugcagucuuuucuguugccccuauugucggcacugcagcgcggacagagagauccaucagcugcacuuguccguuugcaaaaagaggaagacagggucuaaugucaugcucgcuguguguaaacgcaugugcuuccgagccaccauagaagcaucgcggcgugcccugcuaauuagaagcaucaucaacacgacuuuugugauuuguauccugacccucacaauuugcgucguuucaaccuccgcuguggagauggaaaaucugccugccggcacuugggagagggaggaagaucuuacaaacuucugucaucaagagugccaggugaccgaaacagaguguuugugcccguacgaggcacugguauuacgcaagccccucuuucuggacaguauagucaaaggaaugaagaaucuucugaacucuacuagccuagaaaccucccucucaaucgaggcuccauggggcgccauuaaugugcagucuacguucaaaccuacaguuagcaccgcgaacaucgcccugaguugguccagcguggaacaccgggggaauaagauuuuggucacuggaagaucugagucaaucaugaagcuggaagagaggaccggcguguccugggauuuagguguugaggacgcuagugaaagcaaacuccugacagugucgauaauggaucuuucucaaauguauucccccguauuugaguaccugagcggggaccgacaggucgaagaguggccaaaggcaacuuguaccggagauugcccugaacgcuguggcugcacgucaaguacaugcuugcacaaagaguggccccauucucggaacuggagauguaauccaaccuggugcuggggugugggcacuggguguacaugcuguggaguggacgucaaggaucucuucaccgaccacauguuuguuaaauggaagguggaguacaucaagacugaagccauuguaugcguggagcugacaucccaggaaaggcaguguagccuaaucgaggcuggcacccguuucaaccuggggccggucacgauuacucuuucagaaccucgcaacauccaacagaaacugcccccagagauaauuacccugcaucccaagguggaggaaggauuuuucgauuugaugcacguucagaaagugcugagugccagcacagucugcaaguuacaguccuguacccauggcaucccuggugaccuccaaguguaucacaucgggaaucugcuuaaaggagaccggguuaacggccaccugauucauaagauagagccacacuuuaauacaucuuggaugagcugggaugguugcgacuuggauuacuauuguaacaugggcgacuggcccuccugcacuuacaccggggugacgcagcauaaucacgcagcguucgucaaccuccugaauaucgaaacagauuauacuaagaccuuucacuuccauucaaaaagaguaacagcccacggagacaccccucagcuagaucugaaggcuaggccgacuuacggcgccggggagauuaccgugcuuguugagguggcagacauggaacuccauacaaagaaggucgagaucucuggacugaaauucgcuaguuuggccugcacgggcuguuaugcaugcucgagcgguauuuccuguaaggugcgaauccacguagaugaaccagacgaguuaacugugcaugucaaaucuucagaucccgacguuguggccgcuagcaccucccugauggcgcggaagcucgaauuugggacagauaguaccuucaaggccuuuucugcaaugccuaaaacuagccugugcuucuacauaguggagaaggaguacugucgcucaugcuccgaagaggacacacagaaaugugucgacaccaaacuugaacaaccccagaguauccugauugagcacaaaggaacgaucauuggcaagcagaacgauacuugcacagcuaaggccagcuguugguuggaaucugugaaauccuuuuucuauggucuaaagaauaugcugggcucaguuuuugggaacuucuuuaucggaauacuccuguuccuuaccccauuuguauuacuggugcuuuucuucauguuuggcuggaaaauuuuguucugcuuuaaguguugcagaaggacccgggggcugcucaaauaccgacaccugaaggacgaugaggagacuggauauagacgcaucaucgaaaggcuuaauaacaagaaaggcaagaaucgucuguuggacggugagcggcuagccgauagaaaaauugcugaacuguucagcacaaagacccauaucggguga

SEQ ID NO: 10330 - RNA, 5067 nt, Artificial Sequence
  derived and/or modified CDS sequence (opt3) from CCHFV(3756-ST-2007)__KR814866.1__GP
augcccaucaacauuaugcacacccugcucgugugcuucauacuuuaccugcaguugagcggcuuagggggagcccauggucaauccaaugcuacagagcacaacagaacuaauacgaccacagucccuggcacuucucagucaccaaagccgcccgcaaguaccacacugccucauaccccagaaagcuccacuguuaaacuaacaacccccacgucugagacugaagggucgggagagaccacaccuccacccaacacuacccagggccucccucugccagguacaaccccggaaaggucagccacgacugcgacaagcaccaguuccacugacaauaugaacacaaccacacaggugaccgauaauacacccacuucuaccguaagcaucuccccuucaaguagcccaucuaugcccuccacaucacaagggauucacuauccugugcggagccuucugagugucucuuccccaaagacugugaccacacccaccccgaugagcccuggagagaugucgcccgagacuucuucccagcauucagcuaugagucgcaucccaacguuguacacagccacccagguuagcacugaaaacauuaaucgauccaccccucgucagucugagagcucagugcaacccgcaacacagaguccaaucaccucccccgcccagacuauacuccugaugagcgcugcaccuaaagccauccaggacaugcacccaucuccgacaaacagaucaaagaggaaucuggaagucgagauuauccucacguuaagucaaggccugaaaaaguauuacggcaagauucuuaaauugcugcaccuaacccucgaggaagauacugaggggcugcuugaaugguguaagcggaaccugggaagcaauugcgacgaugacuuuuuccagaaacgcaucgaggaauuuuucauaacaggugagggcuauuuuaacgagguguugcaguucaagacccucuccacacugucucccacugaaccuucgcauguaagauuaccaaccgcugagcccuuuaaaagcuacuucgccaagggguuucuguccauugauucaggauauuucagugcgaaguguuacccuaggucuagcacguccggccuccaacuuaucaauguuacccagcacccagcacggauugccgaaacacccgguccgaaaacuaccucacugaagacaaucaacugcaucaacuugcgcgcuagcguguuuaaagagcaucgagaagucgagauuaaugugcuacugccucagauagccgugaaccucucuaauugucacgucguuaucaacucccacgugugcgacuacagucuggauacugacgggccaguaagacuucccaggauucaucacgagggaaccuucaucccuggcacguauaagauagugauugaucggaaaaauaagcugaacgaccguuguagcuuggucacaaauugcgugaucaaaggccgcgaaguuagaaaggggcagucugugcucaggcaauacaagaccgagaucaaaauuggaaaggcauccacugguucacggaaacuguuaagugaggaacccggcgaugacuguaucagccgaacacagcugcuaaagaccgaaacugcugagauucaugacgauaacuaugggggaccaggcgacaaaauaaccaucugcaaugguucgacaauugucgaucagcgccucggguccgagcugggcuguuacacgaucaacagagugaagucuuuuaaacuuugcgaaaauagcgccaccggaaaaacuugcgagaucgacucaacaccuguaaaguguaggcagggcuucugcuugaaaauuacccaagaagggcggggacacguuaagcugagucgcgguuccgaggugguccucgaugcgugugacucuagcugcgagauaaugauccccaaaggcacaggggauauucugguggacuguuccggaggccagcagcauuuccuuaaggauaaccugaucgacuuggguugcccacacauuccgcuccuggggaagauggccaucuauauauguagaaugucaaaucacccuaggacuaccauggcauuuuuauucugguuuagcuucggcuacgucaucacgugcaucuuuuguaaagcucuguucuauagucuaauuauuaucggaacacucggcaagaaaauaaagcaguaccgugaacugaaaccccaaaccugcacuauuugugagaccgccccagugaacgcuaucgaugccgaaaugcaugaccuuaauugcucuuacaacauuugccccuauugugcaucccgguugacaagcgacgggcuggcccgacacguuacucagugcccuaagagaaaggagaaaguggaagagaccgagcucuaccugaacuuagaaaggaucccauggauaguacgcaagcugcuucaggucucggagucaacaggaguggcuuugaaacggucuaguuggcucaucguucugcuagugcugcucacggucucccugagccccgugcagucugcgccuguaggucauggcaagaccauugaaacuuaucaaacaagagagggguuuaccagcaucugucuuuucauguugggauccauucuguuuaucgugucaugcuuaguuaaaggccucgucgauagugugagcgacucuuucuuuccgggucuguccguguguaagacuugcucaauagggaguauuaauggcuucgaaaucgagagccacaaauguuacugcucccucuuuuguugcccauauuguaggcacugcucugcagaucgcgagauccaucagcugcacuugucgauuugcaagaagcgaaaaacaggaagcaacgucaugcucgccguuuguaagcggaugugcuucaaagcuaccaucgaagccucacguagagcacugcuaauuagguccauaaucaauacgacuuucgugauuuguauccugacccucgccauuugcgugguaaguacaucugcugucgagauggaagaccugcccgccggcaccugggagcgcgaagaggaucuuacuaacuuuugucaucaggagugccaagugacagaaaccgaguguuugugcccuuacgaagcacugguuuuacggaagccacucuuccuggacagcaucgugaaagggaugaagaaucuucugaacuccacaucacuagagacuucucucagcauagaggcgcccuggggagcuaucaauguccagaguaccuuuaagccuacgguguccacagccaacauugcacugagcuggucuucaguugaacacagaggcaauaaaaucuuggugaccgguagguccgagaguauuaugaagcuggaggaacgaacugggguaagcugggauuuaggagucgaagacgccucggagucuaaacuccugaccguguccaucauggaucuuagccagauguauucaccgguguucgaguaccugaguggcgaccgccaggucgaagaguggcccaaggcuacauguacuggugauugcccagaacgguguggcugcaccucuuccacgugcuugcauaaagaguggccucacagcagaaacuggagguguaaucccacauggugcuggggaguugggaccggcuguacuugcugugggguggacguaaaggaucucuuuacagaccacauguucauaaaguggaaaguggaauacauuaagaccgaggccaucgucugcguggagcugacuucacaagaacgucaguguagucuaaucgaggcaggaacacgcuuuaaccugggcccaguuaccauuacgcuuagcgaaccucggaauauacagcagaaacuucccccagagaucauuacucugcauccgaagaucgaagaggguuucuuugacuugaugcacgugcaaaaaguccuguccgcuucuaccgugugcaaguuacagagcuguacacaugggauuccuggagaucuccagaucuaucacauaggcaaccugcuuaagggugacagaguuaauggccaucugauccacaaaauugagccccacuucaacaccuccuggaugucaugggaugggugcgacuuggauuacuauuguaacaugggagacuggccaucuugcacauacacuggcgugacccagcauaaucacgccgcguuugucaaccuccugaauaucgaaacggauuauacaaagacuuuccauuuucacaguaaaaggguaaccgcccacggggacacaccccaacuagaucugaaggcucgaccuaccuacggagcaggcgagauuacugugcuuguugaaguggccgacauggagcuccauaccaaaaaggucgagaucucgggucugaaauucgcuagcuugacaugcacgggguguuaugccugcuccucuggaauaucauguaaggugcggauucacguagaugaaccagacgaguuaacugugcaugucaagagcuccgaucccgacguuguggcagcgaguaccucucugauggcccgcaaacucgaauuuggcacagacagcaccuuuaaggcuuucucagccaugccuaaaacuucccugugcuuuuacaucguggagagagaauacuguaagaguugcagcgaggaugacacgaaaaagugugucgauaccaaacuugagcagccgcagucuauccugauugaacacaaagguacgaucauaggcaagcaaaacgacacuugcacagcaaaggcuuccuguugguuggagucaguuaagagcuucuuuuaugggcuaaagaauaugcugggaucgguguucggcucuuucuucguagggauucuccuguuucuuaccccauucguguuacugguccucuuuuucauguucggauggaagaucuuguuuugcuucaaguguugcaggcggacccgaggccuguuuaaauacagacaucucaaggaugacgaagagacugguuaucgcaggauuaucgaacgucugaacaguaaaaaggggaaaaaucggcuucuggauggagagagauuggccgacaggaagauagcagagcuauucuccacaaagacccacauuggcuga

SEQ ID NO: 10331 - RNA, 5067 nt, Artificial Sequence
  derived and/or modified CDS sequence (opt3) from CCHFV(81-R-2014)__KR814865.1__GP
augcccaccaacaucaugcacacacugcucgugugcuucauucuuuaccugcaguuguuaggccuugggggagcccauggucaaagcaaugcuacugagcacaacggcacgaauaccacaacugucccuuccaccucucagucaccaaagccgcuaguuaguacaacacccccucaugcacucgaaagcuccacuauaaaaccaacaacccccacgucugagacugaagggucgggagagaccgccccucugccaaacacaacucaggggcccccuccaccggaaaccacacccgagagaccugcgaccacggugacuucaacaccaagcaccgacaauacuaacaguacaauccacguaaccgauaauaaccccacguccaccauuucuacaagcccuuccucaaguccaagcacucccucuaccccgcaggguauccaucacccugcuaggucccuucugucagugagcagucccaagacagccacuaccccaacaccuaccucucccggggagauuaauuccgaaacuagcucguugcacucugcaaugucccggacgccaacacuccauaccgccacucaagucucaaccgagaacgcuaaucacagugcaccccgccagagcgaauccucugcccagccuacaaccacuagccugaugacaucaccagcucagaguauccugcucauguccgccgcgccgacggcaauacaaaacacccaucccagcccuacuaaucgaucuaaacguaacuuagagauggagaucauucugacacuuucacagggauugaagaaauauuacggcaagauccugaagcuacuccaccugacccuugaagaggacacagaaggccuguuggagugguguaaaagaaaucucgggaguaacugcgaugacgacuuuuuccagaagaggauuggagaauuuuucaugacuggugagggcuauuuuaacgaggugcugcaguucaaaaccuuaagcacgcuguccccaaccgaacccucucacgcccggcucccuacaguugagccauuuaagucguacuucgcuaaaggguuucuuagcaucgauuccggauauuucucagccaaguguuacccccgcaguucuacuagcggccugcaauugauaaaugugacccagcauccggcaagaauugcugaaacaccugguccaaagacuaccucccuaaaaacgaucaacugcauuaaucugagggccucagucuuuaaggagcaccgggaaaucgagaucaacgugcuccugccccagauugcgguaaaucuuagcaacugucauguugugauaaauucucacgucugcgauuauucccuggacacagaugggccugugcgcuugccccauaucuaccacgagggaaccuucauuccaggcacuuacaaaaucgugauagacaagaaaaacaagcucaaugaucgauguacacuggucaccaacugcguuauuaaaggcagagaagugaggaaggggcaaaguguauuacggcaguauaagacugagaucaaaaucggaaaggccagcaccgguucucguaaacugcuauccgaggaaccuggcgacgauuguauuucacgcacacagcuccugagaacggaaaccgcagagauccacgacgacaauuacgggggacccggcgauaagauuacuauaugcaacgguaguacaaucguggaccagaggcuugggagcgaguugggcuguuauaccauuaaucgggucaaaucguuuaagcugugcgaaaacuccgcuacaggaaagacuugcgagaucgauucuaccccagugaaaugucgacaaggcuucugccucaagaucacgcaggaagggcgcggacauguuaaacugagcagagguucagaggugguccuugacgccugugauaguuccugcgaggugaugauuccgaagggcacaggggacauacugguagauuguucuggaggccagcagcacuucuugaaagacaaucucaucgaucuggguugcccucauauucccuuacuggggaagauggcuaucuacauuuguaggaugagcaaccacccacggaccacuauggccuuucuauucugguuuuccuucggcuauguuauaaccugcaucuuuuguaaggcacucuucuacucacugaucauuaucggaacacuuggcaaaaagauuaaacaauaucgcgaauugaagccccagacuugcaccaucugugagacagccccugugaacgcuauagacgcggaaaugcacgaucugaauugcagcuacaacauuugcccauacugugcaaguagacucacgucugacgggcuggccaggcaugucccccagugcccuaaacguaaggagaagguggaagagaccgaguuauaucugaaucuugaacggaucccguggauuguccgaaaauugcuccagguguccgagagcacuggaguugcucugaagagaucgucauggcuaaucgugcugcucguacugcuuacagucucuuugaguccagugcaauccgcccccguuggucacggcaaaaccauagaaacuuaccagacaagggagggguuuaccagcaucugucuguucauguuaggaucuauucucuuucuggugagcugccuugucaagggccugguggacuccguaucagauaguuucuuuccugguuugagcguguguaaaacgugcucuaucggguccauuaacggcuucgaaaucgagucacauaaguguuauugcagucucuuuuguugcccauacugucgccacugcagcgcagaccgggagauacaucagcugcaccuauccauuugcaaaaagagaaagacuggaucuaauguuaugcuggccgucuguaaaaggaugugcuuccgcgcuaccaucgaagccucgcgacgggcacuccugauccguagcauuaucaacacaaccuucgugauuuguauacuuacuuugacaaucugcguggucucaaccuccgcgguugagauggaaaaucugcccgcuggcacaugggagagagaagaggauuuaacuaacuuuugucaccaggagugccaagugaccgaaacggagugucucugcccuuaugaagcccuggugcuuaggaagccgcuguuccuagacaguauuguaaaagggaugaagaaucuccugaacucuaccagcuuggagaccucccugucaaucgaggcacccuggggagccauuaauguccagucuacuuuuaaaccaaccgugagcacagcuaacaucgccuuaaguugguccagcguugaacaucgcggcaauaagauacucgugacuggucggucugagucaaucaugaagcuggaagagagaaccggggucuccugggaucuuggaguggaagacgcaagugagagcaaacuguugacgguuucgauuauggaucucucucagauguacuccccuguguucgaguaucugagcggcgacaggcaaguagaagaguggcccaaggcuacauguaccggugauugcccagaacgauguggcugcacuucaaguacaugccuacacaaagaguggccucauucucgcaacuggcgguguaaucccaccuggugcuggggcgucggaacuggcuguacaugcugugggguggacgugaaggaucuguuuaccgaccacauguucgucaaauggaagguugaauacaucaagacggaggccauugugugcguagagcuuacuucccaggaaagacaguguagccucaucgaggcgggaaccagguuuaaccugggcccagugacaauaaccuugucagaaccgcguaacauucagcaaaaacugccucccgagaucaucacauuacauccaaaggucgaagaggguuucuuugaucucaugcacgugcagaaaguucugagugccagcacugugugcaagcugcaguccuguacccacgggauucccggagaccugcaggucuaccauauaggcaauuugcucaaaggugaccgcaucaacggccaccugauucauaagaucgagccucacuucaauacgucuuggaugagcugggaugggugcgaccuagauuauuacuguaacaugggagacuggccauccugcacauauacuggcgugacccaacacaaucaugcugcauuuguuaaccugcuuaauauugaaacagauuacaccaagacuuuccacuuucauucaaaacgggugaccgcccacggggacacaccccagcucgaucugaaggcuagaccuacguauggagccggcgagaucacugucuugguagaaguggcagacauggaguuacauaccaaaaagguugagauaucuggucugaaauucgcgagucucgccugcacaggguguuacgcuugcucgagcggaaucuccuguaaggugaggauucacgucgaugaaccggacgagcugaccgugcacguaaaaucuucagauccagacguggucgccgcaagcacuucccuuauggcucgaaagcuggaguucggcacagauaguaccuuuaaggccuucucugcaaugcccaaaacgagcuugugcuuuuauaucguugaacgggaauacuguaagucaugcuccgaggaggacacucagaaauguguggacacacgccuagaacagccucaaaguauucugaucgagcauaaggguaccauaauuggcaaacagaacgauaccugcacugccaaggcuagcuguuggcucgaaucugugaaguccuucuuuuacgggcugaaaaauaugcuuggaucagucuucggcaacuuuuucaucgggaucuuacuguuucucgcgcccuucguguugcugguucucuuuuucauguucggauggaagauucuguuuugcuucaaauguugcagaaggacacggggccuucugaaguaucgacacuugaaagacgaugaggaaaccgguuacagacgcaucauagagaggcuaaauaacaagaaggggaaaaaucgucugcucgacggagagcgguuagccgauagaaagauugcagaacuguuuagcacaaaaacucauaucggcuga

SEQ ID NO: 10332 - RNA, 5067 nt, Artificial Sequence
  derived and/or modified CDS sequence (opt3) from CCHFV(75-ST-2010)__KR814864.1__GP
augcccaccaacaucaugcacacacugcucgugugcuucauucuuuaccugcaguuguuaggcccugggggagcccauggucaaccaaaugcuacugagcacaacagaacgaauaccacaacugcaccgagcaccucccagucucccaagccuccagucucaacagcgcccccucaugcccuggagaguccaaccauaaaaagcacuacacccaccuccgagacggaaggcucuggggagacuaccccuccaccgaacacaacucagggacccucgcuaccugaaaccacaccagagaggcccgcuaccacggccacuucaacaccuagcaccgacaauacuaacaguacaacccacguuacggauaauaacccaaccuccacaaucucuacuagccccuccucaaguccgagcaccccuucuacaccccggggcauucaucacccagcacgcaaucuccuguccgugucaagcccuaagacugccaccacacccaccccaacaagucccggugagaucucuuccgaaacgagcucgcuucacucugcuaugucccgaacaucaacccuguauacugcaacccaggccaguacagagaacgcuaaucauagcgccccucgucaauccgaaucuccagcgcagccgaccacuacuagcuugaugacgucacccgcacagaguauucucguaauguccgccgcuccuaccgccauccagaacauacacccaagccccacuaauagaucuaaaaggaaccuggagauggagaucauucugacacucucacaaggguuaaagaaauacuauggaaagauccugaagcuguugcaucugacccuagaagaggacacagaaggccuccuggagugguguaaacggaaucuuggcaguaacugcgaugacgacuuuuuccagaagcgcauugaagaguuuuucaugacuggggagggauacuuuaacgaagugcugcaguucaaaaccuugagcacgcucuccccuaccgagccaucucacgcaagacccccgacagucgaaccuuuuaagucguauuucgcuaaagguuuucugagcaucgauuccggcuacuucucagccaaguguuauccaaggaguucuacuagcggguuacagcugauaaaugugacccaacaccccgcgcggauugccgagacaccuggacccaagacuaccucccucaaaacgaucaacugcauuaaucuucgcgcaucaguuuuuaaggaacaucgagagaucgagaucaacgugcuguugccacagauugcugucaaucuaagcaacugucacgugguaauaaauucucauguuugcgauuacucccuggacacagauggcccugugagacucccccacaucuaccaugaagguaccuucauuccagggacuuauaaaaucgucauagacaagaaaaacaagcugaaugauagguguacacuugugaccaacugcgugauuaaaggacgggagguccguaagggccagaguguucugcgccaauacaagacugaaaucaaaaucggcaaggugagcaccgggucuagaaaauugcucuccgaggaaucaggagacgauuguauuaguaggacacagcuguuacggacggagaccgccgagauccacgacgacaauuaugguggcccgggggauaagauuacuauaugcaacggaagcacaaucguagaccagcgacugggcucggaacuagguuguuacaccauuaaucgcgugaaauccuuuaagcucugcgagaacucugcuacagggaagacuugcgaaaucgauagcaccccugucaaauguagacagggcuucugccugaagaucacgcaagagggaaggggccacgugaaacuuucacgggggagugagguuguguuggacgccugugauuccucuugcgaagucaugauucccaagggaacaggugacauacugguggauuguagcggcgggcagcagcauuuccucaaagacaaucugaucgaucuuggaugcccacacauuccccuguugggcaagauggcaaucuauauuugucgcauguccaaccauccuagaaccacuauggccuuucucuucugguuuucauucgguuacguaauuaccugccuguuuuguaaggcuuuauucuauagccugauaaucauugggacacuaggcaaaaagaucaaacaguacagggagcuccguccacaaacuugcaccauuugugaaacagcgcccguuaacgcaaucgacgccgagaugcacgaucugaauugcaguuacaacauaugcccuuauugugcuucucggcuuacguccgacggauuggcccgacacgugccgcagugcccaaagagaaaagaaaaggucgaggagaccgaacuguaccucaaucuggagaggauucccuggaucgugcgcaaguuacugcaggucagcgaaucgacuggcguggcacuuaaacggucaucuugguugauuguucuccuggugcuacugacaguaagucucuccccuguccagagcgccccaguggggcauggaaagaccaucgagacuuaucaaacaagagaagguuuuaccucuauaugucuguucaugcuuggcagcaucuuguuucugguuuccugcuuagugaaagggcucgucgacucagugagugauagcuucuuucccggacugucuguauguaagacgugcuccauuggcucaaucaacgguuucgagauugagagucacaaauguuacugcagccuucuguguugcccuuauuguaggcauugcuccgcugaccgcgaaauccaccaguugcaucucucuauaugcaagaaacgaaagacugggucgaaugugaugcuggccguuuguaagcggaugugcuuucgugcaaccauugaggcgagcagaagggcucuacugauccgcucaaucauuaacacaaccuucgucaucuguauucucacucugacaauaugcgugguguccaccagugccgucgaaauggagaaucuuccgucuggcacaugggaaaaagaggaggauuugacuaacuucugucaccaggaaugccagguuaccgagacggaaugucugugccccuacgaggcauuagugcuccggaagccacuguuucuugacagcaucgugaaaggaaugaagaaucugcuaaacuccacaucacucgagaccucucugagcauugaagccccuuggggcgcuaucaauguacaaaguacuuucaaacccaccgucuccacagccaacauugcauugagcuggucuucaguggagcacagagggaauaagauccugguuacuggaagguccgaaaguauaaugaaguuagaggaacgaaccggcgugagcugggaucucggugucgaggacgcuucggagucuaaacugcuuacgguguccaucauggaucugagccagauguauucaccaguuuuugaauacuugaguggggaccgccagguggaggaauggccuaaggccacauguaccggagauugccccgagcgguguggcugcacuucuuccacaugccuccauaaagaauggccacacagcagaaacuggagguguaauccgaccuggugcugggguguaggcacuggguguacaugcuguggagucgacgugaaggaucuguucaccgaccauauguuugugaaauggaaggucgaguacauuaagacggaggcgaucguuugcguggaacuaacuucacaagagcgucaguguagucugauugaagccggcacccgcuucaaccuugggccuguaacaaucacccucagcgagccccggaacauacagcagaaacugccacccgaaauuaucacauugcacccuaagguggaggagggauuuuucgaucugaugcauguccaaaaaguguuauccgcuucuacuguuugcaagcuccagagcuguacccacggcaucccaggugaccuucagguguaucacauugggaaucuucugaaaggagacagagucaacggccauuugauacacaagaucgaaccccauuuuaauacguccuggaugucaugggaugguugcgaccucgauuacuauuguaacaugggcgacuggccuucuugcacauacacuggggugacccagcacaaucacgcagccuucguuaaccugcuaaauauugagacagauuauaccaagacuuuucauuuccacaguaaaagggugaccgcucauggagacacaccgcaacuggaucuuaaggcccgaccaacguacggcgcaggggaaaucacuguccucguagagguggcggacauggagcugcacaccaaaaagguugaaauuucgggauugaaauuugccagcuuagcuugcacaggcuguuaugccugcuccucugguaucucauguaaggugcggauacaugucgaugagcccgacgaacugaccgugcacguaaaaagcuccgauccugacguggucgcagcuaguacuucucucauggcccgcaagcuggaguucgggacagauagcaccuucaaggcauuuucagccaugcccaaaacgucccuuugcuucuacaucguugaaagagaguacuguaagaguugcagcgaggaagacacucagaaauguguggacacaaagcuggagcagccacagucuauuuugaucgaacacaaaggaaccauuaucggcaagcaaaacgauaccugcacugcuaaggcguccuguuggcuagagucagugaaaucguuuuucuauggucugaagaauaugcucggcagcgucuuugggaacuucuuuauaggaauccugcuuuucuuagccccuuuugugcugcucguuuuguucuuuauguucggcuggaaaauccuguucugcuuuaaguguugcaggcgggcacgagggcuccugaaauacagacaucuuaaggacgaugaagagacaggauaucgcaagaucauugagaggcugaauaacaaaaagggcaaaaaucguuugcuagacggugaacggcuggcugauagaaagaucgccgaacucuucucuaccaaaacacacauaggguga

SEQ ID NO: 10333 - RNA, 5067 nt, Artificial Sequence
  derived and/or modified CDS sequence (opt3) from CCHFV(75-R-2012)__KR814863.1__GP
augcccaccaacaucaugcacacacugcucgugugcuucauucuuuaccugcaguuguuaggccuagggggagcccauagacaaagcaaugcuacuggucacaacggcacgaauaccacaacugcaccuuccaccucucagucaccaaagccgcuggucaguacagcucccccucaugcgcucgagagcuccauaaucaaacacaccacuccaguuucugaaacagaggggucgggagaaaccacgcccccuccaaacacuacccagggccccucaccucuggagacaacuccagaaaggccggcuaccacagccaccagcacgcccaguacugacaauacaaacuccaccacucaugugacagauaauaacccuaccucuacgauuagcaccuccccaucaaguagccccucuacaccuuccacuccacaggguauccaccaccccgcacggaaucuucugucaguaagcaguuugaagaccgccacaacuccgaccccuacaucucccggggagauuuccagcgagaccucgucucuccauuccgcuaugucacgcacuuccacgcuguauacagcaacccaagugagcacugaaaacgccaaucacuccgcuccacgacagucugagagcucagcccagcagaccacaaccaguccuaugacuucccccgcgcaaagcauccuggucaugucugcagccccaacagcuauacagaacacgcaucccucaccuaccaaucguaguaaaagaaaccucgaaauggagaucauuuuaacucugagccagggacuuaagaaauacuauggcaagaucuugaagcugcuacaccucacacuggaggaagacaccgagggccuucuggaaugguguaaaaggaauuugggguccaacugcgaugacgacuuuuuccagaagcggauugaggaauuuuucaugacaggagaggguuacuuuaacgaggugcuccaauucaaaacucugucuacccagucgccaacggaaccgagccacgccagacccccuaccguugagccauuuaaguccuauuucgcaaaaggcuuuuuaucaaucgauaguggguacuucucugcuaaguguuauccccgccugagcacauccggacuccagcuuauaaaugugacucaacauccugccaggauugcggaaaccccaggccccaagacaacuucacugaaaaccaucaacugcauuaauuugcgggccagcgucuuuaaggagcaccgcgaaaucgagaucaacgugcuacugccgcagauugcaguaaaucucucuaacugucauguugugauaaauucccacgucugcgauuacagucuggacacggaugguccugugcgacuuccacauaucuaccacgaggggacauucauucccggaaccuauaaaaucgugauagacaagaaaaacaagcugaaugauagauguacuuuggucacaaacugcguuauuaaaggcagggaagugcggaagggccagagcguacuccgucaguacaagaccgagaucaaaaucgggaaggcuucuacuggaucccgcaaacuguuaucagaggaaccuggugacgauuguauuaguagaacccaacugcuaaggacagaaacggccgagauccacgacgacaauuauggcgggcccggagauaagauuaccauaugcaacggcagcacuaucguggaccagcggcucgguucggagcugggguguuacacaauuaaucgagucaaauccuuuaaacuuugcgaaaacucugcuaccggcaagacaugcgagaucgauagcgccccagugaaaugucgccagggauucugcuugaagaucacucaggaaggcagagggcauguuaaacugucaaggggaagugaggugguccucgacgcaugugauuccucuugcgaggugaugauuccuaaggguaccggcgacauacugguagauuguagcgggggacaacagcacuuccuuaaagacaaucugaucgauuugggcugcccccauauuccacuccuggguaagauggccaucuauauuugucggauguccaaccacccgcgcacgacaauggccuuuuuauucugguuuucauucggguacguuauaaccugcaucuuuuguaaggcgcuguucuauagccuaaucauuaucggcacucucgggaaaaagauuaaacaguacagagaacugaagccucagaccugcacaaucugugagacugcacccgugaacgccauagacgcugaaaugcacgaucuuaauugcaguuacaacauuugcccauauugugccucuagguugaccuccgacggccuggcacgucaugucccccaaugcccuaaacggaaggagaagguggaagagacagagcucuaccugaauuuagaacgaaucccauggauugucagaaaacugcuucaggugagcgagucgacggggguugccuugaagaggucaucuuggcucaucgugcugcuaguacugcucaccgucagucugucccccgugcagagcgcuccuguuggacacgguaaaacuauagaaacauaucagacccgcgagggcuuuacuucuaucugucuuuucauguuggggagcauucuguuuuuaguguccugccucgucaagggacuggugaacucaguaagugacagcuucuuuccgggccuuucuguguguaaaacaugcuccaucgguucaauuaauggguucgaaaucgagagucauaaguguuacugcagccuguuuuguugcccauauugucggcacugcuccgccgauagagagauacaucaauugcaccucucuauuugcaaaaagaggaagaccggcucgaacguuaugcuggcagucuguaaacgcaugugcuuccgagcgacgaucgaagcuagccggcgugcccuacugaucagaucaauuaucaauacuaccuucgugauuuguauacucacacugaccaucugcguggucuccacaagugcaguugagauggaaaaccuucccucuggaacuugggagagggaagaggacuugaccaauuuuugucaccaggagugccaggugacagaaacugagugucugugcccuuacgaagccuuagugcuccgcaagccacuguuccuugauagcauuguaaaaggcaugaagaaccugcuaaauuccaccucacucgagacgucucugagcaucgaggcucccuggggagccauuaacguccaaaguacauuuaaaccuaccguguccacugcaaauaucgcuuugagcuggucuucaguugaacaucggggaaacaagauacuggugaccggcagauccgagaguaucaugaaguuagaagagaggacaggugucagcugggaccucgggguggaagaugccucggagucuaaacugcuuacuguuuccauuauggaccugagccagauguauucaccgguguucgaguacuugaguggagaucgacagguagaagaguggcccaaggcgaccuguacgggcgacugcccagaacgcugugguugcacaucuaguaccugccuccacaaagaguggccucauagccggaauuggagauguaaccccacuuggugcuggggcgucgggacaggauguaccugcuguggcguggaugugaaggaccuguuuacugaucacauguucgucaaauggaagguugaauacaucaagacagaggccauugugugcguagagcuaaccucacaggaaaggcaauguagucugaucgaggcugggacgcguuuuaaccuuggaccagugacuauaacccucagcgaaccucgcaauauucagcagaaacugcccccagagaucaucacauugcauccgaaggucgaagagggcuucuuugaccugaugcacgugcagaaaguuuuauccgcaucuaccgugugcaagcuccaaagcuguacacacgguauuccuggggaucugcaggucuaucauauaggaaaccuucugaaaggcgaccgggugaauggucacuugauccauaagauugagccccacuucaacacuuccuggaugucaugggacggcugcgaucucgacuacuauuguaauaugggggauuggccaucuugcaccuacacgggaguuacacagcacaaccaugccgcuuuugugaaucugcuaaacaucgaaacugacuauaccaagacauuccacuuucauaguaaaagagucaccgcccacggcgauacuccccagcuggaccuuaaggcaaggccuaccuacggggcgggagagauuacaguacucguggaaguugccgauauggagcugcauacgaaaaagguggagaucucgggcuugaaauucgcuagcuuagccugcacugguuguuaugcaugcuccucugggauaucauguaagguccgaauccacguggacgaaccagaugagcugaccguacacgugaaaagcuccgaccccgaugucguugcugccaguacaucucucauggcacggaagcuggaguucggaaccgacagcacuuuuaaggccuucucagcuaugccuaaaacaucccuuugcuuuuacauuguggaacgcgaauacuguaagaguugcagcgaggaggauacccaaaaauguguggacacgaagcuggaacagccgcagucuaucuugauugagcauaaaggcacuaucauagguaagcaaaaugacacaugcaccgcgaaggccuccuguuggcuagaaucagucaagagcuuccuguauggccucaagaacaugcuggggucgguguuuggaaauuucuuuauuggcauccuuuuauuccuggcaccauuuguucucuugguacuguucuuuauguucggguggaaaauccucuucugcuuuaaguguugcagaaggacccggggacugcuuaaauaccgacuguugaaggaugacgaggaaacuggcuauagacgcauuaucgagaggcuaaacaauaagaaagguaagaaccgucugcucgauggggagcgguuagcugacagaaaaauagccgaacuguucucuacaaagacccacauuggauga

SEQ ID NO: 10334 - RNA, 5067 nt, Artificial Sequence
  derived and/or modified CDS sequence (opt3) from CCHFV(52-R-2014)__KR814862.1__GP
augcccaccaacaucaugcacacacugcucgugugcuucauucuuuaccugcaguuguuaggccuggguggagcccauagacaaagcaaugcuacugagcacaacgguacgaauaccacaacugcaccuuccaccucucagucaccaaagccgcccgucaguacagccccuccacaugcgcccgaaagcuccaccauaaaaccuacuacaccagcuucugagaccgaaggcucgggggagacgacucccccuccaaacaccacacagggaccgucacccccugaagccacuccagagaggcccgcaaccacagccaccagcacgccuaguacugacaauacaaacuccaccacucacgcuacagauaauaacccaaccucuacgaucagcaccucccccucaaguagcccgucuacaccuuccacuccccagggcauucaucacccagcacggaaucuacucucaguuagcaguccuaagaccgccacaacucccaccccaacaucucccggugacaucuccagcgagaccucgucucugcacuccgcuaugucacgcacuccuacgcuucauacagccacccaagcgaguacugaaaacgcaaaucacagcgccccacgacaguccgagucuagcgcucagcagaccacaaccucaccgaugacuagccccgcccaaccuauucuggugauguccgcagcuccaacagccauccagaacauacaucccagcccuacgaaucguucuaaaagaaacuuggaaauggagaucauucucacccugucacaggggcugaagaaauauuacggaaagauccucaaguuacugcaccuuacuuuggaggaagauacagagggccugcuagaaugguguaaaaggaaucucggcaguaacugcgacgaugacuuuuuccagaagcggauugaggaauuuuucaugaccggggagggauauuuuaacgagguacugcaauucaaaacacuuagcacucuguccccaaccgaacccucucacgcgcgcccgccuacgguggagccauuuaagucguacuucgccaaaggguuuuugagcaucgauuccggcuauuucucagcaaaguguuaccccagacucaguaccucugggcugcaguuaauaaaugucacacagcauccugcuaggauugccgaaacucccggaccaaagaccacaagccugaaaacuaucaacugcauuaaucuccgggcuuccguguuuaaggagcaccgcgaaaucgagaucaacguucuucugccucaaauugccgugaauuugucaaacugucaugucgugauaaauagccacguaugcgacuauucucuagauaccgacggccccguucgacugccacauaucuaccacgaggguacguucauuccggggacauacaaaaucgugauagauaagaaaaacaagcucaaugacagauguacccuggucacuaacugcgugauuaaaggaagggaagugcggaagggccaguccguccuucgucaguauaagacagagaucaaaaucggcaaggcaaguaccgggagccgcaaacuguugucugaggaaccuggagaugacuguauuuccagaacucagcuccugaggaccgaaacagccgagauccacgacgauaauuacgguggccccggggacaagauuacgauaugcaacggaucaaccaucguugaucaacgguuaggcagugagcuggguuguuauacuauuaaucgagugaaaaguuuuaagcuaugcgaaaacucggcuacagggaagaccugcgagaucgacuccacaccaguaaaaugucgccagggcuucugccucaagaucacucaggaaggaagaggccaugugaaacugucuagggggagcgaggucgugcuugaugcgugugacaccucaugcgagguuaugauucccaagggaacgggugauauauugguggacuguaguggcgggcagcaacacuuccugaaagauaaucucaucgaccugggaugcccucaugucccacuucugggcaagauggcaauuuacaucugucggauguccaaccacccccgcacaaccauggccuuuuuguucugguuuucuuucgguuaugugauuacuugcaucuuuuguaaggcucucuucuacagccugauaaucauugggaccuuaggcaaaaagaucaaacaguauagagaacugaagccucagacaugcacuauuugugagaccgccccgguaaacgcaaucgaugccgaaaugcacgaccuaaauugcuccuacaacauaugcccauacugugcuucaaggcucacaagcgacggacuggcccgucauguuccccagugcccuaaacggaaggagaagguggaagagacggagcuuuauuugaaucuggaacgaaucccauggauugucagaaaacuccugcaagugagugagucuaccggcgucgcauuaaagagguccagcuggcugauugugcuuuugguucuccugacugugucgcuaucacccguacagucugcgccugucgggcacggaaaaacaaucgaaaccuaccagacucgcgaggguuuuacaagugugugucuguucaugcucggcuccauacuguuucuuguuagcugcuuggugaaggggcuggucgauucugugagcgacuccuucuuuccgggauuaucaguauguaaaaccugcaguaucggcagcauuaacgguuucgaaaucgagucucauaaguguuauugcucccucuuuuguugccccuacugucggcacugcucagcugauagagagauucaucagcugcaccuuaguaucugcaaaaagaggaagauggggagcaaugugaugcuggccguuuguaaacgcaugugcuuccgagcaacgauagaagccucccggcgugcuuugcucauuagaucuaucaucaacacuaccuucgucauuuguauccugacacuaaccauuugcguggugucgacuagcgccgucgagauggaaaaucugccaucaggcacaugggagagggaagaggaccucaccaacuuuugucaccaagagugccagguuacagaaacugagugucugugcccuuaugaagcacuuguguugcgcaagccccuguucuuagauuccauagugaaaggaaugaagaaucuccugaacaguaccucucuugagacgagccuguccaucgaggcuccauggggcgccauuaauguacagucaacauuuaaaccuaccgucucuacugcgaacaucgcccuaagcuggaguuccguggaacaucgggggaauaagauucucguuaccggaagaagcgagucuaucaugaagcuggaagagaggacaggcgugucaugggacuugggugucgaugacgcuuccgaaaguaaacuguuaacugugagcauaauggaucucucgcaaauguacucucccguuuucgaguaucuguccggggaccgacagguggaggaauggccaaaggcaaccuguacgggagauugcccggagcgcuguggcugcacaagcucaaccugccuucacaaagaauggccucauagucggaacuggagauguaaucccacuuggugcugggguguaggcacaggguguaccugcuguggagucgacgugaaggaucuguuuacugaccacauguucgugaaauggaaggucgaguacaucaagacagaagccauuguuugcguggaguugaccucucaggagaggcaguguucccucaucgaagcuggcacgcguuuuaaccuggggccaguaacuauuacccuaagcgagccccgcaacauccaacagaaacugccuccagaaauaauuacacuucaucccaagguggaggaaggauucuuugaccucaugcacguccagaaagugcugucagccaguaccguuugcaaguugcagagcuguacacacggcaucccuggugaucugcaaguguaccauaucgggaauuuacucaaaggagaccgggucaacggccaccugauucauaagauagagccgcacuucaauacuuccuggaugucuugggaugguugcgaccuugauuauuacuguaacaugggcgacuggccaagcugcaccuauacgggggugacacagcacaaucaugcagcguuuguuaaccuguugaauaucgagacugauuacaccaagacauuccacuuucauuccaaaagagugaccgcccacggagacacuccccagcucgaucugaaggcuaggccuaccuauggcgccggggaaauuacaguccuaguagagguggcagacauggaacugcauacgaaaaagguugagaucucaggacuuaaauucgcuucucucgccugcacuggcuguuacgcaugcaguucggguauuagcuguaaggugcgaauccacgucgaugagcccgacgaacugaccgugcacguaaaauccaacgauccagacguggucgccgcuucuacaucauugauggcgcggaaguuagaguucgggaccgacagcacuuuuaaggccuucuccgcaaugccuaaaacaagucugugcuuuuauauaguugaacgcgaguacuguaagucuugcagcgaagaggauacccagaaauguguggacacgaagcucgagcaaccccagucaauccugauugaacauaaaggaacuaucauuggcaagcagaaugauacaugcaccgcuaaggccgguuguuggcuugaguccgugaaaaguuucuuuuacggccugaagaacauguuggggagcgucuucggaaacuuuuucaucggcauacuacuguuucucgccccauucgugcugcuuguuuuauuuuucauguucggguggaaaauucuguuuugcuucaaguguugcagaaggacccggggacucuugaaauaucgacugcucaaggacgaugaagagacuggcuacagacgcaucaucgaaaggcugaauaauaagaaagguaagaaccgucuucuggacggggagcgguuggcugauagaaaaauugcagagcuauuuucuacaaagacccacaucggauga

SEQ ID NO: 10335 - RNA, 5067 nt, Artificial Sequence
  derived and/or modified CDS sequence (opt3) from CCHFV(47-ST-2013)__KR814861.1__GP
augcccaucaacauuaugcacacccugcucgccugcuucauacuuuaccugcaguugagcggcuuagggggagcucauggucaauccaaugcaacagagcacaacggcacuaauacgaccacagugccugggacuucucagucaccaaagccgcccgccaguaccacacugccucauaccccagaaagcuccacugucaaacuaacaacccccacgucugagacugaaggaucgggcgagaccacaccuccacccaacacuacccagggucucccuccaccggggacaacccccgaaagaucagcgacgacugcuacaagcaccaguuccacugacaauaugaacucuacaacccagaugacgggaaauaccccuacaccaacuguuaacaugagccccuccucaaguccuagcaugccaucuaccucccaaggcauccacuaucccgugaggucacugcuuagcguaccgaguccuaagacagccacuacccccacaccagugucuccuggcgagaugucccccgagaccagcucgcagcauucugcaacuucccggauuccaacgcuguacacagccacccaggucucaacugaaaauaccaaccgcaguacaccccgacagagcaaauccucugugcaaccugcuacccagagcccaaucacuccgcccgcacagacaauuuugcucaugucagccgcuccuaaggccauccaggauaugcacccaagucccacgaaucguuccaaaagaaaccuggagguugaaauaauccugacccucagccaaggguuaaagaaguauuacggaaaaauucugaaguuguugcaccugacucuagaggaggacacagaaggucuccuggagugguguaaaaggaaucuuggcucuaacugcgaugacgacuuuuuccagaagcggaucgaagaguuuuucauuaccggggaaggauauuuuaaugaggugcugcaguucaaaacauugucaacucucaguccuaccgagccaagccauguccgccugcccacggcggaaccguuuaaguccuacuaugcaaagggcuucuuaucucuggauucggguuacuuuagcgccaaauguuacccuagauccucaaccagugggcuccaacuuaucaacgugacacagcacccagcuaggauagccgagacucccggaccuaagaccacaucucugaaaacuauuaacugcaucaauuugcgggcaagcguauucaaggaacaucgcgagguugaaauuaacgugcuacugccccagaucgcugucaaucucuccaacugucacguggugaucaauucacacgucugcgauuauccacuggacaccgauggcccuguucgacuucccagaauacaucacgagggcacguuuauuccagggacauacaaaaucgugauugacaagaaaaacaagcugaaugauagguguagcuugguaaccaacugcgugaucaagggacgggagguccguaaaggucagucugugcuccgccaauauaagacugaaauaaaaauuggcaaggccuccacagggaguagaaaacuguuaagcgaggaaccgggagacgauuguaucucuaggacccagcugcuaaagacugagaccgcggaaauccaugacgacaauuacggcgguccuggggauaagauuacaaucugcaacggcuccacgauuguugaccagcggcucggaucagagcugggcuguuauaccauaaaucgagugaaaaguuucaaacuuugcaaaaacagcgccacugggaagacaugcgagaucgauucgacccccgucaaaugucgccagggauuuugcuugaagauuacacaagaagguagaggccacgugaagcuguccagggggucugagguaguucucgacgcaugugauagcucaugcgaaaucaugaucccaaaaggaacuggcgacauucugguggauuguaguggugggcagcagcauuuccuuaaggacaaucugauagauuugggcugcccccacaucccucuccugggaaaaauggcuauuuacaucugucggauguccaaccacccacgcaccacgauggccuucuuauuuugguucucuuuuggcuaugucauuacaugcaucuucuguaaggcucuguuuuacagccuaauaaucauugggacccucggaaagaagaucaagcaguacagagagcugaaaccccaaacuugcaccauuugugagacagccccugugaaugcaaucgacgccgaaaugcaugaucuuaacugcuccuauaacauaugcccguacugugcuucaagguugacuagcgacggucuggcgcgucacgucacccagugcccaaagcggaaagagaagguggaagagacagaacucuaucugaauuuagagcgaauccccuggauuguuagaaaacugcuucaggugagugagucuacgggcguagcauugaagagguccagcuggcucauuguccugcuagugcugcucaccguuucgcugucaccugugcagucugccccagucgggcauggaaaaacuaucgaaacauaccaaacccgcgagggcuucacuagcauaugucuuuuuauguuggguuccauccuguucauugugagcugcuuaguaaaggggcucguggacucuguuagcgauuccuuuuuccccggccugucagucugucggacaugcaguaucggaagcauuaacggcuuugaaaucgagucucacaaguguuauugcucccuuuucuguugcccuuacuguagacacugcucagcugacagggaaauacaucagcugcacuugaguauuugcaaaaagcgcaaaaccgggagcaaugugaugcucgccguguguaagcgaaugugcuuuaaagcaacgaucgaggccucccggcgugcucuguucaucagaucuauuaucaacacuaccuucgucacauguauucuaacccuggccauaugcguugugucgacuagcgcaguggagauggaagaucucccggcgggaacaugggagagggaagaggaccugaccaauuuuugucaucaggaaugccaaguaacagagacugagugucuuugccccuaugaagcucuuguccugcgcaagccauuauuccucgauucaaucgugaagggcaugaaaaaccugcuuaauuccaccagucuggagacgucucuaagcauugaagccccuuggggugcaaucaacguucaguccacauuuaagcccaccgugucaacugccaauauugcucucucuuggagcagugucgagcaccgggggaacaaaauccuggugaccggaagauccgagagcauaaugaaguuggaagagaggacaggcguuucuugggaccuggguguggaagaugccucagaguccaaauuacucacuguaaguaucauggaccugagccagauguacucgccagucuucgaauaccuuucuggcgaucgacagguggaggaguggccuaaggcaaccuguacgggggaaugccccgagcgcuguggaugcacauccaguaccugccugcauaaggaauggccacacucacggaauuggagauguaacccgacuuggugcuggggcguggggacaggauguaccugcuguggcgucgacguuaaagauuuguuuacugaccacauguucauuaaguggaaaguggaguauaucaagacagaagcuauuguaugcguggagcucaccagucaagagaggcaguguucucugaucgaagccgguacgcguuuuaaucuagggccugucacuauaacccuguccgagccccgcaacauucagcagaaacuuccacccgaaaucaucacacuccauccuaagauugaggaaggauucuuugaucugaugcacgugcaaaagguuuugagcgcgucaaccgugugcaaacugcagaguuguacacauggcauaccaggugacuuacagaucuaccacauuggcaaucuccugaagggggaccgggucaacggacaucuuauccacaaaauugagccccacuucaacacuagcuggauguccugggauggcugcgaccuggauuauuacuguaauaugggggacuggccuucuugcaccuauacgggagugacacagcauaaccacgccgcuuuuguuaauuugcucaacaucgagacugauuacaccaagacauuccauuuucacagcaaaagagugaccgcacacggcgacacuccgcaacuggaucuaaaggccaggccaaccuauggugcuggggaaauaacaguccugguagagguggccgacauggaacuucauacgaaaaagguugagguguccggacucaaguucgcaucacuggcgugcacuggcuguuacgccugcucuagugguaucucguguaaaguccggauucacguggaugagcccgacgaauugaccguacaugucaagagcuccgauccugacgugguugcugccucuacaucauuaauggcacgaaaacuggaguucggcaccgauagcacuuuuaaggcuuucuccgccaugcccaaaacaagucucugcuuuuacaucguggaacgcgaguauuguaagucuugcagcgaagacgacaccaagaaauguguggauacgaagcuggagcagccacagucaauucuuaucgagcacaaagggacuauaauuggaaagcaaaaugacacaugcaccgcaaaagccuccuguuggcuggaaagugucaagagcuucuuuuacggcuugaagaacaugcuagggucuguguucggaaacuuuuucguuggcauccugcucuuucuggcuccuuucguacuuuuagugcuguuuuucauguucgguuggaaaauccucuuuugcuucaaguguugcagaaggacccggggguuguuuaaauaucgacaucugaaggaugacgaggaaacuggauacagacgcauuaucgagaggcucaauuccaaaaagggcaagaaucgucugcuugauggcgaacggcuggcggacagaaaaauagccgaguuguucucaacaaagacccacauuggguga

SEQ ID NO: 10336 - RNA, 5067 nt, Artificial Sequence
  derived and/or modified CDS sequence (opt3) from CCHFV(46-ST-2012)__KR814860.1__GP
augcccaccaacaucaugcacacacugcucgugugcuucauucuuuaccugcaguuguuaggccugggaggagcccauggucaaagcaaugcuacugagcacaacggcacgaauaccacaacugucccuuccaccucucagucaccaaagccgcuaguuaguacaacucccccucaugcacucgaaagcuccacuauaaaaccaacaacccccacgucugagacugaagggucgggagagaccgccccucugccaaacacaacucaggggcccccuccaccggaaaccacacccgagagaccugcgaccacggugacuucaacaccaagcaccgacaauacuuccuccacaauccacguaaccgauaacaaucccacgucuaccauuagcacauccccuucaaguagcccaucuacucccuccaccccgcaggguauccaucacccugcuaggucacuucugagcgugaguucucccaagacagccacuaccccaacaccuaccucccccggggagauuaacagcgaaacuucgucuuugcacuccgcaaugucacggacgccaacacuccauaccgccacucaagucaguaccgagaaugcuaaccacagcgcaccccgccaguccgaaucuagcgcccagccuacaaccacuucacugaugacaaguccagcucaguccauccugcucaugagcgccgcgccgacggcaauacaaaauauccaucccucuccuaccaaccgaucaaaacguaauuuagagauggagauuauccugacucuuagucagggauugaagaaauauuacggcaagauucugaagcuacuccaccugacacuugaagaggacaccgaaggccuguuggagugguguaaaagaaaccucgggagcaauugcgaugacgacuuuuuccagaagaggaucgaagaguuuuucaugacaggagaggguuauuuuaacgaagugcugcaguucaaaacuuuauccacccugucuccaacggagcccucgcacgcccggcucccuaccguugaaccauuuaagagcuacuucgcuaaaggcuuucuuuccguggauucaggguauuucagugccaaguguuacccccgcucuagcacauccggacugcaauugauaaacgucacucagcauccggcaagaauugcugagaccccuggcccaaagacaacuucacuaaaaaccaucaauugcauuaaccugagggccagcguguuuaaggaacaccgggagaucgagaucaauguacuccugccccagauugcgguuaaccuuucuaauugucauguggucauaaacucccacgugugcgauuauagucuggacacggaugguccugugcgcuugccccauaucuaccacgaagggacauucauuccaggaaccuacaaaaucgucauagacaagaaaaauaagcucaacgaucgauguacucugguuacaaauugcgugauuaaaggcagagagguaaggaagggccaaagcguguuacggcaguauaagaccgaaaucaaaaucgggaaggccucuacuggaucccguaaacugcuaucagaggaaccuggugacgauuguauuagucgcacccagcuccugagaacagagacggcagagauccacgacgacaacuacggcgggcccggagauaagauuaccauaugcaauggcagcacuaucgucgaccagaggcuugguucggaauugggguguuauacaauuaaccgggugaaauccuuuaagcugugcgaaaauucugcuaccggcaagacaugcgagaucgauagcacuccaguuaaaugucgacaaggauucugccucaagaucacccaggagggccgcgggcaugugaaacugucaagaggaagugaggucgugcuugacgccugugauuccucuugcgaaguaaugauuccgaaggguacgggcgacauacugguugauuguagcgggggacagcagcacuucuugaaagacaaccucaucgaucugggcugcccucauauucccuuacuggguaagauggcuaucuacauuuguaggauguccaaucacccacggacaaccauggccuuucuauucugguuuucauucggguaugugaucacuugcauauuuuguaaggcacucuucuacagccugaucauuaucggcacccuugggaaaaagauuaaacaauaucgcgaguugaagccccagacaugcacuaucugugaaaccgccccugucaacgcuauagacgcggagaugcacgaucugaacugcaguuacaauauuugcccauacugugcaucuagacucacauccgacggccuggccaggcaugugccccagugcccuaaacguaaggaaaaggucgaggagacggaauuauaucugaaccuugagcggaucccguggauugugcgaaaauugcuccagguuagcgaaucgaccgggguggcucugaagagaucaucuuggcuaaucguacugcucguccugcuuacugugaguuuguccccaguucaaagcgcccccgugggacacgguaaaacaauagagaccuaccagacuagggaaggcuuuacaucuaucugucuguucauguuagggagcauucucuuucuggucuccugccuugugaagggacugguagacucagugagugauagcuucuuuccuggcuugucuguuuguaaaaccugcuccaucgguucaauuaauggguucgagaucgagagucauaaguguuauugcagccucuuuuguugcccauacugucgccacugcuccgcagaccgggaaauacaucagcugcaccuaucuauuugcaaaaagagaaagacgggcucgaacgucaugcuggccguguguaaaaggaugugcuuccgcgcuacuaucgaggccagccgacgggcacuccugauccguucaauuaucaaugcgaccuucgugauuuguauacuuacauugaccaucugcgucguuuccaccagugcuguggaaauggagucucugcccgccggaacaugggaaagagaggaggauuuaaccaacuuuugucaccaggaaugccaagugacagagacugaaugucucugcccuuaugaggcacugguacuuaggaagccgcuguuccuagacagcauugucaaaggcaugaagaaucuccugaacuccaccucauuggagacgucucugagcaucgaagcccccuggggcgcuauuaaugugcagaguacauuuaaaccaaccguuuccacugccaacaucgcauuaagcuggucuucaguggagcaucgcggaaauaagauacucgucaccggccgguccgaaaguaucaugaagcuggaggaaagaacaggugugagcugggaucuugggguugaggacgcuucggagucuaaacuguugacuguguccauuauggaucucagccagauguacucaccuguauucgaauaucugaguggagacaggcaagucgaggaauggcccaaggccaccuguacgggcgauugcccagagcgaugugguugcacaucuaguaccugccuacacaaagaauggccucauagccgcaacuggcgguguaaucccacuuggugcuggggcguggggacaggauguaccugcuguggcguggacgucaaggaucuguuuacugaccacauguucguuaaauggaagguggaguacaucaagacagaggcgauuguaugcguggaacuuaccucacaggagagacaguguagucucaucgaagccgggacgagguuuaaccugggaccagucacuauaaccuugagcgagccgcguaauauucagcaaaaacugccucccgaaaucaucacauuacauccaaagguggaggagggcuucuuugaucucaugcacguucagaaagugcuguccgcuucuaccgucugcaagcugcagagcuguacacacgguauucccggggaccuucagguguaccauauaggaaacuugcucaaaggcgaccgcaucaacggucaccugauucauaagaucgaaccucacuucaauacuuccuggaugucaugggauggcugcgaccuagauuauuacuguaacaugggggacuggccaucuugcaccuauacgggaguuacacaacacaaucaugcagccuuugugaaccugcuuaauauugagacugauuacaccaagacauuccacuuucauaguaaacgggucaccgcucacggcgacacuccccagcucgaucugaaggccagaccuaccuauggggcaggagaaaucacaguauugguggagguugcggacauggaguuacauacgaaaaagguggaaauaucgggccugaaauucgccagccucgcuugcacugguuguuacgccugcuccucugggaucucauguaaggucaggauucacguggaugagccggacgaacugaccguacacgugaaaagcuccgauccagacgucguugcagcuaguacaucucuuauggcccgaaagcuggaguucggaaccgauagcacuuuuaaggcauucucagccaugcccaaaacauccuugugcuuuuauaucguggaacgggaguacuguaagaguugcagcgaggaagacacccagaaauguguggacacgcgccuagagcagccucaaucuauucugaucgaacauaagggcacuauaauugguaaacagaacgauacaugcaccgcuaaggcguccuguuggcucgagucagucaagagcuucuuuuacggccugaaaaauaugcuugggucgguguucggaaacuuuuucaucggcaucuuacuguuucucgcccccuucguuuugcugguacucuuuuucauguucggguggaagauucuguuuugcuucaaauguugcagaaggacccggggacuucugaaguaucgacacuugaaagacgaugaagagacuggcuacagacgcaucauagagaggcuaaauaacaagaaggguaaaaaucgucugcucgacggggaacgguuagcagauagaaagauugcugagcuguuuucuacaaaaacccauaucggauga

SEQ ID NO: 10337 - RNA, 5067 nt, Artificial Sequence
  derived and/or modified CDS sequence (opt3) from CCHFV(44-ST-2010)__KR814859.1__GP
augcccaucaacauuaugcacacccugcucgugugcuucauacuuuaccugcaguugagcggcuuagggggagcccauggucaauccaaugcuacagagcacaacggcacuaauacgaccacagucccugggacuucucagucaccaaagccgcccgcaaguaccacacugccucauaccccagaaagcuccacuguuaaacuaacaacccccacgucugagacugaaggaucgggcgagaccacaccuccacccaacacuacccagggucucccuccaccggggacaacccccgaaagaccugccacgacugcgacaucaaugagcaguaccgacaauaugaacuccacuacacaggugaccgauaauacgccaaccucuacaguaagcaucucccccucaaguagcccuucuaugccauccacuucacaagggauucacuaucccgugaggagccugcuuagugucucuuccccgaagaccgugacaacuccuacccccaugagcccaggcgagaugucgccugagacaucuucccagcauucagcuaugagucggauccccacccuguacacugccacgcagguuagcacagaaaacaccaaucgcuccacuccacgacagucugagagcucagcacaacccgccacccagaguccuacaaccuccccaacucagacaauuuugcucaugagcgcugcaccgaaagccauccaggacaugcaccccucuccuacgaaccguucaaagagaaaucuggaaguggagauaauccugacccucagucaaggccuuaaaaaguauuacgggaagauucugaaacuuuugcaccugacucuagaggaagauacagagggacuccuggaaugguguaagaggaaccuugguagcaauugcgacgaugacuuuuuccagaaacggaucgaggaauuuuucauuaccggcgagggguauuuuaacgagguccugcaguucaagacauuguccacucucucuccaaccgaacccucgcaugugcgccugccuacggcugagccauuuaaaagcuacuucgccaagggauuuuuauccaucgauucaggcuauuucagugcgaaguguuaccccagaucuagcaccuccggucugcaacucauaaauguaacacagcacccggcaaggauugccgaaacuccugggccaaaaaccacaucacuuaagacuaucaacugcauuaaccugcgggcuagcguuuuuaaagagcaucgcgaaguggagaucaaugucuugcuaccccagaucgccgugaaccugucuaauugucacguggucauuaacucccacguuugcgacuacagucucgauaccgacggaccugugcgacugcccagaauacaucacgagggcacguucaucccaggcacauauaagauuguaaucgauaaaaagaauaaacuuaacgacagguguagccuggugaccaauugcgucauaaaggggcgggaagugcguaagggacagucuguuuugcgccaauacaaaacugagauuaagaucgguaaagcauccacaggcucaagaaagcuccugagugaggaaccuggggaugacuguaucagcaggacccaguuacugaaaacugaaaccgcugagauucaugacgauaacuauggaggccccggugacaagaucacaauuugcaaugggucgacgauaguggaucagcggcuaggcuccgagcucggauguuacaccaucaaccgagucaagucuuuuaaacugugcgaaaauagcgccacuggcaagacaugcgagauugacucaaccccagugaaaugucgccagggguucugccuuaagaucacacaagaaggaagaggucacguaaaauugaguaggggcuccgagguugugcuggaugcgugugacucuagcugcgagaucaugauuccgaaggggacuggagauauacucgucgacuguuccggcggucagcagcauuuccugaaggauaaccuuaucgaccuggggugcccucacauucccuugcucggcaaaauggccaucuauauuugucggaugucaaaucacccacgcaccacgauggcauuucuguuaugguucagcuuuggauacgugaucacaugcauauucuguaaggcucuguuuuauagucuaaucauuaucggcacccucgggaaaaagauuaaacaguacagagaacugaagccccaaacuugcaccaucugugagacagccccugucaacgcuauagaugccgaaaugcaugaccuuaauugcucuuacaacauuugcccauauugugcauccagguugacuagcgacggacuggcccgucacgugacccagugccccaagcggaaagagaagguugaagagacagagcucuaccugaacuuagaacgaaucccuuggauugugagaaaacugcuucagguaucggagucaacgggugucgcuuugaagaggucuaguuggcucaucgugcugcuaguucugcucaccgugucccugagcccgguccagucugcgccagugggccaugggaaaacuauagaaacauaucaaacccgcgagggauucacuaauaucugucuuuuuauguugggcagcauucuguucaucguauccugcuuagugaagggucucguugauucagucagugacagcuuuuuccccgggcugucuguguguaaaacaugcuccuuuggcucaauuaacggauucgaaaucgagagucacaaguguuacugcagccuuuucuguugcccuuauugucggcacugcuccgcagauagagagauacaucagcugcacuugggcauuugcaagaaaaggaagaccgggucuaaugugaugcucgccgucuguaaacgcaugugcuucaaggcuacgaucgaagccucgcgacgggcacugcuaauccguagcauuaucaacacuaccuucguuauuuguauacugacacucgccaucugcguggugucaaccuccgcuguagagauggaaaaucugccagccggaacuugggagagagaagaggaccuuacaaacuuuugucaucaggagugccaagucagugaaaccgaguguuugugccccuacgaagcacugguguuaaggaaaccucucuuccuggauucuauuguuaagggcaugaagaaucuucugaacagcacaucccuagagacuucacucucuaucgaggcgccguggggugcuauuaaugugcagagcaccuuuaaacccacggucaguacagccaacaucgcacuguccuggagcucuguggaacaccgcgggaauaagauauugguuaccggacggucagaguccaucaugaaacuggaagagagaacuggcgugaguugggacuuagguguagaagaugccagcgagucgaagcuccugaccgucucuauuauggaccuuucccagauguauagcccaguguucgaguaccugucaggcgaucgacagguggaagaguggccuaaagcuacauguacuggggacugccccgaaagguguggaugcaccaguucuacgugcuugcauaaggaguggccacacucccgcaacuggcgguguaauccuacauggugcuggggcgucgggaccggauguacuugcuguggcguugaugugaaggaccucuuuacagaucacauguucaucaaauggaagguagaauacauuaaaaccgaggccaucgugugcgucgagcugacuagccaagaaagacaguguucacuaauagaggcagguacaagguuuaaccuggggcccgugaccauuacgcuuagugaaccacguaauauccagcagaagcucccgccugagaucauuacucugcaucccaaaauagaagagggauucuuugacuugaugcacguucaaaaggugcugagcgcuuccaccgucugcaaguuacagucuuguacacauggcaucccaggugaccuccagauuuaucacaucggcaaccugcuuaaaggggaucgccugaacggacauuugauucacaagaucgagccccacuucaauaccagcuggauguccugggacggcugcgaucucgacuacuauuguaacaugggggauuggccuucaugcacauacacuggagugacccagcauaaucacgccgcguuuguuaaccugcuaaauauagaaacggacuauacaaaaacuuuccauuuucacucuaagcgggugaccgcccacggcgauacaccacaacuggaccuuaaagcuagacccaccuacggugcaggggagaucacuguccucguagaaguggccgauauggagcugcauaccaagaaaguugagauuaguggauugaaguucgcuucguuagccugcacaggcuguuaugcaugcagcuccgguaucucuuguaaggugaggauucacgucgacgaaccugaugagcugacggugcauguaaaaucaagcgacccggauguggucgcggccuccaccagucucauggcucgaaagcuggaauuuggcacugacucuacauuuaaagccuucagcgcaaugccaaagaccucacuuugcuuuuacaucguugagcgggaauacuguaaauccugcagugaggacgauacuaagaaguguguggacacaaaacuggaucagccccagagcauauugauugagcacaaggggaccaucaucggaaaacaaaacgacacgugcacugcuaaggccucuuguuggcuagaauccgugaaaucauucuuuuauggccugaagaauaugcucgggagcgucuucggaaacuuuuucgugggcauucuguuauuuuuagcaccuuucguucugcucguauuguuuuucaugugcgguuggaagauccuguucuguuuuaaaugcugccgcagaacaaggggacucuucaaguaccggcaucugaaagaugacgaggaaaccggauaucgaagaauaauugagcgccuuaauucgaagaaaggcaagaacaggcuguuggauggcgaacgucuagccgaccggaagaucgcugagcuguuuucuaccaaaagucacauuggguga

SEQ ID NO: 10338 - RNA, 5067 nt, Artificial Sequence
  derived and/or modified CDS sequence (opt3) from CCHFV(37-R-2013)__KR814858.1__GP
augcccaccaacaucaugcacacacugcucgugugcuucauucuuuaccugcaguuguuaggccuagggggagcccauagacaaagcaaugcuacugagcacaacgguacgaauaccacaacugcaccuuccaccucucagucaccaaagccgcccgucaguacagccccuccacaugcgcccgaaaccagcacuauaaaaccuacaaccccagcuuccgagacggaaggcucuggggagacuacacccccuccaaacaccacucagggaccgucgcccccugaagccaccccagagaggcccgcaacaaccguuacgucaacuccuagcacagacaauaccaacaguacuacacacgccaccgauaauaacccaacguccaccaucucuacaagccccuccucaaguccgagcacuccuucuacaccccagggcauucaucacccagcucggaaucugcucuccgugucaagcccuaagaccgcaacuacccccacaccaaccagucccggugacaucucuuccgagacuagcucgcugcacucugccaugucccgcacgccuacacuucauaccgcuacucaagccucaaccgaaaacgcgaaucacagugcaccacgacagagcgaguccucugcccagcagacaaccacuagcccgaugacaucacccgcucaaccuauucugguaaugagugccgcaccaacggcuauccagaacauacaucccuccccuaccaaucguagcaaaagaaacuuggaaauggagaucauucucacucugucucaggggcugaagaaauauuacggaaagauccucaaguuacugcaccuuacauuggaggaagauaccgagggccugcuagaaugguguaaaaggaaucucggcucaaacugcgacgaugacuuuuuccagaagcggauugaggaauuuuucaugacaggggagggauauuuuaacgaggugcugcaauucaaaacucuuaguacccugagcccaacggaacccucccacgcccgcccgccuaccgucgagccauuuaagucuuacuucgcgaaaggauuuuugucgaucgauagcggcuauuucuccgccaaguguuaccccagacucacaacuucagggcugcaguuaauaaaugugacccagcauccugcaaggauugcugaaacacccggaccaaagacuaccagucugaaaacgaucaacugcauuaaucuccgggccucuguuuuuaaggagcaccgcgaaaucgagaucaacgugcuucugccucaaauugcugucaauuugagcaacugucaugugguaauaaauucccacguuugcgacuauucacuagauacagacggccccgugcgacugccacauaucuaccacgaggguaccuucauuccggggacuuacaaaaucgucauagauaagaaaaacaagcucaaugacagauguacacuggugaccaacugcgugauuaaaggaagggaaguccggaagggccagagcguucuucgucaguauaagacugagaucaaaaucggcaaggccucuaccgggucccgcaaacuguugagugaggaaccuggagaugacuguauuagcagaacacagcuccugaggacggaaaccgcagagauccacgacgauaauuacgguggccccggggacaagauuacuauaugcaacggaucuacaaucguggaucaacgguuaggcuccgagcuggguuguuauaccauuaaucgaguaaaaucauuuaagcuaugcgaaaacagugccacagggaagacuugcgagaucgacagcaccccagugaaaugucgccagggcuucugccucaagaucacgcaggaaggaagaggccaugucaaacugucgaggggguccgaggugguucuugaugcuugugacacaucuugcgaggugaugauucccaagggaaccggugauauauuggucgacuguagcggcgggcagcaacacuuccugaaagauaaucucaucgaccugggaugcccucauauuccacuucugggcaagauggcgaucuacauuugucggaugucaaaccacccccgcacuaccauggcauuuuuguucugguuuaguuucgguuaugugaucacaugcauauuuuguaaggcccucuucuacucccugaucauuaucgggacuuuaggcaaaaagauuaaacaguauagagaacugaagccucagaccugcacaaucugugagacggcuccgguaaacgccauagaugcagaaaugcacgaccuaaauugcucuuacaacauuugcccauacugugccagcaggcucaccuccgacggacuggcucgucauguuccccagugcccuaaacggaaggagaagguggaagagacugagcuuuauuugaaucuggaacgaaucccauggauugucagaaaacuccugcaagugucagagagcacaggcgucgccuuaaagaggaguucuuggcugaucgugcuuuugguucuccugaccgugucccuaagccccguacagucggcaccugucgggcacggaaaaacuauagaaacauaccagacccgcgaggguuuuacgucagugugucuguucaugcucggcucuauccuguuucuuguuaguugcuuggugaaggggcuggucgauuccgugagcgacucuuucuuuccgggauuaagcguauguaaaacuugcuccauuggcucaaucaacgguuucgaaauugagagucauaaguguuauugcagccucuuuuguugccccuacugucggcacugcucugcggauagagagauccaucagcugcaccuuuccauaugcaaaaagaggaagauggggucaaaugugaugcuggcuguuuguaaacgcaugugcuuccgagccaccauugaagcaagucggcgugccuugcucaucagaagcaucauuaacacaaccuucgucaucuguauucugacucuaacaauaugcgugguguccaccucugcugucgagauggaaaaucugccaucgggcacaugggagagggaagaggaccucacuaacuuuugucaccaagagugccagguuaccgaaacggagugucugugcccuuaugaagcccuuguguugcgcaagccccuguucuuagauagcaucgugaaaggaaugaagaaucuccugaacucaacaucccuugagaccagucugucuauugaggcaccauggggcgcuaucaauguacagagcacuuuuaaaccuaccgucuccacagccaacauugcgcuaucauggucuagcguggaacaucgggggaauaagauccucguuacuggaagaagugaguccauaaugaagcuggaagagaggaccggcgugagcugggacuugggugucgaugacgccucugaaucaaaacuguuaacgguguccaucauggaucucagucaaauguacagccccguuuucgaguaucugucgggggaccgacagguggaggaauggccaaaggcuacauguaccggagauugcccggagcgcuguggcugcacuucuuccacaugccuucacaaagaauggccucauagccggaacuggagauguaaucccaccuggugcugggguguaggcacuggguguacaugcuguggagucgacgugaaggaucuguuuaccgaccacauguucgugaaauggaaggucgaguacauuaagacggaagcaaucguuugcguggaguugacuucacaggagaggcaguguagucucauugaagccggcacccguuuuaaccuggggccaguaacaaucacccuaucugagccccgcaacauacaacagaaacugccuccagaaauuaucacacuucaucccaagguggaggaaggauucuuugaccucaugcacguccagaaagugcuguccgcuagcacuguuugcaaguugcagucauguacccacggcaucccuggugaucugcaaguguaccauauugggaauuuacucaaaggagaccgggucaacggccaccugauacauaagaucgagccgcacuucaauacgaguuggaugagcugggaugguugcgaccuugauuauuacuguaacaugggcgacuggccauccugcacauauacuggggugacccagcacaaucaugccgcauuuguuaaccuguugaauauugagacagauuacaccaagacuuuccacuuucauucuaaaagagugaccgcgcacggagacacaccccagcucgaucugaaggccaggccuacguauggcgcuggggaaaucacuguccuaguagagguggccgacauggaacugcauaccaaaaagguugagauuagcggacuuaaauucgcaucccucgcuugcacaggcuguuacgccugcucaucugguaucaguuguaaggugcgaauacacgucgaugagcccgacgaacugaccgugcacguaaaaucgaacgauccagacguggucgcagccagcacuuccuugauggcucggaaguuagaguucgggacagacucuaccuuuaaggcguucucagccaugccuaaaacgagccugugcuuuuauaucguugaacgcgaguacuguaaguccugcagugaagaggauacucagaaauguguggacacaaagcucgagcaaccccagucuauucugaucgaacauaaaggaaccauuaucggcaagcagaaugugaccugcacugcaaaggcuagcuguuggcuugagucagucaaauccuucuuuuacggucugaagaacauguugggcaguguguucgggaacuuuuucauagguauucuacuguuucucgccccauucguucugcuuguauuauuuuucauguucggcuggaaaauccuguuuugcuucaaguguugcagaaggacacgggggcucuugaaauaucgacugcucaaggaugacgaagagaccggauacagacgcaucauugaaaggcugaauaauaagaaaggcaagaaccgucuucuggauggugagcgguuggccgacagaaaaaucgcugagcuauuuagcacaaagacucacauaggguga

SEQ ID NO: 10339 - RNA, 5067 nt, Artificial Sequence
  derived and/or modified CDS sequence (opt3) from CCHFV(36-ST-2014)__KR814857.1__GP
augcccaucaacauuaugcacacccugcucgugugcuucauacuuuaccugcaguugagcggcuuagggggagcccauggucaauccaaugcuacagagcacaacggcacuaauacgaccacagucccugggacuucucagucaccaaagccgcccgcaaguaccacacugccucauaccccagaaagcuccacuguuaaacuaacaacccccacgucugagacugaaggaucgggcgagaccacaccuccacccaacacuacccagggucucccuccaccggggacaacccccgaaagaccugccacgacugcgacaucaaugagcaguaccgacaauaugaacuccacuacacaggugaccgauaauacgccaaccucuacaguaagcaucucccccucaaguagcccuucuaugccauccacuucacaaggcauucacuaucccgugaggagccugcuuagugucucuuccccgaagaccgugacaacuccuacccccaugagcccaggagagaugucgccugagacaucuucccagcauucagcuaugagucggauccccacccuguacacugccacgcagguuagcacagaaaacaccaaucgcuccacuccacgacagucugagagcucagcacaacccgccacccagaguccuacaaccuccccaacucagacaauuuugcucaugagcgcugcaccgaaagccauccaggacaugcaccccucuccuacgaaccguucaaagagaaaucuggaaguggagauaauccugacccucagucaaggcuuaaagaaguauuacgggaagauucugaaacuuuugcaccugacucuagaggaagauacagagggacuccuggaaugguguaagaggaaccuugguagcaauugcgacgaugacuuuuuccagaaacggaucgaggaauuuuucauuaccggcgagggguauuuuaacgagguccugcaguucaagacauuguccacucucucuccaaccgaacccucgcaugugcgccugccuacggcugagccauuuaaaagcuacuucgccaagggauuuuuauccaucgauucaggcuauuucagugcgaaguguuaccccagaucuagcaccuccggucugcaacucauaaauguaacacagcacccggcaaggauugccgaaacuccugggccaaaaaccacaucacuuaagacuaucaacugcauuaaccugcgggcuagcguuuuuaaagagcaucgcgaaguggagaucaaugucuugcuaccccagaucgccgugaaccugucuaauugucacguggucauuaacucccacguuugcgacuacagucucgauaccgacggaccugugcgacugcccagaauacaucacgagggcacguucaucccaggcacauauaagauuguaaucgauaaaaagaauaaacuuaacgacagguguagccuggugaccaauugcgucauaaaggggcgggaagugcguaagggacagucuguuuugcgccaauacaaaacugagauuaagaucgguaaagcauccacaggcucaagaaagcuccugagugaagaaccuggggaugacuguaucagcaggacccaguuacugaaaacugaaaccgcugagauucaugacgauaacuauggaggccccggugacaagaucacaauuugcaaugggucgacgauaguggaucagcggcuaggcuccgagcucggauguuacaccaucaaccgagucaagucuuuuaaacugugcgaaaauagcgccacuggcaagacaugcgagauugacucaaccccagugaaaugucgccagggguucugccuuaagaucacacaagaaggaagaggucacguaaaauugaguaggggcuccgagguugugcuggaugcgugugacucuagcugcgagaucaugauuccgaaggggacuggagauauacucgucgacuguuccggcggucagcagcauuuccugaaggauaaccuuaucgaccuggggugcccucacauucccuugcucggcaaaauggccaucuauauuugucggaugucaaaucacccacgcaccacgauggcauuucuguucugguuuagcuucggauacgugaucacaugcauauuuuguaaggcuuuauucuauagucugaucauuaucggcacccuagggaaaaagauuaaacaguacagagaacucaagccccaaacuugcaccaucugugagacagccccugucaacgcuauagaugccgaaaugcaugaccugaauugcucuuacaacauuugcccauauugugcauccaggcuuacuagcgacggauuggcccgucacgugacccagugccccaagcggaaagagaagguugaagagacagagcuguaccucaaccuggaacgaaucccuuggauugugagaaaauuacugcagguaucggagucaacgggugucgcucuuaagaggucuaguugguugaucgugcuccugguucuacugaccgugucccucagcccgguccagucugcgccagugggccaugggaaaacuauagaaacauaucaaacccgcgagggauuuacuaauaucugucuguucaugcuuggcagcauuuuguuuaucguauccugccuggugaaggguuuaguugauucagucagugacagcuucuuucccgggcucucuguguguaaaacaugcuccauuggcucaaucaacggauucgaaauagagagucacaaguguuacugcagccuguuuuguugcccuuauugucggcacugcuccgcagauagagagauucaucagcuucaccugggcaucugcaagaaaaggaagaccgggucuaaugugauguuggccgucuguaaacgcaugugcuucaaggcuacgaucgaagccucgcgacgggcacuccugauucguagcaucauuaacacuaccuucguuauauguauccuaacacuggccauuugcguggugucaaccuccgcuguagagauggaaaaucucccagccggaacuugggagagagaagaggaccugacaaacuuuugucaucaggagugccaagucagugaaaccgagugucuuugccccuacgaagcauuggugcugaggaaaccuuuauuccucgauucuaucguuaagggcaugaagaaucugcuuaacagcacaucccuggagacuucacuaucuauugaggcgccguggggugcuaucaaugugcagagcaccuuuaaacccacggucaguacagccaacauagcacucuccuggagcucuguggaacaccgcgggaauaagauccugguuaccggacggucagaguccauuaugaaauuggaagagagaacuggcgugaguugggaccuggguguagaagaugccagcgagucgaaguuacucaccgucucuaucauggaccugucccagauguauagcccaguguucgaguaccuuucaggcgaucgacagguggaagaguggccuaaagcuacauguacuggggacugccccgaaagguguggaugcaccaguucuacgugccugcauaaggaguggccacacucccgcaacuggcgguguaauccuacauggugcuggggcgucgggaccggauguacuugcuguggcguugaugugaaggacuuguuuacagaucacauguucauuaaauggaagguagaauacaucaaaaccgaggccauagugugcgucgagcucacuagccaagaaagacaguguucacugauugaggcagguacaagguuuaaccuagggcccgugaccaucacgcugagugaaccacguaauauccagcagaaacuuccgccugagauuauaacucuccaucccaaaaucgaagagggauucuuugaccugaugcacguucaaaagguguugagcgcuuccaccgucugcaagcugcagucuuguacacauggcauuccaggugacuuacagaucuaucacauuggcaaccuccugaaaggggaucgccuuaacggacaucugauccacaagauagagccccacuucaauaccagcuggauguccugggacggcugcgauuuggacuacuauuguaacaugggggauuggccuucaugcacauacacuggagugacccagcauaaucacgccgcguuuguuaaccuccugaauaucgaaacggacuauacaaaaacuuuccauuuucacucuaagcgggugaccgcccacggcgauacaccacaacuagaccugaaagcuagacccaccuacggugcaggggagauuacuguccuuguagaaguggccgauauggagcuccauaccaagaaaguugagaucaguggacugaaguucgcuucguuggccugcacaggcuguuaugcaugcagcuccgguauuucuuguaaggugaggauccacgucgacgaaccugaugaguuaacggugcauguaaaaucaagcgacccggauguggucgcggccuccacuucgcugauggcucgaaagcucgaguucggcaccgacucuacauuuaaagccuucagcgcaaugccaaagaccucacugugcuuuuacauaguugagcgggaauacuguaaauccugcagugaggacgauacuaagaaguguguggacacaaaacuugaucagccccagagcauucugaucgagcacaaggggaccaucauuggaaaacaaaacgacacgugcacugcuaaggccucuuguugguuggaauccgugaaaucauucuuuuauggccuaaagaauaugcuggggagcgucuucggaaacuuuuucgugggcauccuccuguuucuugcaccuuucguuuuacugguacucuuuuucaugugcgguuggaaguucuuguuuuguuucaaaugcugccgcagaacaagggggcuguuuaaguaccggcaucucaaagaugacgaggaaaccggauaucgaagaauaauugagcgccugaauaguaagaaaggcaagaacaggcuucuggauggcgaacguuuggccgaccggaagaucgcugagcuauucucuaccaaaagucacauuggguga

SEQ ID NO: 10340 - RNA, 5067 nt, Artificial Sequence
  derived and/or modified CDS sequence (opt3) from CCHFV(24-R-2012)__KR814856.1__GP
augcccaccaacaucaugcacacacugcucgugugcuucauucuuuaccugcaguuguuaggccuggguggagcccauagacaaagcaaugcuacugagcacaacgguacgaauaccacaacugcaccuuccaccucucagucaccaaagccgcccgucaguacagccccuccacaugcgcccgaaagcuccaccauaaaaccuacuacaccagcuucugagaccgaaggcucgggggagacgacucccccuccaaacaccacacagggaccgucacccccugaagccacuccagagaggaccgcaacaaccgccacgagcacucccaguacagacaauaccaacuccacuacacacgcuaccgauaauaacccuacgucuaccaucagcacauccccaucaaguagccccucuacuccguccaccccucagggcauucaucaccccgcacggaaucuacucucaguuagcaguccaaagacagccacuaccccuacacccaccucuccaggugacaucuccagcgagacuucgucucugcacuccgcuaugucacgcacgcccacacuucauaccgccacucaagcgaguaccgaaaacgcaaaucacagcgccccucgacaguccgagucuagcgcucagcagacaaccacuucaccaaugacaaguccggcccaacccauucuggugauguccgcagcuccuacggccauccagaacauacauccaagccccaccaaucguucuaaaagaaacuuggaaauggagaucauucucacucugucacaggggcugaagaaauauuacggaaagauccucaaguuacugcaccuuacauuggaggaagauaccgagggccugcuagaaugguguaaaaggaaucucggcaguaacugcgacgaugacuuuuuccagaagcggauugaggaauuuuucaugacaggggagggauauuuuaacgagguacugcaauucaaaacucuuagcacccuguccccuacggaaccaucucacgcgagacccccgaccguggagccuuuuaagucguacuucgccaaaggguuuuugagcaucgauuccggcuauuucucagcaaaguguuacccacgccucaguacaucugggcugcaguuaauaaaugucacucagcaucccgcuaggauugccgaaaccccuggacccaagacaacuagccugaaaaccaucaacugcauuaaucuccgggcuuccguguuuaaggagcaccgcgaaaucgagaucaacguucuucugccacaaauugccgugaauuugucaaacugucaugucgugauaaauagccacguaugcgacuauucucuagauacggacggcccuguucgacugccccauaucuaccacgaggguacauucauuccagggaccuacaaaaucgugauagauaagaaaaacaagcucaaugacagauguacucuggucacaaacugcgugauuaaaggaagggaagugcggaagggccaguccguccuucgucaguauaagaccgagaucaaaaucggcaaggcaaguacugggagccgcaaacuguugucugaggaaccgggagaugacuguauuuccagaacccagcuccugaggacagaaacggccgagauccacgacgauaauuacgguggcccuggggacaagauuaccauaugcaacggaucaacuaucguugaucaacgguuaggcagugagcuggguuguuauacaauuaaucgagugaaaucguuuaagcuaugcgaaaacagcgcuaccgggaagacaugcgagaucgacuccacucccguaaaaugucgccagggcuucugccucaagaucacccaggaaggaagaggccaugugaaacugucuagggggagcgaggucgugcuugaugcgugugacacgucaugcgagguuaugauuccaaagggaacaggugauauauugguggacuguaguggcgggcagcaacacuuccugaaagauaaucucaucgaccugggaugcccccauauuccucuucugggcaagauggcaaucuacauuugucggauguccaaccacccacgcaccacuauggccuuuuuguucugguuuucuuucgguuaugucauuaccugcauauuuuguaaggcucucuucuacagccugaucauuaucgggacauuaggcaaaaagauuaaacaguauagagaacugaagccccagacuugcaccaucugugagacagccccugugaacgcaauagaugccgaaaugcacgaccuaaauugcuccuacaacauuugcccguacugugcuucaaggcucacgagcgacggacuggcccgucauguaccacagugccccaaacggaaggagaagguugaagagaccgagcuuuauuugaaucuggaacgaaucccuuggauugugagaaaacuccugcaagucagugagucuacuggcguggcauuaaagagguccagcuggcugaucguccuuuuggugcuccugacaguuucgcuaucaccagugcagucugcgcccguagggcacggaaaaaccauagaaacuuaccagacacgcgaggguuuuaccagugucugucuguucaugcucggcuccauccuguuucuugugagcugcuugguuaaggggcugguggauucugucagcgacuccuucuuuccuggauuaucaguguguaaaacgugcaguauuggcagcaucaacgguuucgaaauugagucucauaaguguuauugcucccucuuuuguugcccguacugucggcacugcucagcugauagagagauccaucagcugcaccuuaguauaugcaaaaagaggaagauggggagcaauguaaugcuggccguguguaaacgcaugugcuuccgagcaacuauugaagccucccggcgugcuuugcucaucagaucuaucauuaacaccacauucguuaucuguauucugacccuaacuauaugcgucgugucgacaagcgccguggagauggaaaaucugcccucaggcaccugggagagggaagaggaccucacaaacuuuugucaccaagagugccaggucacugaaaccgagugucugugcccauaugaagcacuuguuuugcgcaagccucuguucuuagauuccaucgugaaaggaaugaagaaucuccugaacaguacgucucuugagacaagccuguccauugaggcucccuggggcgccaucaaugugcagucaaccuuuaaaccaacuguaucuaccgcgaacauugcccuaagcuggaguuccgucgaacaucgggggaauaagauccucgugacaggaagaagcgagucuauaaugaagcuggaagagaggacuggcguuucaugggacuuggguguggaagaugcuuccgagaguaaacuguuaaccgucagcaucauggaccucucgcaaauguacucuccuguguucgaguaucuguccggggaucgacagguugaagaguggcccaaggcaacguguacaggagacugcccagaacgcuguggcugcaccagcucaacuugccuucacaaagaguggccgcauagucggaacuggagauguaauccuacauggugcuggggugugggcaccggguguacuugcuguggaguagaugucaaggaccuguuuacagaucacauguucgugaaauggaagguggaauacauuaagaccgaggccaucgucugcguugaguugacgucucaggaaaggcaguguucccucauugaggcuggcacucguuuuaaccuggggcccgugaccaucacacuaagcgaaccacgcaacauacaacagaaacugcccccugagauuaucacccuucauccaaagguagaagagggauucuuugaccucaugcacgugcagaaaguccugucagccaguacagugugcaaguugcagagcuguacucacggcauccccggugaccugcaaguuuaccauauugggaauuuacucaaaggagaucgggugaacggccaccugauacauaagaucgagccucacuucaauaccuccuggaugucuugggacgguugcgaucuugacuauuacuguaacaugggcgauuggccgagcugcacguauacaggggucacucagcacaaucaugcagcguuugugaaccuguugaauauugaaaccgacuacacaaagaccuuccacuuucauuccaaaagaguuacugcccacggagauaccccacagcucgaccugaaggcuaggcccacauauggcgccggggagaucacggugcuagucgaaguagcagauauggagcugcauacuaaaaagguggagauuucaggacuuaaauucgcuucucucgccugcaccggcuguuacgcaugcaguucggguaucagcuguaagguucgaauacacguggacgaaccugaugagcugacaguccacgugaaauccaacgaccccgauguaguggccgcuucuaccucauugauggcgcggaaguuagaauuugggacugacagcacauuuaaggccuucuccgcaaugccaaaaaccagucugugcuuuuauaucgucgagcgcgaauacuguaagucuugcagcgaggaggacacgcagaaauguguugauacuaagcucgaacaaccucagucaauucugaucgagcauaaaggaacaauuaucggcaagcagaaugauaccugcaccgcuaaggccuccuguuggcuugaaagugugaaaucuuucuuuuacggucugaagaacauguugggcagcguguucgggaauuucuucauaggaauccuacuguuucucgcccccuucguccugcuuguguuauuuuucauguucggcuggaaaauccuguuuugcuucaaguguugcagaaggacucgggggcucuugaaauaucgacugcucaaggacgacgaggaaacaggauacagacgcaucauugagaggcugaacaauaagaaaggcaagaaccgucuucuggauggugagcgguuggcugacagaaaaaucgcagaacuauuuuccaccaagacacacauaggguga

SEQ ID NO: 10341 - RNA, 5064 nt, Artificial Sequence
  derived and/or modified CDS sequence (opt3) from CCHFV(Oman-199809166)__KR864901.1__GP
augcccgugaacaccaugcacacacugcucgucuacgccguuuucugccuucagcuguggagcccuggcgggacuagaggauuguccaaugagacgcaacauaacgaaaccgguaucacaagggcuccagagggcucucaggggccgucauuacccgugaguacugcaagcccuauuauguccgacccaucuauaaccacacugucggccucaaccagcggacuagaaggcaguggugauacuacacccccugcgaucacccaggggccaacgcuccccgagacuaccccugaaccauccacaacuaccggaacaaaugcuuuuucuaccgccauugcaaacguaagcacgcagacugugaaggacacaccgacccccacuguccaaacauccccuccaucaacccccgaugccaguacgaucccucagggcacccaccauacagcucggggccugcuuagcgugacuguuaccaaaccagaggaggugcccacaccgacugggccugaacaggcaucuauugagaccaauuccucacgccuggccacaagcaagacccccaguccaucuccuacugcucaggucacgacagaaaacuccaaucccaacaccagccgacaauuggugcucucgacucagccagccaccucuucccccguaacaucuccugcgcagcugaauuucguucagagugcaaccacuaucgccgugcaagacgcucacccaagcccgacaaaccguuccaaaagaaaucuggagauggaggucauacucacguuaucucagggacugaggaaguauuacggucggauccuuaaauugcuggaucuaacccucgaagaggacacugaaggccugcuugagugguguaagcgcaaccugggguugacaugcgaugacaacuuuuuccagaagagaauugaagaguuuuuccucaccggagagggccauuuuaaugaagugcugcaauucaaaacacccagcacuuuaucaccuaccgagagugccuccgugggucugccaacggucgaacccuuuaagagcuauuucgcaaaaggguuucucucuaucgauucaggauacuucagugcuaaguguuauccuagggccagcaauuccggccuucagcugauuaacguuacccagcacucugcgcggaucgccgacacaccaggccccaaaauaacuaacuugaagaccauuaauugcaucaaccuaaaggcacugguguuuaaagagcaccgcgaaauugagaucaauguacuccugccucagguggcugucaaccuuucgaauugucaugugcacaucaagagccauguuugcgauuacucccuggacauugaugggacagugcgauugccgagaauacaccacgagggaacuuucaucccagguaccuauaaaauugucaucgacaagaaaaacaagcaaaaugacagguguaaccucgugacgaauugcguaauaaaaggccgggaaguucguaaggggcagucagugcugcgccaguacagaacagagauuaggaucggaaaggccaguucuggcagccggcgauuacuguccgaagagucaggugaagauuguaucagccgcacccagcuacucagaacugagacagcugagauucauggggacaacuacggcggacccggcgauaaaaucaccauuugcaaugggucuacuauagucgaccaaaggcugggauccgaacuugguuguuauaccaucaaccgggugaagaguuucaaauugugcgagaauagcgccacaggcaagucuugcgaaauugauaacacgccugucaaauguaagcagggguuuugccugaagaucacccaggagggacgcggccacgugaaacucuccagagacucagagguugugcuggaugcaugugacaguagcugcgaaaucaugauucccaaggguacuggggauauacuuguagacuguucgggcggacagcaacauuuccugaaagauaauuugaucgaccucggcugcccaaacauuccucuguuagggaagauggccaucuacauuuguaggauguccaaccaccccaaaacaaccauggcuuuucuguucugguuuucuuucggauaugucaucacaugcauacuauguaaggugaucuuuuaccuccugauuguuguggguacucuuggcaagaaauucaagcaguaucgugaguugaaaccacagaccugcacgaucugugaaacaaccccggucaaugcgauugacgcagagaugcaugaucugaacugcagcuacaauaucugcccuuauugugccucacggcucaccagugacgggcuggcucgacacgugaugcagugccccaagagaaaagaaaagauagaggagacugaauuauaccugaaccuugagaggauuccauggguagugcgcaaguugcuccaaguuuccgaaucuacaggagucgcccugaaacggagcuccuggcuaaucgugcugcucgugcugcuuacugucucauugagccccguucagagugcaccuauuggccacgguaagaccaucgagacauaccagacgagagaaggguauaccucuauaugucuguuuguguuaggcuccauccucuucauugugagccaucugaugaaaggacuuguagauucggucggcaauucauuuuucccagggcugucuaucugcaagacuuguaguauuggauccaucaacggcuuugagauagagagccacaaaugcuacuguucuuuguucugcugucccuauugcaggcauuguagcgccgacaaggaaauucacaaacuccaccuguccaucugcaagaagcgcaaagcugguucaaaugugaugcuagccguuugcaagcgaauguguuuccgggcaacaauggaggugaguaacaaagcgcugcucauccguagcgucauuaauaccacuuuugugguuugcauccugauucuugcuguguguguagucucuacauccgccguggaaauggagucauugccugcagggaccugggaaagagaggaggaucugacgaacuucugccaucaagaaugucaggugacugagaccgaaugcuuauguccguacgaggcccucguccugaggaagccacuuuuucuggacaguauagcuaaaggaaugaagaaucuacucaacagcacaucccuggagaccucuuugucgaucgaagcccccuggggcgcaauuaauguucagagcacuuucaagccuacagugucaaccgcuaacaucgcccuguccuggaguucuguagagcaccgcgguaauaaaauuuuagugagcggccgguccgaaucaaucaugaagcucgaggaaagaacagggauaucuugggaucugggagucgaggacgcgagcgagaguaaacuucugacuguguccguuauggauuugagccagauguauucuccaguguuugaauaccucucaggcgacaggcaagucgaggaauggcccaaggcuaccugcacgggggauuguccugagcgaugcggauguacauccaguaccugccugcauaaagaauggccgcacagccgcaacuggcggugcaaccccacuugguguuggggcguggguaccgggugcacauguugcggacuagacguuaaggaucuguucacugacuauauguuugugaaguggaaagucgaguacaucaagaccgaggccauuguauguguggaacuuacgucgcaggagagacagugcucucucaucgaagcaggcacaagguucaaucuggguccaguuaccauuacuuuguccgagccucguaacauccagcaaaaacugcccccagaaauagugacauuacauccucgcauugaggagggcuuuuucgaccucaugcacguccagaaggugcugagcgccucaaccguauguaaacuucagaguugcacucacggggugcccggagaucugcaggucuaccauaucggcaauuugcucaagggggacaagguuaacggacaccugauccauaaaguggaaccacacuuuaauacaucuuggauguccugggauggcugugaccuagauuauuacugcaacaugggugacuggccgagcuguaccuauacgggggugacucaacauaaucacgcugccuucgucaaccugcuuaauauugagaccgauuacacaaagaacuuucacuuccauucaaaacgggugaccgcacacggagacacaccucagcucgaucugaaggcgagacccaauuauggcgccggugaaauaacuguuuugguagagguggcugacauggaguuacauaccaaaaagaucgaaauuaguggccugaaauucgccagccucacgugcacagggugcuacgcauguuccucuggaaucagcugcaaggucaggauucacguggaugagccagacgaacugacuguucacgugaaguccgaggaucccgacaucgucgcugccucaucuagucuuauggcacgaaaacuggaauuuggcaccgacucgacauucaaggccuuuagcgcuaugccuaaaaccuccuuguguuucuauauaguggagcgggaguacugcaagucuuguucaaaagaagauacucagaagugcguaaacgcgaagcuagagcgcccacaaagcauccugauugaacauaaagggaccaucauuggaaagcagaaugacacauguacggccaaagcauccugcuggcucgagagugucaagucauuuuucuacggccugaaaaacaugcuuagcgguaucuuugggaauguguucauaggaaucuuuuuauuccuggcucccuuuauucucuugauccuguucuucauguuuggcuggaggauucucuucuguuuuaagugcuguagacggacucgaggccuguucaaguauagacaccuuaaagaugacgaagagaccggguaccgcaagaucauagagaggcugaacaacaaaaaggguaaaaauaaguugcuagauggagaacgucuggccgaccggaagauugccgagcucuuuucaacaaaaacccauaucggcuga

SEQ ID NO: 10342 - RNA, 5064 nt, Artificial Sequence
  derived and/or modified CDS sequence (opt3) from CCHFV(Oman_812956)__KY362518.1__GP
augcccgugaacaccaugcacacacugcucgucuacgccguuuucugccuucagcuguggagcccuggcgggacuagaggauuguccaaugagacgcaacauaacgaaaccgguaucacaagggcuccagagggcucucaggggccgucauuacccgugaguacugcaagcccuauuauguccgacccaucuauaaccacacugucggccucaaccagcggacuagaaggcaguggugauacuacacccccugcgaucacccaggggccaacgcuccccgagacuaccccugaaccauccacaacuaccggaacaaaugcuuuuucuaccgccauugcaaacguaagcacgcagacugugaaggacacaccgacccccacuguccaaacauccccuccaucaacccccgaugccaguacgaucccucagggcacccaccauacagcucggggccugcuuagcgugacuguuaccaaaccagaggaggugcccacaccgacugggccugaacaggcaucuauugagaccaauucccccagacuggccacaucaaagaccccaagcccuagucccacugcucaggucacgacagaaaacucuaauccaaacaccucccgacaauuggugcucagcacucagcccgccaccucgucuccuguaacauccccagcgcagcugaauuucguucagucagcaaccacuaucgccgugcaagacgcucacccgagucccacaaaccguagcaaaagaaaucuggagauggaggucauacucacguuaucccagggacugaggaaguauuacggucggauccuuaaauugcuggaucuaacccucgaagaggacacugaaggccugcuugagugguguaagcgcaaccugggguugacaugcgaugacaacuuuuuccagaagagaauugaagaguuuuuccucaccggagagggccauuuuaaugaagugcugcaauucaaaacaccuucuacuuuaagcccaaccgagucagccagugugggucugcccacggucgaaccuuuuaaguccuauuucgcaaaaggguuucucagcaucgauucuggauacuucucagcuaaguguuauccaagggccaguaauagcggccuucagcugauuaacguuacccagcacuccgcgcggaucgccgacacacccggcccgaaaauaacuaacuugaagaccauuaauugcaucaaccuaaaggcacugguguuuaaagagcaccgcgaaauugagaucaauguacuccugccucagguggcugucaaccuuucuaauugucaugugcacaucaagucgcauguuugcgauuacagccuggacauugaugggacagugcgauugccaagaauacaccacgagggaacuuucauccccgguaccuauaaaauugucaucgacaagaaaaacaagcaaaaugacagguguaaccucgugacgaauugcguaauaaaaggccgggaaguucguaaggggcaguccgugcugcgccaguacagaacagagauuaggaucggaaaggccucaaguggcucucggcgauuacugagcgaagaguccggugaagauuguaucucacgcacccagcuacucagaacugagacagcugagauucauggggacaacuacggcggaccuggcgauaaaaucaccauuugcaaugggagcacuauagucgaccaaaggcugggaucugaacuugguuguuauaccaucaaccgggugaaguccuucaaauugugcgagaauagugccacaggcaagagcugcgaaauugauaacacgcccgucaaauguaagcagggguuuugccugaagaucacccaggagggacgcggccacgugaaacucucuagagacuccgagguugugcuggaugcaugugacucaaguugcgaaaucaugauuccaaaggguacuggggauauacuuguagacuguagcggcggacagcaacauuuccugaaagauaauuugaucgaccucggcugcccuaacauuccccuguuagggaagauggccaucuacauuuguaggaugucgaaccacccaaaaacaaccauggcuuuucuguucugguuuuccuucggauaugucaucacaugcauacuauguaaggugaucuuuuaccuccugauuguuguggguacucuuggcaagaaauucaagcaguaucgugaguugaaaccgcagaccugcacgaucugugaaacaaccccugucaaugcgauugacgcagagaugcaugaucugaacugcucuuacaauaucugccccuauugugccagccggcucacuucagacgggcuggcucgacacgugaugcagugcccaaagagaaaagaaaagauagaggagaccgaauuauaccugaaccuugagaggauucccuggguagugcgcaaguugcuccaaguuagugaauccacaggagucgcccugaaacggucuagcuggcuaaucgugcugcucgugcugcuuacugucuccuugucaccuguucagagcgcaccaauuggccacgguaagaccaucgagacauaccagacgagagaaggguauaccaguauaugucuguuuguguuaggcucuauccucuucauugugucccaucugaugaaaggacuuguagauagcgucggcaauucguuuuuccccgggcugucaaucugcaagacuuguucuauuggaaguaucaacggcuuugagauagagucccacaaaugcuacuguagcuuguucugcuguccuuauugcaggcauuguucugccgacaaggaaauucacaaacuccaccugagcaucugcaagaagcgcaaagcugguuccaaugugaugcuagccguuugcaagcgaauguguuuccgggcaacaauggaggugucaaacaaagcgcugcucauccguagugucauuaauaccacuuuugugguuugcauccugauucuugcuguguguguagucagcacaucugccguggaaauggaguccuugccggcagggaccugggaaagagaggaggaucugacgaacuucugccaucaagaaugucaggugacugagaccgaaugcuuauguccauacgaggcccucguccugaggaagccccuguuuuucgacucaauagcuaaaggaaugaagaaucuucuaaacaguacaagccucgagaccucccugucuaucgaagccccuuggggcgcaauuaauguucagucgacuuuuaagccaacagugagcaccgcuaacaucgccuugucaugguccaguguagagcaccgcgguaauaaaauucuggugucuggccggagcgaauccaucaugaaguuagaggaaagaacagggauaucaugggaucucggagucgaggacgcgucugagagcaaacugcuuacugugaguguuauggaucugucccagauguauagccccguguucgaauacuugucuggcgacaggcaagucgaggaauggccuaaggcuaccugcacgggggauuguccggagcgaugcggauguacaucaaguaccugccuccauaaagaauggccccacucccgcaacuggcggugcaacccaacuugguguuggggcguggguaccgggugcacauguugcggacuggacguuaaggaucuauuuacugacuauauguucgugaaguggaaagucgaguacaucaagaccgaggccauuguauguguggaacugacgagccaggagagacagugcucgcuuaucgaagcaggcacaagguuuaaucucgguccuguuaccauuacucugucugagccccguaacauccagcaaaaauugccaccugaaauagugacacugcauccccgcauugaggagggcuucuuugacuuaaugcacguccagaaggugcucuccgccagcaccguauguaaacugcagucaugcacucacggggugccaggagaucuucaggucuaccauaucggcaaucuguugaagggggacaagguuaacggacaccucauccauaaaguggaaccgcacuucaauacaaguuggaugucuugggauggcugugaccuggauuauuacugcaacaugggugacuggccuuccuguaccuauacgggggugacucaacauaaucacgcugccuuugucaaccuacugaauauugagaccgauuacacaaagaacuuccacuuccauagcaaacgggugaccgcacacggagacacaccccagcuugaucucaaggcgagaccaaauuauggcgccggugaaauaacuguucugguagagguggcugacauggaguugcauaccaaaaagaucgaaauuucaggcuuaaaauuugccagucugacgugcacagggugcuacgcauguagcuccggaaucucuugcaaggucaggauucacguggaugagcccgacgaacucacuguucacgucaagagcgaggauccugacaucguggcugccuccucaucucugauggcacgaaaacuugaguucggcaccgacaguacauuuaaggccuucucggcuaugccaaaaaccagccuguguuuuuauauaguggaacgggaguacugcaaguccuguucuaaagaagauacucagaagugcguaaacgcgaaguuggagcgcccccaaucaauccuaauugaacauaaagggaccaucauuggaaagcagaaugacacauguacggccaaagcaagcugcuggcuggaguccgucaagaguuucuuuuacggccucaaaaacaugcugucugguaucuucgggaauguguuuauaggaauuuucuuauuucuugcuccuuucauccugcucaucuuguucuuuauguucggcuggcgcauucuguuuuguuucaagugcuguaggcggacucgaggccucuuuaaguauagacaccugaaagaugacgaagagaccggguaccgcaagaucauagagaggcuuaacaacaaaaaggguaaaaauaagcuguuggauggagaacgucuagccgaccggaagauugccgagcuguucagcacaaaaacccauaucggcuga

SEQ ID NO: 10343 - RNA, 5064 nt, Artificial Sequence
  derived and/or modified CDS sequence (opt3) from CCHFV(Oman)__DQ211632.1__GP
augcccgugaacaccaugcacacacugcucgucuacgccguuuucugccuucagcuguggagcccuggcgggacuagaggauuguccaaugagacgcaacauaacgaaaccgguaucacaagggcuccagagggcucucaggggccgucauuacccgugaguacugcaagcccuauuauguccgacccaucuauaaccacacccucggccucaaccagcggacuggaaggcaguggugauacuacaccuccagcgaucacccaggggcccacgccuccagagacuaccccggaacccuccacaacuaccggaacaaaugcuuuuucuaccgccauugcaaacguaagcacgcagacugugaaggacacaccuaccccaacuguccaaacaagucccccuucaaccccagaugccaguacgaucccccagggcacccaccauacagcucggggccuacucagcgugacuguuaccaaaccggaggaggugccuacacccacugggccagaacaggcaucuauugagaccaauuccccucgccuggccacaucaaagacccccagcccaagucccacugcucaggucacgacagaaaacucuaauccuaacaccucccgacaacuugugcugagcacucagccagccaccucgucuccgguaacaucccccgcgcaguugaucuucguucagucagcaaccacuguggccguccaagacgcucacccuaguccaacaaaucguagcaaaagaaaccucgagauggaggugauacugacgcugucccagggacucaggaaguauuacggucggaucuuaaaacugcuugauuugacccuggaagaggacacugaaggccuacucgagugguguaagcgcaaucuggggcuuacaugcgaugacaacuuuuuccagaagagaauugaagaguuuuuccugaccggagagggccauuuuaaugaaguguugcaauucaaaacacccucuacucucagcucaaccgagagugccuccgucggucugccuacgguugaaccauuuaagagcuauuucgcaaaaggguuuuuaucuaucgauucaggauacuucagugcuaaguguuaucccagggccagcaacuccggccugcagcucauuaaugugacccagcacucugcgcggaucgccgacacaccgggcccuaaaauaacuaaccuuaagaccauuaacugcaucaaucugaaggcauugguauuuaaagagcaccgcgaaauugagaucaacgugcuacugccacaggucgcugugaaucucucgaacugucauguucacaucaagagccaugugugcgauuacucccuggacauugaugggacaguccgacuucccagaauacaccacgagggaacuuucaucccugguaccuauaaaauugugaucgacaagaaaaauaagcaaaacgacagguguaaucugguaacgaacugcguuauaaaaggccgggaagugcguaaggggcagucagucuugcgccaguacagaacagagauuaggaucggaaaggccaguucuggcagccggcgacuccuguccgaagagucaggugaagauuguaucagccgcacccaguuacugagaacugagacagcugagauucauggggacaauuacggcggacccggcgauaaaaucaccauuugcaacgggucuacuauaguggaccaaaggcuaggauccgaacucgguuguuauaccaucaaucgggucaagaguuucaaacugugcgagaacagcgccacaggcaagucuugcgaaauugauaauacgccagugaaauguaagcagggguuuugccuuaagaucacccaggagggacgcggccacguuaaauuguccagagacucagaggugguacuggaugcaugugacaguagcugcgaaaucaugauuccuaaggguacuggggauauacucgucgacuguucgggcggacagcaacauuuccugaaagauaaccuuaucgaccugggcugccccaauauuccauugcucgggaagauggccaucuacauuuguaggauguccaaccacccgaaaacaaccauggcuuuucuguucugguuuucuuucggauaugugaucacaugcauauuauguaagguuaucuuuuaccugcuaauuguggucgguacucucggcaagaaauucaagcaguaucgugagcugaaaccucagaccugcacgaucugugaaacaacccccgugaacgcgauugacgcagagaugcaugaucuuaauugcagcuacaacaucugcccauauugugccucacgguugacuuccgacgggcuggcucgacacguaaugcagugccccaagagaaaagaaaagauagaggagaccgaacucuaccugaauuuagagaggauuccuugggugguucgcaagcugcuucaagucuccgaaucuacaggaguggccuugaaacggagcuccuggcucaucgugcugcuaguccugcucacuguuucacugagcccagugcagagugcacccauuggccacgguaagaccaucgagacauaccagacgagagaaggguauaccucuauaugucuuuuuguguugggcuccauccuguucauuguaagccauuuaaugaaaggacucgucgauucggugggcaacucauuuuucccugggcugucuaucugcaagacuuguaguauuggauccaucaauggcuuugagauagagagccacaaaugcuucuguucucuuuucugcuguccguacugcaggcauuguagcgccgacaaggaaauucacaaacugcacuuguccaucugcaagaagcgcaaagcugguucaaacguuaugcucgccgugugcaagcgaauguguuuucgggcaacaauggaggucaguaauaaagcgcugcuaauccguagcgugauuaacaccacuuucguugugugcauccugauucucgcuguaugugucgugucuacauccgccguggaaauggagucacugccagcagggaccugggaaagagaggaggaucuuacgaauuuuugccaucaagaaugucaggucacugagaccgaaugcuugugucccuaugaggcccugguuuuaaggaagccucucuuccuggacaguauagcuaaaggaaugaagaaccuucugaauagcacaucccuagagaccucucucucgaucgaagccccauggggcgcaauuaacgugcagagcacuuuuaagcccacaguaucaaccgcuaauaucgcccuguccuggaguucuguggagcaccgcgguaacaaaauuuuggucagcggccgguccgaaucaaucaugaagcuggaggaaagaacagggauaucuugggauuuaggaguggaggacgcgagcgagaguaaacuccugacuguuuccgugauggaucuuagccagauguacucuccugucuucgaauaucugucaggcgacaggcaaguggaggaauggccgaaggcuaccugcacgggggauugucccgagcgaugcggauguacauccaguaccugcuugcauaaagaauggccacacagccgcaauuggcggugcaacccuacuugguguuggggcguugguaccgggugcacauguugcggacucgacgugaaggaucuguuuacugacuacauguucgucaaguggaaaguagaguauaucaagaccgaggccauuguguguguugaacuaacgucgcaggagagacagugcucucugaucgaagcaggcacaagguuuaaccuuggucccgugaccauuacucucuccgagccacguaauauccagcaaaaacugccucccgaaauagucacauugcauccacgcauugaggagggcuucuuugaccugaugcacgugcagaagguauuaagcgccucaaccguguguaaacuccagaguugcacucacggggucccgggagaucugcagguuuaccauaucggcaaccuucugaagggggacaaggugaauggacacuugauccauaaaguggaaccucacuucaacacaucuuggauguccugggauggcugugaccucgauuacuauugcaauaugggugacuggcccagcuguaccuacacgggggucacucaacauaaccacgcugccuuugugaaucugcuaaacauugagaccgauuauacaaagaauuuccacuuccauucaaaacggguuaccgcacacggagacacaccacagcuggaucuuaaggcgagacccaacuacggcgccggugaaguaacugugcucgucgagguggcugacauggagcugcauaccaaaaagauagaaaucaguggcuugaaauuugccagcuuaacgugcacagggugcuaugcauguuccucuggaauuagcugcaagguuaggauccacguggaugagccugacgaacugacuguccacgugaaguccgaggauccagacauuguagcugccucaucuagucucauggcacgaaaacuggaguucggcaccgacucgacauuuaaggccuucagcgcuaugcccaaaaccucccuuuguuuuuacaucgucgaacgggaguauugcaagucuuguucaaaagaagauacucagaagugcgugaaugcgaagcuggagcgcccucaaagcauauugaucgaacauaaagggaccauuaucggaaagcagaacgacacauguacggccaaagcauccugcuggcuagagaguguuaagucuuucuuuuacggccugaaaaauaugcucagcgguauuuucgggaacguguuuaucggaauauuccuguuucuugcuccguucauuuuacugauccucuucuuuauguucggcuggagaaucuuguuuuguuucaagugcuguaggcggacucgaggccuguuuaaguacagacaccucaaagaugacgaagagaccggguaucgcaagauuaucgagaggcugaauaacaaaaagggaaagaacaaacuucuggauggugaacguuuggccgaccggaagauagccgagcuauucucaacaaaaacccauauuggcuga

SEQ ID NO: 10344 - RNA, 5064 nt, Artificial Sequence
  derived and/or modified CDS sequence (opt3) from CCHFV(3820-ST-2007)__KR814868.1__GP
augcccaucaacauuaugcacacccugcucgugugcuucauacuuuaccugcaguugagcggcuuagggggagcccauggucaauccaaugcuacagagcacaacggcacuaauacgaccacagucccugggacuucucagucaccaaagccgcccgcaaguaccacacugccucauaccccagaaagcuccacuguuaaacuaacaacccccacgucugagacugaaggaucgggcgagaccacaccuccaaacacuacccagggucucccccugccugggacaaccccagaaagaucagccacgacugcgacaagcaccaguuccacugacaauaugaacucuacaacccaggugacggauaauaccccgacaagcacuguauccaucucacccaguucaucuuccucaaugccuagcaccagucaagggauucaccauccagugaggucucuucuguccgucagcucgcccaagacagugacuaccccuacaccaaugucucccggcgagauguccccggagaccucaagucagcacagcgcuaugucccggguuccuacuuuguauacggccacacagaucucuaccgaaaacacugaccgcagcacuccccgacagucagagaguuccgugcaaccagcaacacagagcccuauuaccucucccgcccagacuauccuccugaugucagcugcaccaaaagccauacaggauaugcaccccaguccuacaaaucguagcaagagaaaccuggaagucgagaucauucucacguuaucccaaggccugaaaaaguacuaugggaagauccuuaaauugcugcaucuaacccucgaggaagacacugagggacugcuugaaugguguaagaggaaucuggguucuaacugcgaugacgacuuuuuccagaaacggauugaggaauuuuucaucacaggcgagggguacuuuaaugagguguugcaguucaagacccucucgacacugagcccaacugaaccgucccacguacgcuuacccaccgcugagccuuuuaaaucauauuucgccaagggauuucugaguauagauucuggcuacuucagcgcgaaguguuauccaagauccucaacgagcggucuccaacuuauuaacguuacccagcaucccgcaaggaucgccgaaacaccugggccaaaaacuaccucucugaagacaauuaauugcaucaacuugcgggcuuccguguuuaaagagcaccgcgaagucgagaucaacgugcuacugccccagauugccgugaaucucaguaacugucacgucguuauaaauagccaugugugcgauuacucucuggacacugauggaccgguacgacuuccuagaauccaccaugagggcaccuucauuccaggcacguacaagaucgugauagacaggaaaaacaagcugaaugaucgguguuccuuggucacaaacugcgugauuaaagggcgugaaguucgcaagggacagucagugcucagacaauauaagaccgagaucaaaaucgguaagaccaguacaggcagcaggaaacuguuaucggaggaacccggggacgacuguauuucccggacccagcugcuaaagacugaaaccgcagagauccacgaugacaauuacggaucuccuggcgauaaaauuacaauaugcaacgguagcacgaucgucgaccagcgacucgggucagagcugggcuguuauaccauuaaucgcgugaagaguuuuaaacuuugcgaaaacuccgcuacuggaaaaacaugcgagaucgauucuacccccguaaaguguagacagggcuucugcuugaaaaucacacaagaagggaggggacauguuaagcugagccgggguuccgaggugguccucgacgccugugauucaagcugcgagauuaugauaccaaaaggcacuggggacauccugguggauuguaguggaggccagcagcacuuccuuaaggacaaucugauugauuuggguugcccucacaucccccuccuggggaagauggcgauuuacaucugucgcaugucuaaccauccaagaaccacgauggccuuuuuauucugguuuuccuucggcuaugucauaacaugcaucuuuuguaaagcacuguucuacagccuaauuaucauuggaacccucggcaagaaaaucaagcaguauagggaacugaaaccgcaaacuugcaccauaugugagacagcuccugugaaugccauugacgcugaaaugcacgaccuuaacugcucguacaauaucugccccuacugugccucacguuugacuucugaugggcuggcacggcauguuacccagugcccaaagcgaaaggagaaaguggaagagacagagcucuaucugaacuuagaaaggauucccuggaucguaagaaagcugcuucaggucagugaguccacgggaguggccuugaaacgcagcucuuggcucauaguucugcuagugcugcucgcugucagccuguccccugugcagucagcgccaguaggucacggcaagaccaucgaaacuuaccaaacacgggagggguuuaccaguauuugucuuuucauguugggaagcauccuguuuauugugucuugcuuaguuaaaggccucgucgacuccgugucagauaguuucuuucccggucugagcguguguaagacuugcuccaucgggucuauaaacggcuucgaaauugagucgcacaaauguuauugcagccuauuuuguugcccuuacuguagacauugcucagcagacagggagauccaccagcugcauuuguccaucugcaagaagcgcaaaacaggaaguaaugucaugcucgccguuuguaagcgaaugugcuucaaagcuaccauugaagccucucggcgugcacugcuaaucagaagcauuauaaacacgacuuucgugauguguauccugacccucgccauuugcgugguauccacaucagcugucgagauggaagaucugccggccggcaccugggagagggaagaggaccuuacuaauuuuugucaccaggagugccaagugacagaaaccgaguguuugugcccauaugaagcacugguuuuacgcaagccccucuuccuggauucuaucgugaaagggaugaagaaccuucugaauagcacaagucuagagacuucccucagcauugaggcgccuuggggagcuaucaacguccagucuaccuuuaagccaacggugucaacagccaauauagcacuguccuggaguagcguugaacaucggggcaacaaaaucuuggugaccgguagaucggagucuauuaugaagcuggaagagaggacugggguauccugggacuuaggagucgaagaugccagcgagucaaaacuccugaccgugaguaucauggaccuuucucagauguacucccccguguucgaguaucugagcggcgaucgacaggucgaagaguggccuaaggcuacauguacuggugacugcccggaacgcuguggcugcaccucaaguacgugcuugcacaaagaguggccccacagccggaauuggagauguaacccaacauggugcuggggaguuggaaccggcuguacuugcugugggguggauguaaaggaccucuuuacagaccauauguucauuaaguggaaaguggaauacaucaagaccgaggccauagucugcguggagcugacuucccaagaaaggcaguguucucuaauugaggcaggaacacguuuuaaucugggcccuguuaccaucacgcuuagcgaaccccgcaacauccagcagaaacucccaccugagauuauaacucugcaccccaagaucgaagaggguuucuuugauuugaugcaugugcaaaaaguccuguccgcuucaaccgugugcaaguuacagucuuguacacacgggauuccaggagaccuccagaucuaccauauuggcaaucugcuuaagggugaucggguuaacggccaccugauccacaaaauagagccgcauuucaauaccaguuggaugucgugggacgggugcgauuuggacuauuacuguaacaugggagauuggccuagcugcacauauacuggcgugacccagcacaaccaugccgcguuugucaaucuccugaacaucgaaacggacuacacaaagacuuuccacuuucacuccaaaagaguaaccgcccauggggauacaccccaacuagaccugaaggcuaggccaaccuauggagcaggcgagauuacugugcuuguugaaguggccgauauggagcuccacaccaaaaaggucgagaucucuggucugaaauucgcuucauugacaugcacgggguguuacgccugcagcuccggaauuaguuguaaggugcgaauccauguagacgaacccgaugaguuaacugugcacgucaagucuagcgacccugacguuguggcagcgucaaccucccugauggcccggaaacucgaguucggcacagauaguaccuuuaaggcuuucagcgccaugccaaaaacuucucugugcuuuuauauaguggaacgcgaauacuguaaguccugcucagaggacgauacaaagaagugugucgacaccaaacuugagcagccccagagcauucugaucgaacauaaagguacgaucauuggcaagcaaaaugauacuugcacagcaaaggcuucguguugguuggagucugugaagaguuucuuuuacgggcuuaaaaacaugcugggauccguuuucggcagcuuuuucguagggauccuccuguuucuugccccuuucguguuacugguccucuuuuucauguucggauggaagauauuguuuugcuucaaguguugcagaaggacccggggccuguuuaaauaucgacaccucaaggacgaugaagagaccgguuacagacgcauuaucgaaaggcugaauagcaaaaaggggaaaaaccgucuucuggacggagagcgguuggcagauagaaagauugccgagcuauucuccacuaagacacacaucggcuga

SEQ ID NO: 10345 - RNA, 5058 nt, Artificial Sequence
  derived and/or modified CDS sequence (opt3) from CCHFV(SR3)__AJ538199.1__GP
augcacaucagccugauguacgccguguucugccuccagcuuuguggccuggggaagaccaacggaccccauaaugguacagagcacaacaauacucaugucaugacgaccccugacgauucccaaucuccagaaccgcccguuucaacagcuuugccugugacuccagaccccaguaccguaacaccuagcaccccagcauccggcuuagaggggucuggagaaguguauacuucgucacccauuacaaccaaaggccugagccuaccugaggccacgagugaaccaccggcgacuaccuccgucgugacaucuagcgcuuccgauacugacucaaguacccaggccgccggugauacacccaccccuacgguuagaacuagccucccaucuucccccucaacaccuagcaccagucaggggacucacuacccagugaggucucugcuuuccgucacaagccccaagccggaggagaccccuacgcccucgaaaucuggaaaggacgaucuggcaaccaacuccccacauccugcuacaucacggcccacuaccccacccacaacugcacagaaaccuaccgaaaauaacagucacaauacaaccgagcaauuggaaagccucacucaccuggccacgcugggccucaugauauccccaacacagaccguguuaccgcagucuguaacuagcaucgcuauucaggacauccauaacucacccaccaaucgcaguaagcgaaaccuggauauggagauuauccuuacauugucccaaggccugaagaaauauuacgggaagauacuaaaacuccugcaccuuacccuggaggaagacacugagggauugcucgaauggugcaagcguaaucuggguuuagauugugacgauacauuuuuccagaaaagaaucgaggaauuuuucauuacgggcgaggggcauuuuaacgagguucugcaguucaggacccucggaacucuuagcacaaccgaaucuacacacgccggcucaccuacuguggagccauuuaagaguuauuucgcgaaggguuuucugagcaucgacuccggguacuucucugcaaaaugcuauucgcggaccagcaauuccggauugcagcuaauuaacgucacgcgccacucaaccagaaucgccgacacacccggcccuaagauaacuaaucugaaaaccauuaacuguaugaaccucaaggcuaguguguuuaaagaacauagggagguggaaaucaauguccugcuuccacaaguugccgugaaccugucuaauugccacguagcaauuaagagccauaucugugauuacuccuuggacacagauggcgcuauccggcucccccagauucaccaugaggggacuuucauaccgggaaccuacaaaaucgugauugacaagaagucacgccugaacgaucgaugcacguuauuuacaaauugugucaucaaagguagagaggugaggaagggccagagcguucugcggcaauauaaaaccgaaauacguauugggcgcgccucuacuggauccagaaggcuacucagugaggaaagcggcgacgauugcaucucucggacacagcugcuucgaaccgagacugcggaagugcacggugacaacuacgggggcccuggagauaagaucaccauuuguaauggcuccacagucguggaccagcgcuuggggucagagcugggaugcuauacgaucaacagaguaaggaguuucaaacucugcgagaauagcgccaccgguaagucgugugaaauugauuccauaccaguuaagugcaaacagggcuacugucugaagaucacucaagaggggcggggacacgugaaacuuucucgcggcagcgaagucgugcuggacgucugcgacucaaguugugaggugaugauucccaaggguacaggggauaucuugguugacugcuccggcggacagcagcauuuccucaaagauaaccugguggacuuaggcuguccuaagaucccccugcuagggaagauggcaauuuauauaugcagaaugucuaaucacccaaaaaccacaauggcuuuucucuucugguuuagcuucggauacguaaucacuuguauucugugcaaggccaucuuuuuccuuuugauuaucuuugguacccugggcaaaagguucaagcaguaucgugagcucaaaccucaaacguguacaauaugcgaaaccacucccgucaacgcuaucgaugccgagaugcaugaccugaauugcuccuacaacauuuguccauacugcgcaucacgguuaaccagcgaugggcuggcccgacacgugacacaguguccgagaaggaaggaaaagguugaggaaacugagcuuuauuugaaucucgagcgcaucccuugggugguccggaaacugcuacaggugagugaaucuaccggaacaguacugaagagauccagcuggcucauugugcugcuuguuuuguuuacggucucgcugucacccgugcagucugcuccaaucggccacgguaaaaccauagagacuuacagggugcgcgaagaguauacaaguauuugcuuauucguccucggguccauccuguuuauuguuagcuuccuuaugaagggccugguggacggagugggcaacaucuuuuuccccggguugucuguauguaaaaccugcagcauaggauccaucaacggcuucgaaauugagucacauaaguguuacugcagucucuuuuguugcccuuauugucgacacugcagcgcggauggugagauccaucaacugcaccuaucuauuugcaaaaagcggaagacuggguccaaugucaugcuggcaguguguaaacguaugugcuucagagccacaauggaaguuucaaacaaggcucucuuuaucaggaguauaauuaauaccacguucgugauguguauccugaaaggagaguuugccgcagucaagagcauccauccaauugaaauggagucccuucccgccggcacuugggaacgcgaggaggacuugaccaacuucugccaccaggaaugucaggugacagagaccgaaugccuguguccuuacgaggcuuuaguucuccggagaccgcuguuucuugauucuaucgugaaagguaugaagaaucugcuaaacucgacuagccucgagacaucacuguccauugaagccccauggggcgcaauaaauguacagaguaccuauaagcccacagucucuacugcgaacaucgcuuugagcugguccucaguggagcacagggggaauaaagugcuggucucuggacgaagcgaaaguauuaugaaguuagaggaacgcaccggcaucuccugggaccucgggguugaggaugccagcgagucuaaacugcuuacggugucaguaauggaccugucccaaauguacaguccuguguucgaauacuugagcggagaccggcaggucgaggaauggccaaaggcaacaugcaccggcgauugucccgagagaugcgguuguacuucgucuaccugccuccauaaagaauggccucacuccaggaacuggcguugcaauccgacaugguguuggggagugggaacuggcugcaccuguugcggucuggacguuaaggaucuauuuacggacuauauguucgugaaguggaaagucgaguacauuaagacagaggccaucguguguguugaacugaccagccaggagcgccaaugcucacuuauagaagcuggcacucgguuuaaccucgggagugugacaaucacccugucugagcccagaaauauucagcagaaauugccaccugaaaucauuacucugcaucccaagaucgaggagggauucuuugauuuaaugcacguccagaaaguacucuccgccagcacaguguguaagcugcaaucaugcacccauggcguuccaggggaccuucagguguaucacauaggaaaccuguugaagggcgauagggucaauggucaccucauucauaaaaucgaacagcacuucaacacgaguuggaugagcugggacgggugugaucuggacuacuauugcaacaugggagauuggccuuccuguacuuacaccggcgugacacagcauaaucacgcaucuuucguaaaccuacugaauaucgagaccgacuauacaaagacuuuucacuuccauagcaaacgagugaccgcucacggugauacgccccaacuugaccucaaggcccggccaacauacggcgcgggggaaauuacuguccugguugagguggccgacauggaguugcauaccaaaaagauagaaaucuccggauuaaaauuugcuggccugacaugcaccgggugcuacgcauguucaucuggaauuaguugcaaggugcgcauccacgucgaugagccggacgaacucacugugcauguuaagucggaugacccugauguaguggccgcuagcuccucucugauggccagaaaacuugaguucggcaccgacucaacauuuaaggcauucagcgcgaugcccaaaacgucccuguguuuuuauauugucgaaagggaguacugcaagaguuguaacaaagaggauacucagaagugcgugaauaccaaguuggaacagccacagucuauccuaauagagcacaaagguacaaucauugggaagcaaaacaauaccuguacugccaaagcuagcugcuggcuggaaucaguuaaguccuucuuuuauggacucaaaaacaugcugggcggcaucuucgggaauguguuuauuggaaucuucacauuccuuacccccuuuauauuacugauucucuucuuuauguucgguuggcggaucuuguuuuguuucaagugcugucgaagaacgcgcggccuguuuaaguacaggcaccucaaagacgaugaggaaacuggguaucguaagaucauugagcggcugaacaauaaaaaggggaaaaacagacuucuggacggcgagagguuggccgaucgcaagaucgcagaacuauucaguacaaagacccauauagguuga

SEQ ID NO: 10346 - RNA, 5055 nt, Artificial Sequence
  derived and/or modified CDS sequence (opt3) from CCHFV(SPU 187/90)__KJ682814.1__GP
augcacaucagccugauguacgccgugcucugccuucagcuguguuccuugggcgagacccauagaucucacaacgaaauugggcauaauaagacagacgucaugacuacgcccggagauaacuuaucaagugagcaaccuguuagcaccgcucuguccauaacaccagacccgucuacugugacccccacaaccccugcaucggguucagaaggcagcggggagguauauacaaguuccccaaucacuaccgaaucucuaagccuccccgagacgacuccugagcugccagccaccacaggaauugauuccucaagugcgagcggcguggacucuuccacucaggcugccggugggaccucagcacuuacagucaggaccagccugcccaauaguccuucuacgccauccacuccgcaggauacauaccaccccgugcggaucuugcucagcguuaccggaccuggcccagaagagacuucgacacccucuggcuccgggaaagaaucaagugccaccagcucccugcauccuauuucugaccgccugccaacgcccccggcuaccgcacagggaccuacagagaacaauagccacaacgccacugagcaccccaagccacucacccaaucagcuacaccugguuuaaugaccagucccacucagaucgugcauccacaguccgccacaagcauaaccguccaggauacuuaucccucuccuaaaaaucgaucaaagcguaaccuggaaauggagaucauucuuacguugagucaaggccugaaaaaguacuaugggaagauccuaagacuccugaggcuuacacuggaagaggacaccgaaggauugcucgaguggugcaaacggaaucugggcuuagauugugacgauacuuucuuucagaagcgcauugaggaguucuuuaucaccggugaagggcacuucaacgaagugcugcaguuuaaaacaccaggaacccucagcacuacagaguccacgccggcggaacuucccaccgcagagccuuucaagucuuacuuugccaaaggcuuccugucgauagacagcggcuauuacuccgcuaagugcuacucagggacaaguaauucuggauugcagcuaauuaacaucacuagacauagcaccaggauuguagauacaccaggucccaagaucacuaaucugaaaaccaucaacuguauuaaucucaaggccuccauauuuaaagagcaccgggaaguugagaucaacgugcugcuuccucaaauugcagucaaccugucaaauugccacguggugaucaagagccaugucugugacuauucuuuggacauagauggcacgguucgccucccacacauuuaccaugaagggguguucauccccggaaccuauaaaaucguaauugacaagaaaaacaagcugaaugaucgaugcacauuauuuacuaacugugugaucaagggcagagaggucaggaaaggucaguccgugcugcggcaguacaagaccgaaauucguauagggaaagcuaguacaggcagccgcagacuacucucugaggagccguccgacgauugcaucucaaggacucaacugcuucggaccgaaacggccgagauucacggagacaauuauggcgggccuggagauaagaucacaaucuguaacgguaguaccauuguugaccagcgauugggcagcgaacuggggugcuacacuauaaaucgcgugaaaucguucaagcucugcgagaacuccgcgacaggaaagucuugugagaucgauagcgucccagugaaaugcagacagggcuauugucugaggauuacccaggaaggucgggggcauguaaaacuuucacgcggcagugagguugugcuggacgccugcgauacuuccugugaaaucaugauucccaaaggaaccggcgacaucuuggucgacugcucugggggacaacagcacuuucucaaggauaaucugauagacuuagguuguccuaaaaucccccugcuaggcaagauggcaauuuacaucugcagaaugagcaaccacccaaagacaacgauggcuuuccucuucugguuuuccuucggguacgugauuaccuguauccugugcaaagccauauuuuaucuuuugauuaucauuggaacucugggcaagagguucaaacaguaccgugagcucaagccucagacauguaccaucugcgaaacaacucccgucaaugcuauagaugccgagaugcaugaccugaacugcucauauaauaucuguccauacugcgcaagccgguuaaccagugauggucuggcccgacacgugacgcaauguccgaaaagaaaggagaagguugaagagacagaacuuuauuugaaccucgagaggauuccuugggugguacgcaaacugcuacaggucucugaauccaccgggguggcucugaagcggagcucguggcucaucguucugcuuguguuguuuacugucucacugucucccgugcagagugcgccaauuggccauggaaaaaccaucgaggcauacagagccagggagggcuauacauccauaugcuuauucguacucgggagcauucuguuugugguuucuugucuuaugaagggacuggucgacagcgugggcaauuccuucuuucccgguuugucaaucugcaaaacuuguaguaucgggagcauuaacggauucgaaaucgagucucacaagugcuacuguucccucuuuugcuguccuuacugccgccacugcucagcugauaaagaaauucauaagcugcaccuaaguauauguaagaaacgaaagaccggcagcaacgugaugcuggccgucugcaaacggauguguuuccgugcaacaauggagguuuccaauagagcccucuuuaucaggucuauuaucaacacgaccuucgugcugugcauucuuaucuuggcuguguguguagucucgacuagcgccguggaaauggagaaucugccagcagguacaugggagcgcgaagaggacuuaaccaacuucugccaucaggaaugucaaguuacugagacagagugccucugucccuaugaagcgcuggugcuucggagaccucuguuucuagauucaauagucaagggcaugaaaaaucuccugaacuccaccaguuuggagacgucucugagcaucgaagcuccguggggagccauuaaugugcaguccacuuacaagccaaccguuucaacagcaaacaucgccuuaucuuggagcaguguggagcacagggggaauaagauucucguauccggccgaagcgaaucuaucaugaaacuggaggagcgcaccgggauaucaugggaccuuggagucgaagaugcuuccgagaguaagcuguugacugugagcgugauggaccucucgcagauguauucucccgucuucgaauaccuguccggcgaucggcagguugaggaauggccuaaagccacaugcaccggugacuguccagagagaugcgggugcacaagcucaacuugucuacauaaggaguggccccacaguaggaacuggcguugcaauccuaccugguguuggggagugggcacggguugcacauguugcggccuggacguaaaagaucuuuuuaccgacuauauguucgugaaguggaaggucgaauacauuaaaacugaggcaaucguguguguugaacucaccucucaagagcgccagugcucccugaucgaagcugggacacgguuuaacuugggaccggugacuauuacccugagcgagcccagaaauauacagcaaaaguuaccaccugagaucauuacgcuccaccccaggaucgaagagggcuucuuugaucugaugcauguccagaaagugcuuucagccaguacaguuuguaagcugcagagcugcacccacggggugccaggagacuugcaggucuaucauauuggcaaccuccugaaaggugauaagguaaaugggcaccuaauccauaagauagaaccucacuucaacacuuccuggaugucuugggacggaugugaucuggacuacuacugcaacaugggcgauuggcccagcugcacauauaccggugugacucaacacaaucaugcguccuuuguuaaccuucucaauaucgagacagacuacaccaaaaacuuccacuuucauucaaagcgagugacggcccacggcgauacuccacagcuggacuugaaagcucggccgaccuauggggcaggagagauuacagucuuaguggaaguagccgauauggagcugcacaccaagaaaaucgaaauuucuggccucaaguucgcuagucugacauguacugggugcuacgccuguucgagcggaaucuccugcaaagugcgcauacaugucgacgagccugacgaacuuaccguucacgugaagucugaugaccccgauguggucgcagcgucaagcucccugauggccagaaaguuggaguuuggcacggacaguauuuucaaggcuuucucugccaugccaaagacaagccuauguuuuuauaucguggagagggaacauugcaaaucauguuccgaggaagauacuaagaaaugcguuaauaccaagcuggagcagccccagaguauccucauugaacacaaggguacaaucauagggaaacaaaacagcaccuguacugcaaagaccucuugcuggcuggaguccguaaaaucauucuuuuacggacuuaagaauauguuaagcggcauuuucggcaacguguuuaucgggauuuuccuguuucucgcuccuuucaucuugcugauacucuuuuucauguuuggauggcggauucuguucuguuucaaaugcugccgaagaacacgcggucuuuuuaaguauaggcaucugaaggacgaugaggaaacgggcuaccgucggaucaucgagagauugaauaacaaaaaggggaaaaauaagcuacuggacggagaaaggcucgccgaucgccgaauugcagaguuauucucgacuaaaacccacaucggcuga

SEQ ID NO: 10347 - RNA, 5055 nt, Artificial Sequence
  derived and/or modified CDS sequence (opt3) from CCHFV(SPU 48/90)__KJ682813.1__GP
augcacaucagccugauguacgccgugcucugccuucagcuguguggcuugggggagacccauagaucccacaacgaaacaggacauaauaagacugacgucgcuacgacccccggugauaacuuaucuucagagcaacugguuaguacagcacuaagcauuacuccugacccauccaccgugacaccgaccacuucugccucgggccucgaagggucaggagagguauauacaagcagucugauaaccacggaaucccuuucucuguuggagacuacccccaaacucccuacaacuaccggcaucgauacaagcuccgcgucagacguggauaguagcacccaggcugccggugacacgucugcacugacugucaggacauccccacccucaaauccuagcaccccaaguacuccccaggauacacaccauccuaugcggaaccugcucucugugaccuccccagggccggaggaaacgagcacccccucgggaucuggcaaggaguccccugccacaucaaguccacaccccguuagcaaucgcucccagacuccuccagcuaccgcacaaggccccacagaagacaacucuuacaaugccacugagcacccggagcauuuaacccagagcgcuacaucagggcugaugaccaguccuacucagauugugcacccccaguccgccacgagcaucacaguccaagauaccuauccaucuccuacuaaccgaucaaaacguaaucuugaaauggagauuaucuugacccugagucagggacuaaagaaauacuaugguaagauacucagacugcuuaggcugacauuggaagaggacaccgaaggccuccuggaguggugcaagcggaacuuagggcuggauugugacgauacuuucuuucagaaacgcaucgaggaguucuuuauuacaggagagggccauuucaaugaagugcuccaguuuaagacgcccgguacccuuagcacuacagaguccaccccagcggaacccccuacagcagagccauucaaaucuuacuuugccaagggguuccugucgaucgacagcggauauuacuccgcuaaaugcuacucaggcaccaguaacucuggcuugcaacuaauuaauaucaccagacacagcacgaagauagccgacaccccggggcccaagauuacaaaccugaaaacuaucaauuguauuaaccucaaggcauccaucuuuaaagagcacagggaaguagagaucaacguucugcuuccucagguggcugucaaucugucaaacugccauguggugauuaagagccacgucugugauuauccauuggacauagauggaaccguucggcucccccauaucuaccacgaagguguguucauuccuggcacauauaaaaucguaauagacaagaaaacuaagcugaaugaucgcugcaccuuauuuacggacugugugauuaaggggcgagaggucagaaaaggacagucugugcugaggcaauacaagacagaaauccggaucggcaaaaccuccacugguagucgucgccuacucagcgaggagccaucugaugacugcauuuccagaacacagcugcuuaggaccgaaacugccgagauccauggggauaacuauggcggacccggcgacaagauuaccauauguaaugggucaacaaucguugaucagcgguugggaagugaacuggguugcuacacgauuaaccgagugaaaucguucaagcucugcgagaauagcgcgaccggcaaguccugugucaucgacucugugccgguaaaaugccgccagggguauugucugagaaucacucaagagggaaggggccacguuaaacuuagccgggguucagaagugguccuggacgccugcgauacaaguugugagauuaugauaccuaaggggaccggcgacaucuugguggauugcuccggaggccagcagcacuuucucaaggacaaccugauugauuuaggguguccaaaaaucccccugcuaggaaagauggcaauuuacaucugccgcaugucuaaucauccuacaacuaccauggcuuuccucuucugguuuagcuucgguuacgucauaacguguauccugugcaaggccaucuuuuaucuuuugauuauuaucggcacacuggggaaaagauucaggcaguaccgugaacucaagccccaaaccuguacuauaugcgagaccacaccagugaacgcuauugacgccgaaaugcacgaucugaauugcuccuauaacaucuguccuuacugcgcaucacgguuaacuagcgacggacuggcccgacauguuacccagugucccaaaagaaaggagaaaguggaggaaacagagcuuuauuugaaucucgaaaggauuccauggguaguccgcaagcugcuacaggugagugagucuacgggcguugcucugaagcgguccagcuggcucaucgugcugcuugucuuguuuaccgugucgcugucaccgguacagucugcgccuauaggucacgggaaaacuaucgaagcauacagagccagggagggcuauacaaguauuugcuuauucgugcucggauccauccuguuuguugucagcugucuuaugaagcgccugguggauucugugggcaacagcuucuuucccggguuguccauuugcaaaaccuguucaaucaguagcauaaauggauucgagauugaaucucacaagugcuacuguucccucuuuugcuguccauacugccgacauugcucagcugacaaagagauccacaagcugcaucuaaguaucuguaaaaagcggaagacuggcagcaacgucaugcuggccguuugcaaacguauguguuucagagcaacaauggaaguguccgauagggcccucuuuauucgcucuaucauuaacaccacguucgugcugugcauacuuaucuuggcuguaugugucgugucgacuagcgccguugagauggaaaaucugcccgcagguaccugggagcgggaggaagacuuaacaaacuucugccaccaagagugucaggugaccgaaacugagugccucuguccuuaugaggcgcugguccuuagaaagccacuguuuagggauucaauugugaaagggaugaagaaucuacucaacuccacaagucuggaaaccucuuugagcaucgaggcucccuggggagccauuaauguucaguccacauacaaaccuacugugucaaccgcaaacaucgcccugucuuggagcaguguagaacaucgaggcaauaagauauuagucuccggucgcagcgagucuaucaugaagcucgaagaacggacgggcauuucaugggaccuggggguggaggacgcuuccgaaaguaaacuucugacagugagcgucauggauuugucgcagauguauucuccgguuuucgaguaccucuccggagacagacaaguggaagaguggccaaaggccacuugcacuggcgauugucccgaaaggugcgggugcaccagcucaacaugucugcacaaagaguggccucacagucguaacuggcgcugcaauccaacuugguguuggggaguaggcaccgguugcacguguugcgggcuagacgugaaggaucuguuuacagacuauauguucgucaaauggaagguggaguacaucaagaccgaagcaauuguuuguguggagcuuacuucucaggaacggcagugcucccucaucgaggcuggaacaagauuuaaccugggccccgucaccauaacuuugagcgaaccuaggaauauucaacagaaacugccgcccgagaucaucacauuacauccacgaauugaggaagguuucuuugaucucaugcacgugcagaagguucugucagccaguaccguguguaaacuucagagcugcacgcauggcgucccuggggaccugcaaguauaucacauaggaaacuugcucaagggcgauaaagugaaugggcaucugauccacaagauugagccccacuucaacacuuccuggaugucuugggacggaugugaucuagacuacuacugcaauaugggcgauuggccaagcugcaccuauacagguguuacccagcauaaccgggcguccuuugugaaccugcuuaauaucgaaacagacuacacuaagaacuuccacuuucauucaaaacgcgucaccgcccacggggacacgccucagcucgaucugaaggcuagacccacauauggagcaggcgagauuacuguguugguagagguggccgacauggaauuacacaccaaaaagaucgagauaucuggucugaaauucgcuagucucacauguaccggcugcuacgccuguucgagcgggaucuccugcaaggucaggauucauguugaugaaccagacgagcugacugugcacgugaaaucugaugacccggaugucguggcagcgucaagcucccuuauggcccggaagcuggaauuuggaaccgacaguacauucaaggcuuucucugccaugccuaaaacgagcuuguguuuuuauaucguugagaaggaguacugcaaaucauguuccgaagaggauacuaagaaaugcguaaauaccaagcuagaacagccccaaaguauucugaucgagcauaagggcacaauaauugggaaacagaacagcaccuguacugcaaaggugucuugcuggcucgaauccgcuaaaucauucuuuuauggacugaaggacaugcuuagcggcaucuucgguaaugucuuuaucgggauuuucuuauuucuggccccauucauccucuugauacuguuuuucauguuuggauggcgaauccuccuguguuucaaaugcugcagacgcacaaggggccuuuucaaguaccgucaccugaaggaugacgaggagaccggcuaccggagaauuauugaaagguugaacaauaaaaaggggaaaaacaagcuacuggacggagagcgccucgcagaucgaagaaucgccgaauuauuuucgacgaaaacucauauagguuga

SEQ ID NO: 10348 - RNA, 5055 nt, Artificial Sequence
  derived and/or modified CDS sequence (opt3) from CCHFV(Sudan AB1-2009)__HQ378187.1__GP
augcacaucagccugauuuacgccauacucugccuucagcuguguggcuugggggagacccauggaucccacaacgaaacaagacauaauaagacugacacgaucaccacacccggugauaacuuaucuucagagccuagugugagcacugcucuguccauuaccccagacccgucuacagucacccccacuacuccugcaucgggccuagaagggucaggagagguuuauaccagcccacccaucacgacuggcagucucccucugccagguaccacacccgaacuuccugccacuaccgggacagauaccuccucugcgagcgacguggauuccucaacgcaaacugcuggaggcacauucacccugacuguaaggacaaguuugccacggagcccgucuacccccuccacgccucaggacacccaccauccagugcgcaaucuccugucagucacaagccccggcccugaugagacaaguaccccaucugggacaggaaaagagucccccgccacuagcucgccgcacccugugucuaaccgacccccaaccccucccgcaacagcccaggguccaaccgaaaaugacucccacaacgcuacugagcaucccgaaucacugacgcagagugcaacaaccggcccuaugacuagcccaacccaaauuguucacccgcaguccgccacacccaucaccgugcaggauacucauccuucuccaacaaaucguagcaagagaaaccucgagauggagauaaucuuaacgcugucacaggggcuuaaaaaguacuauggaaaaauuuugaggcugcuacaccucacccuggaagaggacacugaaggccuucuggaguggugcaagcggaauuugggucucgauugugacgauacauuuuuccaaaagcgcaucgaagaguuuuucauuaccggggagggacacuuuaacgaaguccugcaguucagaacacccggcacuuuaaguaccacggaguccaccccugcuggccugccaacagccgaacccuuuaaaagcuacuucgcgaagggguuucucucuaucgacucaggauauuacagugcaaaaugcuauagcgguacuuccaauucuggccuucagcugauaaacauuaccaggcauucgacacggaucguggacacuccggggccuaagauuaccaauuugaaaacgaucaacuguaucaaucuaaaggccagcauuuucaaggagcaccgcgaaguagagauaaacguucugcucccacagguggcugucaaccuguccaauugccauguggugaucaaaucacacgucugugauuacagucuugacauugauggagccguucgacugccccauaucuaccacgagggcguguuuauaccugguacauauaagauuguaaucgacaaaaagaacaaauugaaugauagaugcacccucuucacuaacugugugaucaaggggagggaaguccggaaaggccaaucugugcugcgucaguacaagacagagguucgcauuggaaaggcaagcaccggcuccagaagguuacugucagaagaacccagcgacgauugcaucucucggacucagcuacuccgaaccgaaacagcugagauucacggggacaauuauggagguccaggcgauaaaauaacgaucuguaacggguccaccauuguggaccaacgccugggaagugagcuuggcugcuacacuaucaauagagucaagagcuuuaaauugugcgaaaacucugccacagguaagaauugugagaucgauuccgugccuguaaaaugcaggcagggguauugucugcggauuacccaggaaggccgcggacauguuaagcucucaagaggcagugaggugguccuggacgcgugcgacacaagcugugagauaaugauccccaaggggacuggagauauucuuguggacugcucggguggccagcaacacuuccugaaagauaacuugaucgaccucggguguccaaagauuccgcuguuaggaaaaauggccaucuacauaugcaggauguccaaucauccuaagaccacgauggcauuccuguuuugguucucuuuuggcuaucuaaucacauguauucucugcaaagcuaucuucuaccugcuuauuaucauagguaccuuggggaagcgucugaagcaguaccgggaacucaaaccccagacuuguaccauuugcgagacaacuccagucaacgccaucgaugcugaaaugcacgaccugaauugcagcuauaacauuugucccuacugcgccucacgauuaaccagugauggccuggcaagacacgugauccaguguccuaagaggaaagagaagguugaagagacagagcuuuauuugaaucucgaacgcauaccaugggugguacggaaacugcuacaagucuccgagucuacgggaguggcccugaagagaagcuccuggcucaucguucugcuuguguuguuuaccgucucacugagccccgugcagagugcuccuauuggccaggggaagacuaucgaagcguacagggcacgcgagggauauacaucuauuugcuuauucguacucggcuccauccuguuuauagugagcugucuuaugaaaggucugguugacucggucgggaacucauucuuuccgggauugucuauuugcaagaccuguaguaucuccagcaucaacggcuucgaaauugagucucauaaaugcuacuguagccucuuuugcuguccauauugccgacacugcuccacugauaaggagauccauaaacugcaccuaucaauuuguaagaaacggaagacagguaguaaugugaugcuggccgugugcaagcguauguguuucagagcuaccauggaagucagcaacagggcccucuuuauacgcucuaucauuaauacgacuuucguucugugcauccuuauuuuggcagugugugugguauccaccucagccgucgagauggaaaaccugcccgcuggcacaugggagcgggaagaggacuuaaccaauuucugccaucaggagugucaagugacugaaacagagugccucuguccuuacgaagcccugguucuuagaaaaccacuguuucuagauaguaucgcaaaggggaugaaaaaccuccugaauagcaccuccuuggagacaucucugucgauagaggcgcccuggggagcuaucaacgugcagagcacuuacaagccuaccgucucaacggccaauauugcauuauccuggaguucuguggaacacaggggcaacaaaauccucguuagcgggcgauccgagucaauuaugaagcuggaggagcgcacaggaaucucuugggaccuuggcguggaagaugccagcgagaguaagcuguugaccguauccgucauggaccucagccagauguauucuccgguguucgaguaccugucaggugaccgacagguggaagaguggcccaaagcuacuugcaccggggauuguccagaaagaugcggaugcacauccaguacuugucuacacaaggaguggccucauagcaggaauuggcguugcaaccccaccugguguuggggcgucgguacgggcugcacauguugcgggcuggacguuaaagaucuuuuuaccgacuauauguucgugaaguggaaaguagaauacauaaagacugaggccauugugugugucgagcucacaucgcaagaacgccagugcucucugaucgaggcaggaacccgguuuaauuugggcccagugacuaucacacuguccgaaccuagaaacauucagcaaaaguuacccccagagauaaucacccuccacccgaggauugaagagggguucuuugaucugaugcauguucagaaagugcuuagcgcuucaacggucuguaagcugcagaguugcacucacggagugccuggcgacuugcagguuuaucauaucgguaaucuccugaaaggggauaaggugaacggacaccuaauucacaaaaucgagccccauuucaacaccucuuggauguccugggacggcugugaucuggacuacuauugcaauaugggugauuggccaagcugcacauacaccggcgucacacaacacaaccaugccucauuuguaaaucuucucaacauagaaacugacuacaccaagaauuuccacuuucacaguaagcgagugacggcgcauggggauacaccccagcuggacuugaaagcccggccuacuuauggagcuggcgagaucaccguuuuaguggaagucgcagacauggagcugcacacaaagaaaauugagaucagcgggcucaaguucgccucccugaccuguacuggaugcuacgcuuguucuagcggcauuuccugcaaagugcgcauccauguagaugaaccagacgagcuuaccgugcacgucaagucagaugaccccgauguuguggccgcaucuaguucgcugauggcgagaaaauuggaauuugguacagacagcacguucaaggccuucuccgcuaugccuaagacuucucuauguuuuuauauaguggagagggaacauugcaaaucauguaacgaggaggauaccaagaaaugcgucaauacaaagcuggaacagccgcagagcauucucaucgagcacaaagggaccaucauuggaaagcaaaacuccacuuguacagcccgggcaaguugcuggcuggaaucuguuaagagcuucuuuuacggccuuaaaaauauguuaucaggcaucuucgggaacguguuuaugggaauauuccuguuucucgcuccauucauuuugcugauccucuuuuucauguuugguuggcggauucuguucuguuucaagugcugcagacgcaccaggggccuuuuuaaauaucgucaccugaaggacgaugaggaaacgggguaccggagaaucauagagagguugaauaacaaaaagggaaagaauaaacuacuggacggcgagcgccucgccgaucgaagaauugcagaauuauucuccacuaagacacauaucgguuga

SEQ ID NO: 10349 - RNA, 5055 nt, Artificial Sequence
  derived and/or modified CDS sequence (opt3) from CCHFV(Sudan Al-Fulah 9-2008)__HQ378185.1__GP
augcacaucagccugauguacgccgugcucugccuucagcuguguggcuugggggagacccauagaucccacaacgaaacaguccauaauaagacugacauuguuacgacccccucugaugacuuaucaagugagcaacuggugagcacagcucuauccauaacuccugauccaucuaccguaacaccgaccacuucggcaucaggacucgaagguagcggcgagguguauacaaguucccccaucaccacggaaucucugagccagccugagacuaccccaaaacuucccgccacaacugggauugacaccuccucagcgagugaugucgacagcucuacacaggcugccggagauaccuccacgcugacugugaggacaucaccuccaaacagccccaguaccccuucuacuccacaggacacacaccauccgaugcggaauuugcucuccguuaccagccccggcccugaggaaacgucgaccccaucugguuccgggaaggagucaagugcaacaagcucuccccacccuguguccaaccgcccacaaacucccccggccaccgcucagggaccuacagaagauaauagccacaacgcaacugagcaucccgagcaccugacccagucagccacaaguggcccaaugaccuccccuacucagaucguccauccccaaagcgcuacgacaauuaccgugcaggacacuuacccaucucccaccaaucgaucaaaacguaaccuggaaauggagaucauacucacauuaagucagggccugaagaaauauuacgggaagauccuuagauugcugaggcuaacccucgaagaggauacugaaggacugcuugaguggugcaagcggaaucuggguuuggacugugaugacacauucuuucagaaacgcauugaggaguucuuuaucacgggcgaggggcacuucaacgacguacuccaauuuaagaccccuggaacucugagcacaaccgaauccacaccagccaaaccgcccacugcggagccuuucaagucuuauuuugcaaaaggcuucuuaaccauugauucggguuacuauagcgccaagugcuacuccgggacgucaaauaguggacugcagcucaucaacauaaccagacacucuacaaggauuguugacacuccaggccccaagaucaccaaucuuaaaacaauuaacuguaucaaucugaaggcuagcaucuuuaaagaacaucgggagguggagauuaacgucuugcuaccucagguggccgugaaccuguccaauugccacgucguuauaaagucacaugugugugauuacccacucgacaucgauggcacuguacgccugccccacauuuaucaugaagggguguucaucccgggaaccuacaaaauagucauugacaagaaaaacaaacuuaaugaucgaugcacgcuguuuacagacugugugaucaaggguagagagguuaggaagggccaaagcguguugcggcaguauaagaccgaaauccguauugggaaagcaucuacuggaucccgcagacuccugagugaggaaccuagcgaugacugcaucucuaggacacaguuacugcggaccgagacugcugagauucacggcgauaacuacggugggccaggcgacaagauaaccaucuguaauggauccacaauugucgaccagcgacuaggcucagaacucgggugcuauacgaucaaccgcgugaaaaguuucaagcugugcgagaauagcgccaccggaaagucguguguaaucgauuccguucccgugaaaugcagacaagguuacugucuuaggauuacucaggaaggccgggggcacgucaaguugucucgcggaagcgaggugguccuggacgcgugcgauacaucaugugagauaaugaucccuaaaggcaccggugacauucucguggauugcagugggggccagcagcauuuucugaaggacaaccuuguugaucugggaugucccaaaaucccauugcucggcaagauggccauuuauaucugcagaauguccaaucacccuaagacaacuauggcauuccuguucugguuuucuuucggguacgugauaaccuguaucuuaugcaaagcuaucuuuuaccugcuaauuauuaucggaacgcucgguaagagguuccgucaauaucgggaacugaaaccccagacauguaccauaugcgagacuaccccaguaaacgccauugacgcugaaaugcaugaucuuaauugcagcuacaacaucuguccguauugcgccucccgauugacaucagacggccuggcaagacacgucacucaguguccuaagaggaaagagaagguggaagagaccgagcucuaccugaauuuagaacgcauucccuggguugugcggaagcugcuucaggucagcgagaguacagggguggccuugaaaagaucuuccuggcucaucguacugcuagugcuguuuacgguuagccucucgccaguccaaucagcucccauaggacacggcaagaccaucgaagcguauagggcacgcgaggguuacacuucuauuugccuguucgugcuugggaguaucuuguuuauuguguccugucugaugaaaggcuuagucgauagcguuggaaacucuuucuuuccuggccucagcaucugcaagacauguuccauaucaaguauuaauggguucgaaaucgagagccauaaaugcuauuguucucuguuuugcuguccauacugccgacacugcuccgccgacaaggagauccauaaacuucaccugucaauuuguaagaagcggaaaaccggaaguaacgugauguuggcugugugcaagcguauguguuucagagccacuauggaaguaagcaacagggcacucuuuauccgcuccauuauaaauacaaccuucguccugugcauccuaauucuggccguguguguugugucuacgucggcugucgagauggaaaaccuccccgccggcacuugggagcgggaagaggaucugaccaauuucugccaucaggagugucaggugacagaaaccgagugccuuuguccuuacgaagcauugguucugagaaggccguuauuucucgacagcaucgugaaagguaugaagaaccugcuuaauucaacuucccuggagacaagucuaucuauugaggcgccauggggagcuaucaacguacagagcaccuauaaacccacagucuccacugccaauauagcacucucauggucuagcguggaacaccgagggaacaagauccuggugaguggccgcuccgagagcauuaugaaguuggaagaacggaccgguaucucuugggaccugggcgucgaagaugccucagaguccaaauuacucacgguuagugugauggaccugagccaaauguacucgccuguauucgaguaucuuucuggggauagacagguggaagaguggccaaaggcuacaugcaccggagacugucccgaaaggugcggcugcacuuccagcaccugucugcacaaagaguggccucauucacguaauuggcgcugcaacccgacaugguguuggggagucgggacuggcugcaccuguugcgguuuggaugugaaggaccucuuuacggauuacauguucguuaaauggaagguggaauauauuaagacagaggccaucgucuguguggagcugaccagucaggaacggcaaugcucucuaauagaggcagggacuagauuuaaucugggacccguuacaauuacccuuuccgaaccaaggaacauccagcagaaacucccucccgagaucauuacucugcacccacgaauagaagagggcuucuuugacuugaugcaugugcagaagguccugagcgcuucaacaguauguaaauuacaaaguugcacccacggugugccuggcgaucuccagguuuaccauaucgggaaucugcuuaagggagacaaagugaacggccaccugauucacaagaucgagccccauuucaauacgagcuggauguccugggaugggugugacuuggauuauuacugcaacaugggagacuggccaucuugcacuuacaccggcgucacacagcacaaccaugccagcuuugugaaucuccugaacauugaaaccgacuauacaaagaauuuccacuuucacuccaaacggguaacugcgcauggugauaccccgcagcuagaccugaaggcccgcccuacguacggggcuggagagaucacagugcuugucgaaguugcagauauggagcuccacacuaaaaagauagagaucucaggccugaaauucgccucuuugaccuguacagguugcuaugcuuguaguucgggcauuagcugcaaggugagaauccauguggacgaacccgaugaguuaaccguccacgugaaauccgacgauccagacguuguagccgcaucuucaagccugauggcgaggaagcucgaauuugggacugauuccaccuucaaggccuucagugcuaugcccaaaacaucucuguguuuuuacauuguggagaaggaauauugcaaaagcuguucagaggaggacacgaagaaaugcgucaacacuaaacuugaacaaccucaguccauccugauagagcauaagggaaccauuaucggcaagcagaauaguacauguaccgccaaggugagcugcugguuggaaucugcaaaauccuucuuuuacgggcuaaaggauaugcugucaggaaucuucggcaacguuuuuauugguaucuuccucuuucuggcuccauucgugcuuuuaguccuguuuuucauguuuggguggcggauacucuuguguuuccgaugcugcagacgcacuaggggacuguucaaauaucgucaccucaaggacgacgaggaaacaggcuaccggagaauuaucgagaggcugaauaacaagaaaggcaagaauaaacuucuggauggggagcgcuuggccgaccgaaagauugcagaacuauuuagcaccaaaacgcacaucggauga

SEQ ID NO: 10350 - RNA, 5055 nt, Artificial Sequence
  derived and/or modified CDS sequence (opt3) from CCHFV(SPU4/81)__DQ157175.1__GP
augcacaucagccugauguacgccgugcucugccuucagcuguguggcuugggggagacccauggauccuauaacgaaacaggucacaauaagacugacgucaugacgacccccggcgauaacuuaucuucagagcaaccuguuaguacagcucugagcauuacuccagacccguccaccgugacacccaccacuccugcaaaugggcuagaaggaucuggcgagguauacacaucgucaccaauaaccacggaaagccucagucugcccgagacuaccccugagcuuccagccacagcggguaucgauacuuccucugcuagcgacguggauuccucaacccaggccgcagggggaacaagugcccccaccgucagaacgagccugccuaacucuccauccacuccgucaacaccccaggaaacccaucacccugugaggaauuugcucagcguuaccagucugggcccagaggaaacaucuacccccuccggcccugggaaagagagcucggcuacgucuuccccacaucccgugucaaacaagccgccuacucccccagcacgggcccagggaccuacagagaauaacagucacaaugcuacugaacaccccgagccacugacccaaagcgccacacccggucucaugacuuccccuacccaggucgugcauccacagucugcgacaagcauuaccguacaggacacuuauccgucacccacgaaccgcaguaaacgaaauuuagaaacagagaucauucugacccuuucccaaggcuugaagaaauacuaugggaagauccugcgucuacucagacugacucuugaagaggauaccgagggacuguuggaauggugcaagaggaaccucggccuggacugugaugacacauucuuucagaaacggauagaggaguucuuuaucaccggugaagggcacuucaaugaaguuuuacaguuuaagacuccuggaacacugagcacgaccgagucuacuccagcagagcuccccacagccgaaccuuucaaaucauacuuugcuaagggcuuccuuaguauugauagcggcuauuacuccgccaaaugcuacucugggaccucgaacagcggacugcaguugaucaauauuacacgccauuccacuagaaucguggacaccccaggucccaagauaacgaaccuaaagaccauuaacuguaucaaucugaaagcaucaauuuuuaaggagcacagggaagucgagaucaacgugcuccugccgcaagcugccgugaaucuuaguaacugccacgucguuaucaaaucucaugugugugauuauagccuggacauugacggcacaguacgguugccucacauauaccaugaagggguguucaucccaggaacuuauaagauugucaucgauaaaaaggacaaacucaaugaucgcugcacccuguuuacagacugugugauaaagggccgagagguuagaaagggucaguccguguuaaggcaguacaaaacugagauucggaucgggaaggcgucaaucggcagccgucgccugcuaucugaggaacccuccgaugacugcauuaguagaacccaacuccugaggacggaaacagccgagauccacggagauaacuauggcgggccuggagacaaaauuaccauauguaaugguagcacuaucgucgaucagcggcuuggcucugaguuggggugcuacacaauuaaccgagugaaguccuucaaacugugcgaaaauucagcaaccggaaagaguugugagaucgaaagcguacccguuaagugccgccagggcuauugucucagaaucacucaggaggguagggggcaugugaaacugucgcggggcuccgaagucgugcuugacgcuugcgauaccucuugugagauuaugauaccaaagggaacaggcgacauccuggucgacugcagcgggggacaacagcacuuuuugaaagauaaccucauugaccuggguuguccuaagauccccuuacugggcaaaauggccauuuacaucugccgcaugucaaaucacccaaagacgaccauggcuuuccuauucugguuuaguuucggguacgugauaacuuguauccucugcaaggccaucuuuuaucugcuuauuauuaucggaacauugggcaaaagauucaagcaguacagggagcugaaaccgcagaccuguacaauaugcgaaacuaccccuguuaacgcaauugaugccgagaugcaugaccucaauugcuccuauaacaucugucccuacugcgcuucucgucugacgagcgaugguuuagcgcggcacgugacacaauguccaaagcgaaaagaaaagguagaggaaaccgagcuguaucuuaauuuggagaggauucccugggucgugagaaagcuccugcagguuuccgaaucaacugggguggcacuaaaacgcagcaguuggcugaucguccuccuggugcuuuuuaccguaucuuuguccccugugcagagcgccccaauaggccauggaaagacaaucgaggcuuaccgggccagagaaggcuauacuucgauuugccuguucguuuuagggucaauccucuuuauugucucuugucugaugaaaggacuuguggacagugugggcaacuccuucuuucccggucugagcaucugcaagaccuguucuauaagcuccauuaacggguucgagaucgaaucacacaaaugcuacuguaguuuguuuugcuguccuuacugcaggcacugcagcgcagauaaggagauccauaaacuccaccugucuauuuguaagaagcgcaaaacaggauccaaugucaugcuagccguuugcaagcgaauguguuuccgggcuacgauggaggugucaaaccgugcccuguuuaucagaaguauuauaaauaccacuuucgugcucugcauccugauucuugcaguaugugucgugagcacauccgcgguugaaauggagaacuugccggcuggcaccugggaaagggaggaggaccugacuaauuucugccaucaggaaugucaagugacagagaccgaaugcuuauguccauaugaggcccucguccugcgcaaaccccuuuuucuggauucuaucgugaaggguaugaaaaaccuacucaauucgacgagccuggaaacuucauuguccauugaggcaccuuggggcgccaucaacguucagaguaccuacaagccaacagugucuaccgcuaauauagcccugagcugguccucaguagagcaccgggggaacaagaucuuagucucuggaagaagcgaaaguauuaugaaacucgaggaaaggacuggcaucuccugggaccuggggguggaggaugcaagcgaaucuaaacuucugacagugucagucauggacuugucccagauguauagucccguuuucgaguaccucagcggagaucgacagguggaggaauggccuaaggcuaccugcacaggcgacuguccggagcgcugcgguugcacuucgucuaccugucugcauaaggaauggccccacucccggaauuggagaugcaacccaacgugguguuggggaguagggacaggcugcaccuguugcggucuagacgugaaagaucuguuuacugacuauauguucgucaaguggaagguggaguacauuaaaaccgaagccaucguuuguguggagcuuacaagccaagagaggcagugcucacucauagaagcgggcacucguuuuaaucuggggccugucaccauuacguugagugagccccgcaacauccagcaaaagcugccaccugaaaucauuacauuacacccccggauagaggagggauucuuugaucucaugcaugugcagaaaguucugucugccuccaccguguguaaacuucagagcugcacucacggcgucccaggggaccugcagguauaucauaucggaaauuugcucaagggcgauaaggugaacggucaccugauucauaagaucgaaccgcacuucaacacaucauggaugaguugggacgggugugaucuagacuacuacugcaauaugggagauuggccuagcugcaccuauacuggcguuacacaacacaaccaugcuuccuuugugaaucugcuuaacauugagaccgacuacacgaaaaauuuccacuuucauucuaagagagucacugcacacggugauacaccccagcucgaccugaaagccaggccaaccuauggcgcuggggaaaucaccguguugguagagguggccgauauggaauuacacacaaagaaaauagagaucagcggacugaaguucgcaucccucacuuguaccggcugcuacgcguguucaucugggauuaguugcaaaguccgaauccauguugacgagcccgacgaacugacggugcacgugaagucggaugacccugaugucguggccgcuagcuccucucuuauggcccggaagcuggaguuuggaacagacucaacuuucaaagcauucagcgcuaugccaaagaccuccuuguguuuuuauauuguugaacgcgagcauugcaaaaguuguucugaagaggauacaaagaaaugcguaaacaccaagcuagagcagccccagagcauccugauagaacacaagggcacuauuaucgguaaacaaaauucaaccuguacagccaaggcauccugcuggcucgagagugugaaaucuuucuuuuacgggcugaagaacaugcuuagcggaaucuucggcaaugucuuuauuggcaucuucuuauuucuggggccuuucauacucuugauucuguuuuucauguuuggauggagaauccucuucuguuucaaaugcugcaggcggacgcgaggucugcuuaaguauagacaucugaaggaagacgaggaaacuggcuaccgcaggauuaucgagcguuugaacaauaaaaaggggaaaaacaagcuacuggauggagagcggcucgccgacagaaggauagcugaauuauuuuccaccaaaacacacauuggcuga

SEQ ID NO: 10351 - RNA, 5055 nt, Artificial Sequence
  derived and/or modified CDS sequence (opt3) from CCHFV(NIV 11703)__JN572086.1__GP
augcacaccagccugaucuacgugguccucugccuucagcuguguuccuugggcaagacacaugggucucacaacggaacugagcauaauaaaacggacguuaugaccacacccggugauaaccaaucaccugaaccauuagugaguacugcccugccgguaacccccgacccuagcacagugaccccaacugcucccgcauccggccuagaggggucuggagaagucuauacaucgucaagcauuaccacgaagggccucagucugccuaaagccacuuccgagcuucuggcgaccacagguauggugacuucuagcgcuuccgauauagacccaucaacccaggccgcaggggauacacccaccccuacgguuagaacaaguuugccaaauagcccgucuacacccuccaccucacaggacacucaccauccugugaggaaccuccugagcgucacaaguccaaagcccgaagagaccccuacgccaucuaaauccgauaaggacagcucggccaccaauucuccccacccggcugcaucccggcugucaacaccucccacuaccgaucagggaccaacagagaacaauaaccacaauaguacugaacaacucgagagcuuaacccgcuccgccacaucuagcucaauggugagucugacccagacuguacuuccucaguccgcuacgagcaucgccacacaggacacccaucccucuccaacuaaccgaucaaagcguaauuuggaaauggagauuauccugacccuaccccaaggccucaaaaaguacuauggcaaaauucugaaacuucugcacuugacacucgaggaagauaccgaggggcuguuagaauggugcaagagaaaccugggacucgacugugaugacacuuucuuucagaagaggaucgaggaguucuuuauaacaggugagggccauuucaaugagguucuucaguuucgggcgccugggacgcugaguaccacugaaccaacacacgcaggaagcccgaccgccgagcccuucaaguccuacuuugcuaaaggcuucuugucuaucgacucggguuauuuuagcgccaagugcuacucccgcacaucaaacagugggcuacagcugauuaaugugacuagacacucuaccaggaucgcagauacgccuggaccaaaaauuaccaaccucaagacaaucaacuguauaaaucugaaagcuagcgucuucaaggaacaucgggagguggaaauuaacgugcuucugccccaagucgccguuaauuuguccaacugccacguggcgaucaaaucacauguaugugacuauagccucgauacugacggcgccauucgccugccucacauccauuacgagggcaccuuuaucccagggacauacaagauugugauagauaagaaaaauaaguuaaacgaccgaugcacucuguucaccaauugugucaucaaaggaagagaggugaggaagggucagucuguucuacggcaguauaaaacggaaauucguaucggccgcgcauccacagggaguagaaggcuccugagcgaggaaucuggagaugacugcauaucccggacccaacuuuugcgaacugagacagcugaagugcacggcgauaacuacggugggcccggcgacaagauuaccaucuguaauggaucaacugucguggaucagcgccugggcagugagcucgggugcuauaccaucaacagaguaaagagcuuuaaacugugcgaaaauucggccacaggaaaguccugugaaauugacucuaucccgguuaaaugcaggcaggguuacugucuuaagauuacgcaggagggccgggggcacgugaaacugagccgcggaucagaagucguguuggacgcuugcgauaguuccugugaggucaugauaccuaagggcaccggugacauccucguggauugcucugggggccaacagcauuuccugaaggacaacuuaauugaucugggauguccaaaaaucccccuacucggcaagauggccaucuauauuugcagaaugagcaaucacccuaaaacuacaauggcauuccuguuuugguucuccuuuggguacguuauaaccuguauccuuugcaaggugauuuucuauuugcugaucauuuuuggaacacucgguaaaagguucaagcaguaccgugagcugaagccccagacuuguaccaucugcgaaacgacaccaguaaacgccauagacgcugagaugcaugauuuaaauugcucauacaacaucuguccuuauugcgcgagccggcugaccagugacggccuugcacgacacgucacucaaugucccaaaagaaaggaaaaaguggaggaaaccgaguuguaccucaaccuggagaggauuccauggguugugcgcaagcuacugcaggucucugaauccacagggaucgcccucaaacggagcucguggcugauugugcuuuugguacuguuuacugugucaaucaccccgguucagucugcuccuauaggacacggcaagacaauugaggccuauagagcaagggaagaguacacgaguaucugcuuauucguccucgguuccgugcuguuuguggucagcugucuuaugaaagggcugguugauucugugggcaauauuuucuuucccggauuguucaucugcaagaccuguagcauaggcuccaucaacggguuugaaauugagucacauaagugcuauuguagucucuucugcuguccauacugccgccacugcagcgccgaccgagagauccaucagcugcaccuaucuauuuguaaaaagcggaaaacuggauccaaugugaugcuggcuguaugcaagcguauguguuucagaacaaccauggaagucucaaacaaagcccucuuugugaggaguaucauaaauacuacauucguugugugcauucugauccuugcagucugugugguuagcaccuccgcgguggagauggaaucuuugcccgcuggcacgugggagcgcgaagaggaucugacuaacuuuugccaucaagagugucagguaaccgaaacagagugcuuauguccuuaugaagcccucguccugcggagaccacuuuuccuggacucgaucgugaaggguaugaagaaucuacucaacagcaccucacuggagacuuccuugaguauugaggcacccuggggagccaucaaugugcagucuacauacaaaccuaccgucagcgcugccaacauugcacuguccuggucaucuguugaacacagggggaauaagauauuagugagcggccgaagugaguccaucaugaaacucgaggaacgcacagguauuagcugggaucugggcguagaagacgcuucugagucaaaacuucugacuguguccgucauggacuugagucagauguacagcccgguguuugaguaucucucgggggaucggcaaguugaagaguggccaaaggcaaccugcacgggagacugucccgaaagaugcggcugcacaucuuccaccugucugcacaaggaguggccucauagcaggaacuggcguugcaauccaacuugguguuggggaguggggaccggcugcacauguugcggucuagaugucaaggaccuguucacugauuacauguuugugaaauggaagguugaauauaucaaaaccgaggcgauugugugugucgagcuuacgucacaggaacgccagugcagucucaucgaggccgggacacgguucaaccugggaucuguaaccauaacuuuguccgaacccagaaauauccaacagaagcugccuccggagauuaucacauuacaccccaggauugaagagggcuuuuucgaccucaugcaugugcagaaaguucugagcgcuucaaccguguguaaacuucagaguugcacucacggugucccaggcgaucugcaaguguaccauaucgggaacuugcucaagggagaccgaguaaacggccaccugauacacaagauugagcagcaucuaaauacaagcuggauguccugggaugggugugaccuggauuauuacugcaacaugggagacuggccuucuugcaccuauacgggcgugacucagcacaaucaugccagcuuugucaaccuucucaauaucgaaaccgauuacacaaagaccuuccacuuucacuccaaacggguuacagcccauggugacacuccccagcuggacuugaaggcucgcccaaccuacggggccggagagaucacgguguuaguggaagucgcagauauggagcugcacacuaaaaagauugagauaucaggccucaaauucgcgucucugaguuguacugguugcuaugccuguucgagcggcaucuccugcaaggugaggauucauguugacgaaccugaugagcuuaccguacacgugaagucugacgaucccgacgucguggcugccucaagcucccugauggcaagaaaauuggaaagugggacagauucuaccuucaaggcuuuuagcgccaugccaaaaacuucacuauguuucuacaucguugagcgggaauauugcaagggauguuccaaagaggacacccaaaagugcgugaacacaaagcuggagcagccgcagaguauucucaucgaacauaaaggcacgauaaucgggaagcagaauaacacuuguaccgcaaaagccagcugcuggcuggagucugucaaguccuuuuucuacggacuuaaaaauauguuaucaggcauuuuugguaacguguuccuggggaucuuuagcuuccucgcuccuuuuguauugcugauucucuucuuuauguucggauggcgaauccuguucuguuuuaagugcugcagacgcacaaggggccuuuucaaguaucgucaccugaaagaugacgaagagaccggcuaccggaagauaauugaaagauugaauaacaaaaaggggaaaaauaagcuacuggauggagagaggcucgcggaccgcaagaucgccgaguuauuuucgacuaaaacacacaucgguuga

SEQ ID NO: 10352 - RNA, 5055 nt, Artificial Sequence
  derived and/or modified CDS sequence (opt3) from CCHFV(NIV 112143)__JN572085.1__GP
augcacaccagccugaucuacgugguccucugccuucagcuguguuccuugggcaagacacaugggucucacaacggaacugagcauaauaaaacggacguuaugaccacacccggugauaaccaaucaccugaaccauuagugaguacugcccugccgguaacccccgacccuagcacaauuaccccaacugcucccgcauccggccuagaggggucuggagaaguguauacaucgucaagcauaaccacgaagggccucagucugccuaaagccacuuccgagcuucuggcgaccacagguauggucacuucuagcgcuuccgauaucgacccaucaacccaggccgcaggggauacacccaccccuacggugagaacaaguuugccaaauagcccgucuacucccuccaccucacaggacacucaccauccuguuaggaaccuccugagcgugacaaguccaaagcccgaagagaccccuacgccaucuaaauccgauaaggacagcucggccaccaauucuccccacccggcugcaucccggcugucaacaccucccacuaccgaucagggaccaacagagaacaauaaccacaauaguacugaacaacucgagagcuuaacccgcuccgccacaucuagcucaauggucagucugacccagacugugcuuccucaguccgcuacgagcauugccacacaggacacccaucccucuccaacuaaccgaucaaagcguaauuuggaaauggagaucauucugacccuaccccaaggccucaaaaaguacuauggcaaaauccugaagcugcugcacuugacacucgaggaagauaccgaggggcuguuagaauggugcaaaagaaaccugggacucgacugugaugacacuuucuuucagaagaggauagaggaguucuuuaucacaggugagggccauuucaaugagguacuucaguuucgggcgccugggacgcugaguaccacugaaccaacacacgcaggaagcccgaccgccgagcccuucaaguccuacuuugcuaaaggcuucuugucuauugacucggguuauuuuagcgccaagugcuacucccgcacaucaaacagugggcuacagcugaucaauguuacuagacacucuaccaggauugcagauacgccuggaccaaaaaucaccaaccucaagacaauaaacuguauuaaucugaaagcuagcguguucaaggaacaucgggaggucgaaaucaacgugcuucugccccaaguggccgucaauuuguccaacugccacguugcgauuaaaucacaugugugugacuauagccucgauacugacggcgccauccgccugccucacauccauuacgagggcaccuuuauuccagggacauacaagauaguaaucgauaagaaaaauaaguuaaacgaccgaugcacucuguucaccaauugugugauuaaaggaagagaggucaggaagggucagucugugcuacggcaguauaaaacggaaauccguauaggccgcgcauccacagggaguagaaggcuccugagcgaggaaucuggagaugacugcauuucccggacccaacuuuugcgaacugagacagcugaaguucacggcgauaacuacggugggcccggcgacaagaucaccaucuguaauggaucaacuguggucgaucagcgccugggcagugagcucgggugcuauaccauuaacagaguaaagagcuuuaaacugugcgaaaauucggccacaggaaaguccugugaaaucgacucuauuccggugaaaugcaggcaggguuacugucuuaagauaacgcaggagggccgggggcacguuaaacugagccgcggaucagaaguggucuuggacgcuugcgauaguuccugugaggugaugaucccuaagggcaccggugacauucucgucgauugcucugggggccaacagcauuuccugaaggacaacuuaaucgaucugggauguccaaaaaucccccuacucggcaagauggccauuuauauaugcagaaugagcaaucacccuaaaacuacaauggcauuccuguuuugguucuccuuuggguacgugaucaccuguauucuuugcaagguuaucuucuauuugcugauuaucuuuggaacacucgguaaaagguucaagcaguaccgugagcugaagccccagacuuguaccauaugcgaaacgacaccagugaacgccaucgacgcugagaugcaugauuuaaauugcucauacaacauuuguccuuauugcgcgagccggcugaccagugacggccuugcacgacacguaacucaaugucccaaaagaaaggaaaaagucgaggaaaccgaguuguaccucaaccuggagaggaucccaugggugguucgcaagcuacuucaggugucugaauccacagggauugcccucaaacggagcucguggcugaucguccuuuuggugcuguuuacuguaucaauaaccccggugcagucugcuccuauuggacacggcaagacaaucgaggccuauagagcaagggaagaguacacgaguauuugcuuauucguucucgguuccguccuguuuguggugagcugucuuaugaaagggcuggucgauucuguuggcaauaucuucuuucccggauuguucauaugcaagaccuguagcaucggcuccauuaacggguuugaaaucgagucacauaagugcuauuguagucucuucugcuguccauacugccgccacugcagcgccgaccgagagauucaucagcugcaccuaucuaucuguaaaaagcggaaaacuggauccaaugugaugcuggcugugugcaagcguauguguuucagagccacaauggaaguaucaaacaaagcacucuuugucaggaguauaauuaauaccacuuucgugguuugcauccugauccuugcgauuuguguggucagcacauccgcuguggagauggaaucuuugcccgccggcaccugggagcgcgaagaggaucugacgaacuuuugccaucaagagugucagguuacugaaaccgagugcuuauguccuuaugaagcacucgugcugcggagaccacuuuuccuggacucgaucguaaaggguaugaagaaucuacucaacagcacaucacuggagaccuccuugaguauugaggcccccuggggagcuauaaauguccagucuacuuacaaaccuacagugagcgccgcaaacaucgcucuguccuggucaucuguggaacacagggggaauaagauuuuagucagcggccgaagugaguccaucaugaaacucgaggaacgcaccgguauuagcugggaucugggcguugaagacgccucugagucaaaacuucugacaguguccguaauggacuugagucagauguacagcccgguguuugaguaucucucgggggaucggcaagucgaagaguggccaaaggcgacuugcaccggagacugucccgaaagaugcggcugcacgucuuccacaugucugcacaaggaguggccucauagcaggaacuggcguugcaauccaaccugguguuggggaguggggacuggcugcaccuguugcggucuagauguuaaggaccuguucacagauuacauguuugugaaauggaaggucgaauauaucaaaacugaggccauaguguguguugagcuuaccucacaggaacgccagugcagucucaucgaggcugggacgcgguucaaccugggaucugugacaauuaccuuguccgaacccagaaauauccaacagaagcugccuccggagauuaucacuuuacaccccaggauagaagagggcuuuuucgaccucaugcauguccagaaaguacugagcgcaucaacaguguguaaacuucagaguugcacccacgguguuccaggcgaucugcaaguguaccauauugggaacuugcucaagggagaccgagucaacggccaccugauccacaagaucgagcagcaucuaaauacuagcuggauguccugggaugggugugaccuggauuauuacugcaacaugggagacuggccuucuugcacauauaccggcgugacgcagcacaaucaugccagcuuuguaaaccuucucaauauugaaacugauuacaccaagacauuccacuuucacuccaaacgggugaccgcucauggugacacaccccagcuggacuugaaggcccgcccaacuuacggggcaggagagauaaccgucuuaguugaaguggcggauauggagcugcacacgaaaaagaucgagauuucaggccucaaauucgccucucugaguuguacagguugcuaugcuuguucgagcggcaucuccugcaaggugaggauucaugucgacgaaccugaugagcuuacugugcacguuaagucugacgaucccgacguaguggccgcaucaagcucccugauggcuagaaaauuggaguucgggaccgauaguacauuuaaggccuucucugcaaugccaaaaaccagccuauguuuuuacaucgucgaacgggaauauugcaagggauguucaaaagaggacacucaaaagugcgugaacaccaagcuggagcagccgcaguccauacucaucgaacauaaaggcacaauuaucgggaagcagaauaacacguguacugccaaagcuaguugcuggcuggagagcguuaagucuuucuuuuacggacuuaaaaauauguuauccggcauuuucgguaacguguuucuggggaucuucucauuucucgcgccuuucgucuugcugauacucuuuuucauguucggauggcgaauccuguuuuguuucaagugcugcagacgcaccaggggccuuuuuaaguaucgucaccugaaagaugacgaagagacaggcuaccggaagauuaucgaaagauugaauaacaaaaaggggaaaaauaagcuacuggauggagagaggcucgccgaccgcaagauugcagaguuauucagcaccaaaacucacaucgguuga

SEQ ID NO: 10353 - RNA, 5055 nt, Artificial Sequence
  derived and/or modified CDS sequence (opt3) from CCHFV(NIVA 118594)__JN572084.1__GP
augcacaccagccugaucuacgugguccucugccuucagcuguguuccuugggcaagacacaugggucucacaacggaacugagcauaauaaaacggacguuaugaccacacccggugauaaccaaucaccugaaccauuagugaguacugcccugccgguaacccccgacccuagcacagugaccccaacugcucccgcauccggccuagaggggucuggagaagucuauacaucgucaagcauuaccacgaagggccucagucugccuaaagccacuuccgagcuucuggcgaccacagguauggugacuucuagcgcuuccgauauagacccaucaacccaggccgcaggggauacacccaccccuacgguuagaacaaguuugccaaauagcccgucuacacccuccaccucacaggacacucaccauccugugaggaaccuccugagcgucacaaguccaaagcccgaagagaccccuacgccaucuaaauccgauaaggacagcucggccaccaauucuccccacccggcugcaucccggcugucaacaccucccacuaccgaucagggaccaacagagaacaauaaccacaauaguacugaacaacucgagagcuuaacccgcuccgccacaucuagcucaauggugagucugacccagacuguacuuccucaguccgcuacgagcaucgccacacaggacacccaucccucuccaacuaaccgaucaaagcguaauuuggaaauggagauuauccugacccuaccccaaggccucaaaaaguacuauggcaaaauucugaagcugcugcacuugacacucgaggaagauaccgaggggcuguuagaauggugcaaaagaaaccugggacucgacugugaugacacuuucuuucagaagaggaucgaggaguucuuuauaacaggugagggccauuucaaugagguucuucaguuucgggcgccugggacgcugaguaccacugaaccaacacacgcaggaagcccgaccgccgagcccuucaaguccuacuuugcuaaaggcuucuugucuaucgacucggguuauuuuagcgccaagugcuacucccgcacaucaaacagugggcuacagcugauuaaugugacuagacacucuaccaggaucgcagauacgccuggaccaaaaauuaccaaccucaagacaaucaacuguauaaaucugaaagcuagcgucuucaaggaacaucgggaguuugaaauuaacgugcuucugccccaaguggccgucaauuuguccaacugccacguugcgaucaaaucacaugugugugacuauagccucgauacugacggcgccauucgccugccucacauccauuacgagggcaccuucaucccagggacauacaagauuguaauagauaagaaaaauaaguuaaacgaccgaugcacucuguuuaccaauugugugaucaaaggaagagaggucaggaagggucagucugugcuacggcaguauaaaacggaaauucguaucggccgcgcauccacagggaguagaaggcuccugagcgaggaaucuggagaugacugcauaucccggacccaacuuuugcgaacugagacagcugaaguucacggcgauaacuacggugggcccggcgacaagauuaccaucuguaauggaucaacuguggucgaucagcgccugggcagugagcucgggugcuauaccaucaacagaguaaagagcuucaaacugugcgaaaauucggccacaggaaaguccugugaaauugacucuaucccggugaaaugcaggcaggguuacugucuuaagauuacgcaggagggccgggggcacguuaaacugagccgcggaucagaaguggucuuggacgcuugcgauaguuccugugaggugaugauaccuaagggcaccggugacauccucgucgauugcucugggggccaacagcauuuccugaaggacaacuuaauugaucugggauguccaaaaaucccccuacucggcaagauggccaucuauauuugcagaaugagcaaucacccuaaaacuacaauggcauuucuguucugguuuuccuucggguacgugauaaccuguauccuuugcaagguuaucuuuuauuugcugauuauuuucggaacacucgguaaaagguuuaagcaguaccgugagcugaagccccagacuuguaccaucugcgaaacgacaccagugaacgccauagacgcugagaugcaugauuuaaauugcucauacaacaucuguccuuauugcgcgagccggcugaccagugacggccuugcacgacacguaacucaaugucccaaaagaaaggaaaaagucgaggaaaccgaguuguaccucaaccuggagaggauuccaugggugguucgcaagcuacuucaggugucugaauccacagggaucgcccucaaacggagcucguggcugauuguccuuuuggugcuguucacuguaucaaucaccccggugcagucugcuccuauaggacacggcaagacaauugaggccuauagagcaagggaagaguacacgaguaucugcuuauuuguucucgguuccguccuguucguggugagcugucuuaugaaagggcuggucgauucuguuggcaauaucuuuuuccccggauuguuuauuugcaagaccuguagcauaggcuccaucaacggguucgaaauugagucacauaagugcuauuguagucucuucugcuguccauacugccgccacugcagcgccgaccgagagauccaucagcugcaccuaucuauuuguaaaaagcggaaaacuggauccaaugugaugcuggcugugugcaagcguauguguuuuagaacaaccauggaaguaucaaacaaagcccucuucgucaggaguaucauaaauacuacauuugugguuugcauucugauccuugcagugugugucgugagcaccuccgcgguugagauggaaucuuugcccgcuggcacgugggagcgcgaagaggaucugacuaacuucugccaucaagagugucaggugaccgaaacagagugcuuauguccuuaugaagcccucguacugcggagaccacuuuuucuggacucgaucgucaaggguaugaagaaucuacucaacagcaccucacuggagacuuccuugaguauugaggcacccuggggagccaucaaugugcagucuacauacaaaccuaccgugagcgcugccaacauugcacuguccuggucaucugucgaacacagggggaauaagauauuaguuagcggccgaagugaguccaucaugaaacucgaggaacgcacagguauuagcugggaucugggcguggaagacgcuucugagucaaaacuucugacuguauccgugauggacuugagucagauguacagcccggucuucgaguaucucucgggggaucggcaaguggaagaguggccaaaggcaaccugcacgggagacugucccgaaagaugcggcugcacaucuuccaccugucugcacaaggaguggccucauagcaggaacuggcguugcaauccaacuugguguuggggaguugggaccggcugcacauguugcggucuagaugugaaggaccuguuuacugauuacauguucgucaaauggaagguggaauauaucaaaaccgaggcgauuguuuguguggagcuuacgucacaggaacgccagugcagucucaucgaggccgggacacgguuuaaccugggaucugucaccauaacuuuguccgaacccagaaauauccaacagaagcugccuccggagauuaucacauuacaccccaggauugaagagggcuucuuugaccucaugcauguacagaaagugcugagcgcuucaaccguuuguaaacuucagaguugcacucacggugugccaggcgaucugcaagucuaccauaucgggaacuugcucaagggagaccgagugaacggccaccugauacacaagauugagcagcaucuaaauacaagcuggauguccugggaugggugugaccuggauuauuacugcaacaugggagacuggccuucuugcaccuauacgggcguaacucagcacaaucaugccagcuucgugaaccuucucaauaucgaaaccgauuacacaaagaccuuucacuuccacuccaaacgggucacagcccauggugacacuccccagcuggacuugaaggcucgcccaaccuacggggccggagagaucacgguuuuaguggaaguggcagauauggagcugcacacuaaaaagauugagauaucaggccucaaauucgcgucucugaguuguacugguugcuaugccuguucgagcggcaucuccugcaaggucaggauucauguggacgaaccugaugagcuuaccguucacguaaagucugacgaucccgacguggucgcugccucaagcucccugauggcaagaaaauuggaaagugggacagauucuaccuuuaaggcuuucagcgccaugccaaaaacuucacuauguuuuuacaucguggagcgggaauauugcaagggauguuccaaagaggacacccaaaagugcguuaacacaaagcuggagcagccgcagaguauucucaucgaacauaaaggcacgauaaucgggaagcagaauaacacuuguaccgcaaaagccagcugcuggcuggagucugugaaguccuucuuuuacggacuuaaaaauauguuaucaggcauuuucgguaacgucuuucuggggaucuucagcuuucucgcuccuuucguguugcugauucucuuuuucauguucggauggcgaauccuguuuuguuucaagugcugcagacgcacaaggggccuuuuuaaguaucgucaccugaaagaugacgaagagaccggcuaccggaagauaauugaaagauugaauaacaaaaaggggaaaaauaagcuacuggauggagagaggcucgcggaccgcaagaucgccgaguuauucucgacuaaaacacacaucgguuga

SEQ ID NO: 10354 - RNA, 5055 nt, Artificial Sequence
  derived and/or modified CDS sequence (opt3) from CCHFV(UCCR4448)__KY484042.1__GP
augcacaucagccugauguacgccgugcucugccuucagcuguguggcuugggggagacccauggaucccacaacgaaacaggucauaauaagacugacgucaugacgacccccggcgauaacuuaucuucagagcaaccuguuaguacagcucugagcauuacuccagacccguccaccgugacacccaccacuccugcaucugggcuagaaggaucgggcgagguauauacaucaccacccauaaucaccgaaagccucagucugccugagacgacuccagagcuuuccgccaccgcggguauugauacaucuagcgcuuccgacguggauucaaguacucaggccgcaagagggaccagcgcccugacagucaggaccucuuugcccaauuccccuucaacgccaagcacuccgcaggaaacacaccaucccgugcggaaccuccugaguguuaccucuccucgcccagaggaaacuuccacacccagcggaucgggcaaagagucuuccgcuaccucaggcccucacccagugaguaauaagcccccgacgccucccgcaaaaacccaggggccaacagagaacaauagccacaacgccacugaacauccugagccccugacccaauccgcuacacucggauuaaugacuucuccaacccagaucguccacccccagagcgccacaucaauuaccgugcaggacacuuacccuaguccaacgaaucgauccaagcguaaccuggaaauggagaucauacuuacauugagccaaggucugaaaaaguauuacggcaagauccuaagacuccugaggcuuacccuggaagaggauacugagggguugcucgaauggugcaaacggaaucugggauuagacugugaugacaccuucuuucagaagcgcauugaggaguucuuuaucacaggcgaaggucauuucaacgaaguacugcaguuuaaaaccccggggacucucucuacaacggagucaacccccgcggagcuuccuacugcagaaccauucaagaguuauuuugccaaaggauuccugagcauugauuccggcuacuauucugcuaagugcuacucgggcacaagcaauuccggguugcagcuaaucaacauaaccagacacucagccaggauuguugacacacccggaccuaaggugacuaaucugaaaaccaucaacuguauuaaccucaaggcaaguaucuuuaaagagcaccgggaagucgagaucaaugugcugcuuccacaaguggcugucaaccugucuaauugccauguuauuauaaagagccacgugugugauuacuccuuggacaucgacgguacgguacgccucccccauauuuaucacgaaggcguguucaucccggggaccuacaaaauagucauugauaagaaagacaagcugaacgaucgaugcacauuauuuacugacugugugaucaagggaagagagguuaggaaaggccagucagugcugcggcaguauaagaccgagauccguauugguaaagccagcacagggucucgcagacuacucuccgaagagacuucugaugacugcaucagcaggacccaacugcuucggacggaaacagcggagauucauggcgauaauuacggaggcccuggggacaagauaaccaucuguaacggaucuacuauugucgaucagcgauuggguuccgagcugggcugcuauacaaucaaucgcgugaaaucauucaagcucugcgaaaacagugccaccggaaagagcugugagaucgacucgguaccaguuaaaugcagacagggguacugucugaggauuacucaggaaggccggggucacgugaaacuuucccgcgggucugaggucgugcuggaugcaugcgacaccagcugugaaauaaugauccccaagggcacaggagacauuuuggucgauugcucaggcgggcaacagcacuuucucaaggacaaucugaucgauuuaggauguccuaaaauuccccugcuagguaagauggcuaucuauauaugcagaaugaguaaccauccaaagacgaccauggccuuccucuucugguuuuccuucggcuacgugaucacuuguauucugugcaaagcuaucuuuuaccuuuugauuaucauagggacacugggaaagagguucaaacaguaucgugagcucaagccucagaccuguacaauuugcgagacuacccccguuaaugccaucgacgcagaaaugcacgaucugaacugcucuuacaauauuuguccauauugcgccagccgguuaacguccgacggccuggcucgacaugugacacaauguccgaaaagaaaggagaagguagaagagaccgaacuuuacuugaaccucgagaggaucccuugggucgugcgcaaacugcuacagguuucagagagcacugguguggcgcugaagcggaguucuuggcucauaguccugcuuguguuguuuaccaucucccugagccccguacagucggcaccaauuucacacgggaaaacaaucgaagccuauagagcuagggagggcuacacuucuauuugcuuauucgugcucggaaguauccuguuuauaguuuccuaucuuaugaagggccuggucgauagcguggggaauaguuucuuucccggauugagcauuuguaaaaccugcuccacaucaaguaucaacggcuucgaaaucgagagccacaaguguuacugcucucucuuuuguugcccuuacugucgccauugcuccgccgacaaagaaauucacaagcugcaucuaucaaucugcaagaaacgaaagacggguaguaacgugaugcuggcagucuguaaacggaugugcuuccgugccaccauggagguuagcaauagagcucucuuuauuagguccauaaucaacacuacauucgugcuguguauucuuaucuuggccgugugcguagucucuaccucggcaguggagauggaaaaucugccagcggggacuugggagcgcgaagaggauuuaacaaacuucugucaccaggagugccaaguuaccgaaacggagugucucugccccuaugaagcucuggugcuucggaagccucuguuucuagacagcauugucaaaggaaugaagaaucuccugaacucaacuuccuuggagaccagucugucuaucgaagccccguggggcgcaauaaaugugcagagcacauacaagccaaccguuuccacugccaacaucgcuuuaucauggucuagcguggagcauagagguaauaaaauucucguaaguggcagguccgagagcaucaugaagcuggaagagaaaacagggauuucuugggaucuuggagucgaagacgccucagaguccaagcuguugaccgugagugugauggaucucagccagauguauucgcccgucuucgaauaccugucuggcgaccgacagguugaggaguggccuaaagcaacauguacuggggacugcccagaacgcuguggaugcaccuccagcacgugccuacacaaggaguggccccacucacggaacuggagauguaauccuacauggugcuggggcguggguaccggguguacuugcuguggacuggauguaaaggaccuuuuuaccgauuauauguucgugaaauggaaggucgaauacaucaaaacagaggcuauagugugcguugaacucaccagucaagagaggcaguguucucugauugaggccggcacucguuuuaacuuggguccggugacgaucacacuguccgaaccccgcaauauccagcaaaaguuaccaccugagauuauaacccuccauccccggaucgaagagggcuucuuugaccugaugcacguccagaaagugcuuagcgcgucaacuguuugcaagcugcagaguuguacacauggggugccaggagauuugcaggucuaucacauuggcaaccuccugaagggggacaaaguaaauggacaucuaauccacaagauugagccucacuucaacaccagcuggauguccugggauggcugcgaccuggauuacuacuguaacaugggugacuggcccucuugcacuuauacaggggugacccaacauaaucacgccagcuuuguuaaccuucucaauaucgaaacggauuacacuaaaaacuuccauuuucacuccaagagagugaccgcucacggagacacaccacagcuggauuugaaagcaaggccgaccuauggcgccggugagauaacagucuuaguggaaguagcugacauggagcugcauacuaagaaaaucgaaauuucaggccucaaguucgccucucugaccugcacgggguguuacgcaugcaguucgggaaucagcuguaaggugcggauucacgucgacgagccugaugagcuuacaguucaugugaaauccgacgaucccgacguggucgcggccucuucaagccugauggcucgaaaguuggaauuuggcacugauuccaccuucaaagccuucagugcaaugccaaagacaucucuaugcuuuuauaucguggagcgcgaacacuguaaaagcugcucagaggaagacaccaagaaguguguuaauacuaaacuggagcagccccaguccauacucauugagcauaaggggaccaucaucggaaaacaaaacaguacaugcacggcuaaggccagcuguuggcuggaaucuguaaaauccuucuuuuacggccuuaagaauauguuaucagguauuuucgggaacguguuuaucggaauauuccuguuucucgcaccuuucauuuugcugauccucuuuuucauguuuggcuggaagauucuguucugcuucaaauguugcagaaggacucggggccuuuuuaaguaucgacaccugaaagaugacgaggaaaccggguacagacgcaucauagagagguugaauaacaagaaaggaaagaauaagcuacuggauggugaaauucucgccgaccgucggaucgcugaguuauucagcacaaaaacccacaucggcuga

SEQ ID NO: 10355 - RNA, 5055 nt, Artificial Sequence
  derived and/or modified CDS sequence (opt3) from CCHFV(UCCR4401)__KY484035.1__GP
augcacaucagccugauguacgccauucucugccuucagcuguguggcuugggggagacccauggaucccacaacgaaacaagacauaauaagacugacacgaugaccacacccggugauaacccuucuucagagccaccggugaguacugcuuuaagcauaacccuggaccccuccacagucaccccuacuacaccagcaucuggccuagaagggucgggagagguuuauaccucacccccuaucacgacuggcagccucccacugagugaaaccacacccgagcuuccugugacuaccgguacagauacccuguccgccggggacguagauccaucuacgcaaacugcgggaggcacaagcgcuccgaccgugaggacuuccuugcccaauucaccuaguacaccaagcacgccccaggacacccaccauccuguccggaaccuccugucugugaccuccccaggccccgaugagacaucaacuccgagcgggaccggaaaagaaaguucugccacauccagcccucaccccguuucgaaucgcccaccuacucccccagcaaccgcccagggucccacagagaacgacucucacaauuccaccgaacauccugagucacugacucagagugcuacgccaggccucaugacaagcccgacccaaauugugcacccccaguccgcaacuccuaucaccguccaggauacacauccaucucccaccaaccgaagcaagcguaauuuaaaaauggagauuauccugacucuuucacagggguugaagaaauacuauggaaagauacugagacuacuccaacugacacuugaagaggacacggaaggccuguuggaguggugcaagaggaaccucggucuggauugugacgauaccuucuuucagaaacggaucgaagaguucuuuauuacuggggagggacacuucaaugaaguguuacaguuucgcacaccuggcacccugaguacaacugaguccaccccagccggccuccccacggcugaaccguucaagagcuacuuugccaaaggguuccuuucuaucgacucaggauauuacagugcgaagugcuauagcgguaccuccaacucuggccugcaguugauuaauaucacaagacacucgacuaggauaguagacaccccugggccaaaaauuacaaaccuaaagacuaucaauuguauuaaccugaaggcaagcaucuuuaaagagcaucgggaaguugagaucaacgugcuccugccccaagucgccgugaaucuuuccaacugccacguggucauuaagucacauguuugugauuacagucuggacauagauggagcugugcgcuugccucacaucuaccaugagggcguauucauucccgguaccuauaaaaucgugauagacaagaaaaauaagcucaacgaucgaugcacgcuguuuacagacugugucauuaaagggagagaagugaggaagggccagucuguuuuacggcaguacaagaccgagauccguaucggaaaagccagcacuggcucccgcagacugcuaucagaggaaccaagcgaugacugcauuucuaggacacaacuccugcggaccgaaacugcagagauccacggggauaauuauggagguccuggcgacaagauuaccauauguaacggguccacaaucguggaucagcgacuuggaagugaguugggcugcuacacgauuaaucgcgucaggagcuucaaacugugcgaaaacucugcuaccgguaagaauugugagaucgacuccgugcccguaaaaugcagacagggguauugucuccggaucacucaggaaggccgcggacacguuaagcugucaagaggcagugaggugguccuugacgccugcgauacaagcugugagauuaugauaccaaaggggaccggagacauccugguggauugcucggguggccaacagcauuuucuuaaagacaaccucauugaucugggguguccgaagaucccuuuacugggaaaaauggcgauuuacaucugcaggauguccaaucaccccaagacaacuauggccuuccuauucugguuuucuuucggcuaugucauaaccuguauccucugcaaagcaaucuuuuaccugcuuauuauuguggguacguuggggaagcgucugaagcaguaccgggaacucaaaccacagacauguaccaucugcgagacuacccccguuaacgcuauagacgccgaaaugcaugaucugaauugcagcuauaacauuuguccuuacugcgcuucacgauuaacaagugacggccuggccagacacgugauccaauguccaaagaggaaagagaagguagaagagacugagcuuuauuugaaucucgaacgcauucccugggucgugcggaaacugcuacagguuuccgagucuaccggaguggcacugaagagaagcuccuggcucaucguccugcuuguguuguucacaguaucacugagcccugugcagagugccccgauaggccaggggaagacgaucgaagccuacagggcgcgcgagggauauaccucuauuugcuuauuuguucucggcuccauccuguucauugucagcugucuuaugaaaggucugguggauucgguggggaacucauuuuucccaggauugucuaucugcaagacuuguaguauauccagcauuaacggcuuugaaaucgagucucacaaaugcuacuguagccucuucugcugucccuauugccgacauugcuccacagacaaggagauccacaaacugcaucuaucaauuuguaagaaacggaagaccgguaguaaugucaugcuggcaguuugcaagcucauguguuuucgugccacuauggaagugagcaacagagcucuguucaucaggucuauuauaaauacaaccuuugugcuuugcaucuugauucuggccguaugugucguguccacgucagcaguugagauggaaaacuuaccugccggcacuugggagcgcgaagaggaucucaccaauuucugccaccaagagugucaggugacagaaaccgagugccuguguccauacgaagcucuuguccugcggaaaccccuauuccucgacaguacugccaaggggaugaaaaaccuguugaauagcacaucccuggagaccucuuuaucgaucgaggcaccuuggggagcgauuaacgugcagagcacauacaagccgacuguuucaaccgcuaauaucgcccucuccuggaguucuguggaacauagaggcaacaaaauacugguaagcgggagguccgagucaaucaugaaacuugaggaacgaacgggaauuucuugggaucugggcgucgaagacgcaagcgagaguaaguugcucacaguguccgugauggaccugagccagauguauucucccgucuuugaguaccuaucaggugaucgccaaguugaagaguggccaaaggcuaccugcacuggggacuguccugaacggugcggaugcaccuccaguacaugucugcacaaggaguggccccacagcagaaauuggaggugcaacccaacuugguguuggggcguggguaccggcugcacguguugcgggcuugauguaaaagaccucuucacagauuauauguuugugaaguggaaagucgaauacaucaagaccgaggcuauuguguguguugagcugacuucgcaggaacgucagugcucuuugaucgaggccggaacacgcuucaaucugggcccugugaccauaacuuuauccgaaccccggaacauucaacagaagcucccaccggagaucaucacacugcauccuagaauugaagagggguuuuucgaccuuaugcacguccagaaagugcugagcgcaucaaccguuuguaaguugcagaguugcacgcauggagugcccggcgaucuccaagucuaucacauagguaaucugcuaaaaggggacaagguaaacggacaucugauccacaaaauugagccacacuuuaacacuucuuggauguccugggauggcugugaccuugauuacuauugcaauaugggugacuggcccagcugcaccuacacaggcgugacccagcauaaccacgcuucauucguuaaucuccugaacaucgaaacagauuacacuaagaauuuucauuuccacaguaagagggugaccgcccacggggacacgccucaguuggacuuaaaagcgcgaccaacauauggagccggcgagauuacuguccugguggaaguagcugauauggagcuccauaccaagaaaaucgagauaagcgggcugaaguuugcaucccuugccuguacaggaugcuacgcuuguucuagcggcaucuccugcaaagugcggauucacgucgacgaacccgaugagcugaccguucaugugaagucagacgauccugacguggucgccgcaucuaguucguugauggcgcgcaaacuagaguucgguacugauagcaccuuuaaggccuucuccgcuaugccgaagacaucucuguguuucuauaucguggaaagagaacacugcaaaucauguagcgaggaggacacgaagaaaugcguuaacacuaagcucgaacagccacaauccauucugaucgagcauaaagggaccauaauuggaaagcagaauaguacauguaccgccaaggcaucuugcuggcuugaaagcguaaaaucauuuuucuacggcuuaaagaacaugcuguccggcaucuuugggaauguguucaugggaaucuuucucuucuuggcucccuuuauucugcucauccuguucuuuauguucgguuggaggauauuguuuuguuucaaaugcugccggcgaacuagaggccuguucaaguaucgccacuugaaagaugacgaggaaacaggguacaggcguauuaucgagaagcuaaacaauaagaaaggaaagaacaaacugcucgauggcgagcgguuagccgacagaaggauugcagaacuguuuaguaccaagacgcacaucgguuga

SEQ ID NO: 10356 - RNA, 5055 nt, Artificial Sequence
  derived and/or modified CDS sequence (opt3) from CCHFV(IbAn7620)__KX013451.1__GP
augcacaucagccugauuuacgccauacucugccuucagcuguguggcuugggggagaccuauggaucccauaacgaaacaagacacaauaagacugacacgaugaccacacccggugauaacuuaucuucagagccuccagugaguacugcucuguucaucaccccggaccccagcacagucaccccuacuacaccagcauccggccuagaagggucuggagagguuuacaccucgcccccuauuacgacuggcucacucccacugcccgaaaccacaccugagcuuccagccacuaccgguacagauaccagcagugcguccgacguggauuuuucuacgcaaacugcugggggaacaagcgcccugaccguaaggacuggcuugccggacucccccucaacaccuaguaccccacaggauacgcaucaccccaugcggaaucuccugagcgugaccucuccuggcccagacgagacauccacucccucagggaccggacgcgaaagcagugcaacaucuuccccgcauccugucagcaaccgacccccaacuccucccgccaccgcucaggguccaacagagaaugauucgcacaacgcaaccgaacaccccgagucucugacucaguccgccacgccuggccucaugacaucaccaacccaaacuauccauccgcagagugcuacccccauuacagugcaggacaaacagccuagcccaaccaaucguuccaagagaaacuuagagauggaaaucauacugacucuuucucaaggguugaaaaaguauuacggaaaaauccugaggcuacuccaccugacacuugaggaagauacggagggccuguuggaauggugcaagcggaaucucggucuggacugugaugacaacuucuuucagaagcgcauugaggaguucuuuaucaccggggaaggacauuucaaugagguuuuacaguuuagaacucccggcacacugagcaccacagaaucaacuccugccggccucccaaccgcggagcccuucaaaaguuauuuugcaaagggguuccuuuccauugacagcggauacuauucugccaaaugcuacucagguacgaguaacagcggccugcaguugaucaauauaaccaggcacuccacacggauuguggauacuccggggccuaagaucaccaaccuaaaaacaauuaauuguaucaaccugaaggcuucuaucuuuaaggaacaccgcgaggucgagauuaacgugcuccugccacaaguagccguuaaucuuucgaacugccauguggucauaaaaagccacgugugugacuacucccuggauaucgacggagcagugcgauugccccauauuuaucacgaaggcgucuucaucccugguacuuacaagauaguuauugauaaaaagaauaaacucaacgacagaugcacccuguuuacggauugugugaucaaggggagggagguacggaaaggccagucaguguuacgucaguauaagacagaaauccgcauuggaaaggcuaguaccggcucuagaaggcugcuaagcgaggaacccuccgacgauugcaucucacggacucaacuccugcgaacagagaccgccgagauucauggggacaauuacggagguccaggcgauaaaauaacuaucuguaacgggagcaccauugucgaccagcgccuuggaucugaauugggcugcuauacaaucaauagagugaaguccuucaaacugugcgagaacagugcgacggguaagaauugugaaaucgacagcguuccugugaaaugcaggcagggguacugucuccggauuacccaggagggccgcggacacgucaagcugucuagaggcuccgagauagugcuugaugccugcgacacuucaugugaaaucaugauucccaaggggacaggagauauccugguagacugcagugguggccaacagcacuucuugaaagauaaccucauugaccugggguguccaaagaucccguuacugggaaaaauggcaauauauaucugcaggaugagcaaucauccuaagaccacaauggcuuuucuauucugguuuucguucggcuacguuauuacuuguauccucugcaaagccaucuuuuaccugcuuauuauaauugguaccuuggggaagcgucugaagcaguaucgggagcucaaaccccagacguguacaaucugcgaaaccacuccagugaacgcuauugaugccgagaugcacgaccugaauugcuccuacaacaucugucccuauugcgcaucucgauuaaccagcgauggccuggccagacaugucauacaauguccuaagaggaaagaaaagguggaggagacagaacuuuacuugaaucucgagcgcaucccaugggucgugcggaaacugcuacagguuucagaaaguacuggaguggcucugaagagauccucuuggcucauuguacugcuugucuuguucaccgugagccugucccccguucagucagcgccuaucggccaggggaagacaacggaggcauauagggcccgcgaaggauacaccagcauuugcuuauuugugcucggcaguauccuguucauagucucuugucuuaugaaaggucugguggacuccguagggaacagcuuuuucccgggauugucgauuugcaagacuuguucaaucucuaguaucaacggcuuugagauugagucccacaaaugcuauuguagccucuucugcuguccauacugccgacacugcucuacagauaaggaaauccauaaacugcaccuaagcauuuguaagaaacggaagaccgguuccaaugugaugcuggcuguuugcaagcguauguguuuuagagccacuauggaggucucaaacagggcacucuucauacgcaguaucauuaauacaaccuucgugcugugcauccuuauuuuggccgugugugucguuagcacgucugcuguggaaauggagaaccugcccgccggcacuugggaacgggaggaggacuuaaccaauuuuugccaucaagaaugucaggugacagagaccgaaugccucuguccuuacgaggcacugguacuuagaaaaccacuguuccuagauuccaucgcgaaggggaugaaaaacccccucaauucaacaagucuggagacaagccuuuccauagaagcuccuuggggagccaucgacguccagucuaccuauaagccgacagugucgacugcaaacauugcccugagcuggucauccguugagcacaggggcaauaaaaucuuagugagugggcgaucugaaagcauuaugaagcucgaggaacgcaccggaaucuccugggaccugggcgucgaggaugcuucagagucuaaguugcugacggugagcguuauggacuugagucagauguacucccccguguuugaauaucucagcggugaucggcaaguagaggaauggccaaaagccacaugcaccggggacuguccugagagaugcggaugcacuucuucaaccugucugcauaaggaauggccccacuccaggaacuggcguugcaauccaacaugguguuggggcgucgguacuggcugcaccuguugcgggcuagaugugaaagaccuguucacggauuacauguuugugaaguggaaagucgaguauauaaagacagaggcaauuguuuguguggaacuuaccagucaggagcgccagugcagccucaucgaagcuggaacucgguucaaccugggcccuguaacaaucaccuugucggagcccagaaauauucaacagaagcugccaccggaaauaaucacuuuacacccuaggauugaggagggguuuuucgaccucaugcaugugcagaaaguccugucugccuccacaguguguaaacuucagagcugcacccacggaguucccggcgaucugcaaguguaccauaucgguaacuugcucaaaggggacaaggucaauggacaccugauucauaaaaucgaaccacacuuuaacacgucauggaugaguugggauggcugugaccuagauuauuacugcaacaugggugacuggcccucuugcacuuacaccggcgugacacagcacaaucaugcguccuucguuaaccugcuuaauauagagaccgacuauacaaagaacuuucacuuccauagcaagcgagugacugcccacggggauaccccucagcucgaccugaaagcucggccaacguacggagcaggcgaaaucacagucuugguagagguggccaauauggaguuacacacuaagaaaauugaaaucucagggcugaaguuugcuagucucaccuguacaggaugcuaugccuguagcuccggcauuucuugcaaaguucgcauccauguggaugagcccgacgaacugaccguccacguaaagagcgaugacccugaugugguggcagcguccucaucucuuauggccagaaaacuggaguucgguacugacaguaccuucaaggcuuuuucggccaugccgaagacuagcuuguguuucuacauagucgaaagggagcauugcaaauccuguucugaggaagauacgaagaaaugcguuaacacuaagcuagagcagccacaaucaauucugaucgaacacaaagggaccaucauuggaaagcagaauagcacauguaccgcaaaggcuuccugcuggcucgagagugugaaaucuuucuuuuauggccugaagaacaugcuuagcggcaucuuugggaauguguucaugggaauauuuuuauuccuggcccccuuuauucucuugauccuguucuuuauguucgguuggcggauucucuucuguuuuaaaugcugccgaagaacucgcggccuguucaaguacaggcaucuuaaagacgaugaagagacaggguaucgucggaucauagagagacugaacaauaagaagggaaagaacaaguugcuagacggcgaaaggcuggcagaccgccgaauugccgagcucuuuucaaccaaaacgcacaucgguuga

SEQ ID NO: 10357 - RNA, 5055 nt, Artificial Sequence
  derived and/or modified CDS sequence (opt3) from CCHFV(Zahedan 2007)__KC867273.1__GP
augcacaucagccugauguacgccguguucugccuccagcuuuguggccuggggaagaccaacggaccccauaaugguacagagcacaacaauacucaugucaugacgaccccugacgauucccaaucuccagaaccgcccguuucaacagcuuugccugugacuccagaccccaguaccguaacaccuagcaccccagcauccggcuuagaggggucuggagaagugcacacuucgucacccauuacaaccaaaggccugagccuaccugaggccacgagugaaccaccguccacuaccucugucgugacaagcuccgcgucagauacugacaguagcacccaggcugccggugauacacccaccccuacgguuagaacuucucucccauccucacccagcacaccuaguaccucucaggggacucauuauccagugaggucccugcuuagcgucacaggacccaagccggaggagaccccuacgcccucgaaaucuggcaaggacaaccuggcaaccaauuccccacacccugccacaucacggcccacuaccccaaguacaauagcucagaaacccacugaaaacaauagccacaacaccacagagcaauuggaaucccucacccaucuggcaacucugggcucuaagaucagcccuacgcagacagugcucccacagucaguaaccaguauugccauccaggauauucacacuuccccgaccaaucgcagcaagcgaaacuuagacauggagaucauacugacacuuucucaaggguugaaaaaguacuauggaaaaauccugaagcuacuccgucugacccuugaggaagauacugagggucuguuggaauggugcaaaagaaaucucggccuggacugugaugacacauuuuuccagaagaggauugaggaauuuuucaucacgggggagggacauuuuaacgagguuuuacaguuccggacccugggcacucucucaacaaccgaaaguacacacgcugguagccccacuguggagccuuuuaaguccuacuucgccaaaggguuucuuucuauugauucgggauauuucagcgcgaagugcuacucccgcaccucaaauaguggccugcaguugaucaacgucacgagacacucuaccaggauagcagacacaccaggccccaaaauuacuaaucuaaagaccaucaacuguauuaaccugaaagccagcguguuuaaggaacaucgggagguggaaaucaauguccuccugccucaaguugcugugaaccuuuccaauugccacguagccaucaaaucacauauuugugacuauagccuggauacagacggggcaauacgcuugccacagauccaccaugagggaacuuucauucccgguaccuacaagaucgugauagauaagaaaucuaagcucaacgaccgaugcacgcuguuuacaaauugugucauuaaaggcagagaggugaggaaggggcaguccguuuuacggcaauacaaaaccgaaauccguaucggacgcgcuaguacuggcagcagaaggcugcuaucugaggaauccggugaugacugcauuucacggacacagcuccugcgaaccgagacugccgaagugcacggggauaacuauggcggaccgggcgacaagaucaccauuuguaaugggaguacagucguggaucagcgccuuggaagcgaguuggguugcuacacgauaaacagaguaaggucguucaagcugugcgaaaauuccgcgaccggcaaaucuugugaaaucgacagcauuccuguuaagugcaaacagggguucugucucaagaucacucaagagggacggggccacgugaaacugucacgcgguagugaagucgugcuugaugucugcgacuccucuugugaggugaugaucccaaaggggacaggcgacauucugguugauugcagcggaggccagcagcauuucuugaaggacaaccucguggaucuggggugucccaaaauaccuuuacugggaaagauggccaucuauauuugcagaauguccaaucaccccaaaaccacaauggcauuccuauuuugguucucauuugguuacguaaucacuuguauucucugcaaggcuaucuucuuucugcuuauaaucuucggcaccuuggggaaaagguuuaagcaguaucgugagcugaagccacaaacguguacaauuugcgaaaccacuccugucaacgccaucgacgcugagaugcaugaucucaauugcagcuacaacauuugucccuauugcgccagucggcugaccucugacggauuagcacgacacgugacacaguguccaagaaggaaagaaaagguugaggaaacugagcuguaccuuaauuuggagcgcaucccgugggugguccggaaacuccuacagguguccgaaagcaccggcacaguacugaagagaucgucauggcugauagugcuccugguucuuuucacggucucuuugaguccugugcaguccgcccccauuggucacgggaaaaccaucgagacuuacagggugcgcgaagaguauacaagcauuugccuguuugucuuaggcucuauccucuucauaguuagcuuucugaugaagggacuuguggauggcguggggaacaucuucuucccaggacuguccguauguaaaaccugcucaauuggcaguaucaacgguuuugaaauugagagccaucgauguuacugcucuuuguucuguugccccuauugucggcacugcuccgcugacggggagauccaucaacuccaccugucaauaugcaagaagcguaaaacuggaaguaaugucaugcuagcgguguguaagagaaugugcuuuagggcaacaauggaaguuagcaacaaagugcuguucauucgcuccaucaucaauaccacguuugucguguguauucucauccuggccguuugcgugguaucuacuucggcugucgagauggaaagccuuccugccggcaccugggagcgggaagaggauuugacaaacuucugucaucaggagugccaggugaccgaaacugagugucugugcccauacgaagcauuagugcucagaaggccccuguuucuugacucaauugucaaggauaugaaaaaucugcuaaacuccacaagucucgagaccucucugagcauagaggccccuuggggugcuaucaauguucaguccacauauaagccgacugugucaaccgccaacauugcauugucuuggagcaguguagaacaccgaggcaauaaggugcuggucuccgggcgcagcgagucuaucaugaaauuagaggagcggacgggaauuucaugggaccucggcguggaagaugcguccgagaguaagcugcuuacaguuagcgugauggaccugucgcaaauguacucuccagucuucgaguauuuguccggggacagacagguggaagaguggcccaaagcuaccuguacuggagauugcccugaaagguguggcugcaccagcucaacaugccuccacaaggaguggccacauagucguaacuggcgcuguaaucccacuuggugcugggguguugggaccggauguacgugcuguggccuggacgugaaagaucuauuuacagacuacauguucgucaaguggaagguagaauacaucaaaaccgaggccauagugugcguugagcugacuucucaggaacggcaauguucccuuaucgaggcagguacaagauuuaaccucggcagcgugaccauuacucugucagaaccuaggaauauccagcagaaguugccgcccgagauuaucacacugcacccaaaaauagaagagggguucuuugauuuaaugcauguccagaaggugcucagugccagcaccguaugcaaacugcaauccuguacgcacggagugccuggcgaccuucaggucuaucauauugggaaccuguugaagggagaucgaguuaauggccaccucauccacaagaucgagcagcauuucaacacuucuuggaugagcugggacgguugcgaucuggacuacuauuguaacaugggggauuggcccuccugcaccuacacaggagugacccagcacaaucaugcuucauucgugaaccuacugaauauugaaacagacuauacuaaaaccuuucacuuccacucuaagcgggucacggcccauggcgauacaccacaacuugaccucaaagcacgcccuacuuacggugcuggcgagauaaccgugcugguugaaguagccgacauggaguugcacacaaagaaaaucgagauuaguggguuaaaguuugcgggacugaccugcacuggcuguuaugccugcucgagcgggaucuccuguaaagugaggauucaugucgaugaacccgacgagcucaccgugcacguuaagucugaugacccagauguggucgcugcaucaagcucccugauggccagaaaacuugaauuuggaacagacaguacguuuaaggcuuucucugccaugccgaagacuagccugugcuuuuacaucguggagcgggaauacuguaaaucaugcuccaaggaggauacccagaaauguguaaacacaaaguuggagcagccucagaguauacuaaucgaacauaagggcaccauuaucgguaaacaaaauaacacuugcacagcaaaggcgagcuguuggcuggagucugucaaauccuucuuuuaugggcucaagaauaugcugggaggcauuuucggcaacguguuuaucgggauauucaccuuccuuacgcccuuuauuuuacugaucuucuuuuucauguuuggauggcgaauccucuucugcuuuaaauguugcagacgcacuagggguuuguucaaguaccgucaccugaaggacgaugaagagacaggcuaucggaaaauuaucgaaagacucaauaacaagaaagggaagaauaggcugcuugacggagagcgccuggccgaucgaaaaauagcugaguuguuuucaaccaagacccacauuggcuga

SEQ ID NO: 10358 - RNA, 5055 nt, Artificial Sequence
  derived and/or modified CDS sequence (opt3) from CCHFV(Afg09-2990)__HM452306.1__GP
augcacaucagccugauguacgccguguucugccuccagcuuuguggccuggggaagaccaacggaccccauaaugguacagagcacaacaauacucaugucaugacgaccccugacgauucccaaucuccagaaccgcccguuucaacagcuuugccugugacuccagaccccaguaccguaacaccuagcaccccagcauccggcuuagaggggucuggagaaguguauacuucgucacccauuacaaccaaaggccugagccuaccugaggccacgagugaaccaccggcgacuaccuccgucgugacaucuagcgcuuccgauacugacucaaguacccaggccgccggugauacacccaccccuacgguuagaacuagccucccaucuucccccucaacaccuagcaccagucaggggacucacuacccagugaggucucugcuuuccgucacaagccccaagccggaggagaccccuacgcccucgaaaucuggaaaggacaaccuggcaaccaauuccccacauccugcuacaucacggcccacuaccccacccacaacugcacagaaaccuaccgaaaacaauagucacaacacaaccgagcaauuggaaagccucacucaccuggccacgcugggcuccaugauaucuccaacacagaccgugcucccgcagagcguaacuucaaucgcuauucaggauauccauaauagucccaccaaccgcuccaagcgaaauuuagacauggagauuauccugacacuuagccaaggcuugaagaaauauuacgggaagauacugaaacuacuccaccugacccuugaggaagauacugagggacuguuggaauggugcaagcguaaccucggucuggacugugaugacacauuuuuccagaaaagaaucgaggaauuuuucauuacgggcgaggggcauuuuaaugagguuuuacaguucaggacccugggaacucucucuacaaccgaaucaacacacgccggcaguccuacuguggagccauuuaagagcuauuucgcgaaggguuuucuuuccaucgauucuggguacuucucggcaaaaugcuauagccggaccuccaacucaggacugcaguugauuaaugucacgcgccacaguaccagaaucgccgacacacccggcccuaagauaacuaaccuaaaaaccauuaacuguaugaaucugaaggcuucuguguuuaaagaacauagggagguggaaaucaacguccuccugccacaaguugccgugaaucuuagcaacugccacguagcaauuaagucccauaucugugacuacucacuggauacagacggcgcuauccgguugccccagauucaccaugaggggacuuucauaccgggaaccuacaaaaucgugauugauaaaaagagcaagcucaaugaccgcugcacgcuguuuacaaacugugucaucaagggucgagaggugagaaaaggccagucuguuuuaaggcaauauaagaccgaaauacggauugggcgugccuccgcgggaagucgcagacugcuaagcgaggaaucuggcgaugacugcaucuccaggacucagcuccugcggacagagaccgccgaagugcacggugauaauuacgggggcccuggagacaaaaucacuauuuguaacggcucaaccgucguggaucagcgacuugggagugaguugggaugcuauacaaucaaucgcguaaggagcuucaagcugugcgagaacucggcaacggguaaguccugugaaauugacucuauaccaguuaaaugcaagcagggcuacugucucaaaaucacccaagaggggagaggacacgugaagcugagccggggcucagaagucgugcuugaugucugcgacaguuccugugaggugaugauucccaaagguacuggggacauccugguugauugcucuggcggacagcagcauuauuugaaggacaaucucguggaucugggcuguccuaagauccccuuacuggggaaaauggcuauuuacauaugccgcaugagcaaccacccaaagacaaccauggccuuccuauuuugguucuccuuuggauauguaaucacauguauucucugcaaagcuaucuucuuucugcuuauuaucuucgguacuuugggcaagagauuuaaacaguacagggagcugaagccucaaaccuguacgauaugcgaaacaacccccgucaaugccaucgacgcagagaugcaugaucucaacugcucauacaauauuuguccauauugcgccagccgucugacuagcgacggguuagcucggcacgugacccaguguccgcgaagaaaggaaaaaguugaggaaacagagcuguaccuuaacuuggagaggaucccuugggugguccgcaagcuccuucaggugucugaauccacuggaaccguacuaaaacggagcucguggcugauugugcuccugguucuuuucacagucucauugucucccgugcagagugcgccaaucggccacgguaagacgauagagaccuauagagugagggaagaguacacuuccauuugccuguuugucuuagggagcauccucuucauuguuucuuuucugaugaaaggccuuguggauggagugggcaacaucuucuuucccgggcugagcguauguaagacaugcuccauaggaucaaucaauggcuucgaaauugagagucauaaauguuauugcagcuuguucuguugcccuuacugucgccacugcucugcagacggugagauccaucaacuccaccuguccauuugcaagaagcgaaaaaccgggucaaacgucaugcuagccguguguaagcggaugugcuuucgugcuacuauggaaguuaguaauaaagcccuguucaucagaagcauaauuaacacaaccuuuguggucuguauccucauccuggcagugugcguuguguccacgucugccguagagauggaaucgcuuccagcuggaacuugggagagggaagaggauuugaccaauuucugucaucaggagugccaggucacagaaaccgagugucugugccccuaugaagccuuagugcuccgccggccucuguuucuugacagcauugugaagggcaugaaaaaccugcuaaauucaacuucccucgagacaagucugucuaucgaggcaccguggggugcgauuaacguccagagcaccuacaagccaacaguuuccacugcuaauauagccuugucauggucuagcguggaacacagaggcaacaagguacuggugagugggagguccgagagcaucaugaaauuagaagaacgaaccggaauuucuugggaucucggcgucgaagacgcaucagaguccaagcugcuuacggugaguguuauggaucugagccaaauguacucgcccguguucgaguauuugucuggggaccgccaggucgaagaguggccuaaagccacauguaccggagacugcccagaacgguguggcugcacuuccaguaccugccuccacaaggaguggccccauucaagaaauuggagguguaacccuacauggugcugggguguggggacuggauguaccugcuguggccuggauguuaaagaccuauuuacggauuacauguucgugaaguggaaggucgaauauaucaaaacagaggcuauuguaugcguggagcugaccagucaggaacgucaauguucucuuaucgaggccgguacucgcuuuaaucucggcuccguuacaauaacccugagcgaaccgcggaacauccagcagaaguugcccccagagauuaucacucugcacccuaaaauugaagagggguucuuugacuuaaugcaugugcagaagguccucucagcaaguacagugugcaaacugcaaagcuguacccacggaguacccggcgaucuucagguguaccauaucgggaaucuguugaagggagacagagucaacggccaccucauacacaagauugagcagcauuucaacacguccuggaugucuugggaugguugcgaccuggauuauuacuguaauaugggggacuggccaagcugcacuuauaccggaguuacacagcacaaccaugcuuccuuugugaaucuacugaacaucgaaaccgauuacacaaaaacuuuccacuuccacucaaagagggugaccgcccauggcgacacgccucaacuugaucucaaagcgcgacccacauacggugccggcgagaucacuguccugguggaaguugcugacauggaguugcacaccaagaaaauugagauaucuggguuaaaguuugcaggacugacaugcaccggcuguuaugccugcaguucggggaucagcuguaaaguacggauucauguggacgaaccagaugagcucacuguccacgugaaguccgacgauccggacguuguggcugccucuucaagccugauggcacgcaagcuggaguucggaaccgauuccacauuuaaagcguucagugccaugccuaagacgucucugugcuuuuacaucgucgagagagaauauuguaaaagcugcucaaaggaggacacucagaaaugugugaauaccaaguuggagcagccccaguccauucuaaucgaacauaagggcacaauaaucgguaaacaaaacaauaccugcacugcuaaggccaguuguuggcuggagagcguaaaaucuuucuuuuacgggcucaagaacaugcugggaggcauuuucggcaaugucuuuaucgggauuuucacauuucuuaccccauucaucuuacugauacucuucuuuauguucggauggaggauuuuguuuugcuucaaauguugccggcgaacgagaggucuguuuaaguaucgccaccucaaggaugacgaagagacuggcuacaggaaaaucaucgaacgucugaacaauaagaaagggaagaaccggcuucuggauggagagagauuggcagacaggaaaauugcugagcuauucuccacaaagacccacaucggcuga

SEQ ID NO: 10359 - RNA, 5055 nt, Artificial Sequence
  derived and/or modified CDS sequence (opt3) from CCHFV(SPU41/84)__AY900142.1__GP
augcacaucagccugauguacgccgugcucugccuucagcuguguggcuugggggagacccauggaucccacaacgguacaagauauaauaacacugacgcuacgaccacacccggcgauucucaaucaccugaaccaccggucaguacugcaagcuccauuacccauaaucccucuacaguuaccucgacuacaccuaccucagggagcgagggaaguggcgaaguguacacguccucuccaauaacuaccgaggguuuaagcccaccugggacaacuccagaacugcccgccaccacaggaaucgacaccuccggcgcgucagaugcuaacccuaguacgcaggccgcaaggggcacuagcgcccuaacaguacacaccucucucccauccucaccgagcacucccccuauuagucaggacacacaucacccagugcggaaucugcuuucugucaccucccccaugccugaggagacgaccgcuccaagcgggucgggaaaggaaucuuccgcaacaucaaguccccacccggccagcgaucgcccucccacucccccugcuaccgcccagggucugacagaguccaacucucauaaugcgacugaacacuuggagagccucacccaaucagcaacacccggccuggugaccaguccagcccagacuguucauccccacuccgcuacgagcaucgccgcaccugacacacacccaaacccgaccaaucgaucuaaacguaaccuggagauggaaauuauccucacuuuaucacaggggcugaagaaauauuacggaaagauacuuagauugcugcaucuaacccucgaggaagauacagagggccugcuugaauggugcaaaaggaaucuggguuuggacugugaugacaccuucuuucagaagcggaucgaggaguucuuuauuacuggggaaggacacuucaacgaggugcuccaauuucgcacacccggcacggucaguaccacugaaagcacacaugcuggcccuccaaccgccgagcccuucaaguccuauuuugcgaaagggucucugucgaucgauagcggauacuauuccgccaagugcuacucagguacaaguaauucuggcuuacagcugauuaacaucacuagacacagcaccaaaauagcagacacgccugggccaaagauuaccaaucucaaaacaaucaacuguauuaaccuuaaggcucugacuuucaaggaacauagggagguggagaucaauguauugcuaccccagguugccgugaaccuguccaauugccacgucgugaucaaaucacacgugugugauuacagccucgacauugacggaaccguccggcugccgcauauacaccaugaaggcaucuuuauuccugguacauauaagaucguuauagauaaaaagaacaaaaugaaugaccgcugcacucuuuucaccaacugugugauuaaggggcgagagguaagaaaaggccagucugugcugaagcaauacaagacggaaaucaggaucggaaaggcuuccacaggcagucggcguuugcucagcgaggaaucuuccgaugacugcauuucacgcacccagcuguuaagaacugagacagccgagauccacggggauaauuauggagguccaggcgacaaaauuaccauauguaacgggaguacugucguggaucagaggcugggaagcgaacuaggcugcuacaccaucaaucggguuaaaacauuuaagcucugcgagaacucggcaacggguaaauccugugaaauugacucugugcccgucaagugccgacaaggguauugucugaagaucacccaggagggccgcggacacgugaaacuuagcagaggcucagagguaguuuuggaugccugcgacacaaguugugaagugaugaucccuaaggggacaggagauauucuggucgacugcuccgguggccagcagcauuuccucaaagacaaucugauagaucuugggugucccaagaucccacuguugggaaaaauggcuauuuacaucugcaggaugucuaaccacccuaagaccacaauggcguuucucuucugguucagcuuuggcuaugugauuacuuguaucauaugcaaggucaucuucuaccuguuaauuaucguggguacccuggggaaacgguuuaagcaauaccgcgagcuaaaaccccagacguguacaauuugcgaaaccacuccaguuaaugcaaucgacgccgagaugcaugaucucaacugcuccuauaauauauguccguacugcgcuucaagacugaccagcgacggccuugccaggcacgugacacaguguccuaagcguaaagaaaagguagaggagacugaauuguaucugaaccucgagcggauucccugggucgugcgaaagcuguuacagguuagugaaucuaccggaguggcacugaaaagauccagcuggcuugucguguugcucguacugcuaacagugucgcugucaccaguucaaucugcccccaucagucauggcaagacggucgaggcuuacagggcccgcgaaggguauaccuccaugugccucuucgugcugggaagcguguuguuucuugucucuugucugaugaaaggcuuaguugauagcguggguaacacuuucuuuccugggcucuccauuugcaagacauguucaaucaguagcauaaauggauucgagaucgagucucaccggugcuacuguucccuguuuugcuguccauauugcagacacugcucagcaaacaaagaaauucaucagcuucaccugaguaucuguaagaaaaggaaggcgggcagcaaugugauguuggcuguaugcaagcgcauguguuuccgagccaccauggaggucuccaaccgggcacucuuuauucguucuaucauaaauacuacauucgugcugugcauucuaauccuggccgcuuguguugugucgaccagcgccgucgaaauggagucacuccccgcagguacgugggaaagagaggaggaccugacuaacuuuugccaucaggaaugucagguggcugauaccgagugccuuuguccuuacgaagccuugguucugaggcgcccguuauuccucgacuccaucgugaaaggcaugaagaaucugcuuaacaguacaucucuggagaccagccuauccauugaggcgccauggggagccaucaauguacaaucaacuuacaaacccacagucucuaccgcuaacauugcacucagcuggaguuccguggaacaccggggaaauaagauacuggugagcggcagaucugagucaaucaugaaauuggaagagaggacagggauuuccugggaucugggagucgaagacgccagugagagcaaguuacucacuguuucggugauggaucugucucagauguauuccccuguauucgaguaccuuagcggcgaccgacagguggaagaguggccaaaggcuaccugcacgggugauugucccgaacgcugcgggugcacaucaaguaccugucugcauaaagaguggccucacucucggaacuggagaugcaauccgacuugguguuggggagucggcaccgguugcacauguugcggcuuggacgugaaggaccucuuuacugauuauauguucguuaaauggaagguggaauacaucaaaaccgaggccauugucuguguggagcugacgucccaggaaaggcaaugcagccuaaucgaggcagggacacguuuuaaccugggacccguuaccauaacucuuucagaaccacgcaauauccagcagaagcucccucccgagauuaucacacugcacccacggauugaagagggcuucuuugacuugaugcaugugcaaaagguccugagugcgagcaccguauguaaauuacaguccugcacucacggggugccuggagaucuccagguuuaucauaucggcaaccugcuuaagggugacaaagugaacgggcaccugguccacaagauagagccccauuucaauacaucuuggaugagcugggauggaugugacuuggauuacuauugcaacaugggcgacuggccauccugcaccuacacgggugugacucagcacaaucaugccucauuuguaaacaugcucaauauugaaaccgauuacacuaaaaacuuccacuuucauucuaagagagugaccgcucacggcgacacaccgcaacuggaucuaaaggccaggccuacuuauggggcaggagagaucaccguccugguugaaguggcugacauggagcuucacacgaaaaagaucgagauuaguggccucaaauucacaucgcugacuuguaccgggugcuacgccuguagcuccggaauaucuugcaaggugcgaauccaugucgaugaacccgacgaguugacagugcacguuaaaucagaagacccagauguaguggcagccagcuccaguuuaauggcucggaagcuggaguuuggcaccgacucuacuuucaaagcguuuagcgccaugcccaagaccucacucuguuucuauauugucgaacgcgaguacugcaaguccuguagugaggaagauacacagaaaugcgugaauacgaagcuggagcagccucagagcauccuuauugaaagaaaagguacuaucauagggaagcaaaacaauaccuguaaagcaaaggcuggaugcuggcuggagucuguuaaguccuucuuuuauggcuugaaaaacaugcuaucaggcaucuucgggaauguguuuauuggaaucuuccuguuucucgccccauucauucugcuuaucuuauuuuucauguuugguuggaggauacuguucuguuuuaagugcugccggcgaacaagaggccucuucaaauaccgccauuugaaggacgaugaagagaccggguauaggaaaauuaucgagcgucugaacaauaagaaggggaaaaacaagcuccuggacggcgaacggcuugccgauagaaggaucgcugagcuguucagcacuaaaacacacauugguuga

SEQ ID NO: 10360 - RNA, 5055 nt, Artificial Sequence
  derived and/or modified CDS sequence (opt3) from CCHFV(SPU103/87)__DQ211634.1__GP
augcacaucagccugauguacgccgugcucugccuucagcuguguggcuuagggggagcucaugguucccacaacggcaccagauauaauaacacaggggcauugacuacgcugggagacggccaaucuucagagcccccugucaguaccgccccaagcacaacucauaauccguccaccguuacaucuaccacucccgcgucggguucagaagggagcggagagguguacacagcuaguccuguaaccacggaaggccuauccccacccggcacuaccccugagcucccagccacaacugggauugauaccucuggagcaagcgacgccgaucccuccacacaggcugcaggggacaccucagcccugacggugaggacaagucuuccuagcucuccauccacacugccgaccucacaggauacucaccaucccguccggaacuugcucagcgugacaaguccucgcccagaagagaccacggcucccucuggcuccgggauagagagcucggccaccucuuccccucacccagcgucagaccgacccccgacaccucccgcagccgcucagggaccaacugaaaguaauagccacaacgccaccgagcaucuggaaucccugacacaaucugcaacuccugaucucguuaccagccccgcucagacagugcacccacagucagccaccaguaucgcggcccccgacacucauccuuccccaacgaaucguagcaagagaaacuuagaggucgagauuauccugacacuuucucagggcuugaaaaaguauuacgguaaaauucugaggcuacuccaccugacccuugaagaggauacugaagggcuguuggaguggugcaagcggaaucucggacuggacugugaugacaccuucuuucaaaaacgcaucgaagaguucuuuauaacaggcgagggccacuucaacgaaguguuacaguuuagaaccccggggacuguaucaacaacggagaguacccaugcaggacccccuacugcugaaccauucaagagcuauuuugccaaggguuuccuguccaucgauucuggcuacuauucggcuaaaugcuacagcgggacauccaauucaggacuccagcuuauuaacaucaccaggcacaguacacggauugccgacacucccggcccuaagaucaccaaucugaaaacgauaaacuguauuaauuugaaggcacuaaccuuuaaagagcaucgcgaaguugagaucaacgugcugcucccacaggucgccgugaaccugucuaauugccacguggucauuaagagccauguuugugacuacucccuugauaucgacgguacagugcgacugccccacauccaccaugaggggauuuucauaccgggcacuuauaagaucguaauugauaaaaagaacaaauugaaugacagaugcacccucuuuacagauugugugaucaagggaagggaaguccggaaaggccaaucagugcugaagcaguacaaaacugagauacguauugggaaggcuagcaccggaucucgcagauuacuguccgaagagaguagcgacgauugcaucucuaggacgcagcuacuccggacagaaaccgcggagauccacggugacaacuauggcgggccuggagauaagauuacuaucuguaauggcuccacaauuguugaccaacgacuggguucagagcuugggugcuacaccauaaaccgcgugaaaacuuucaaguugugcgaaaauagugcaaccggcaaaagcugugagaucgauucggucccagugaagugcagacagggauauugucugaaaauuacacaggaaggcagggggcauguaaagcucucccggggaucugagguugugcuggacgccugcgacacgagcugugaggucaugauccccaaggguaccggcgauauccuuguggacugcucagggggacagcaacacuuucugaaagauaacuugauugaccucggcuguccuaagauaccccuguuagguaaaauggcuaucuacauuugccgcaugaguaaucacccaaagacuacaauggccuuccuguucugguuuuccuucggguaugucaucaccugugugcuaugcaaagcaaucuuuuaccuccugauuauaguuggcacacuuggaaagagauugaagcaguacagggaacugaaaccucagacuuguaccaucugcgagacgacacccgugaacgccauugaugcugaaaugcaugaccucaauugcucuuauaacaucuguccauacugcgccagccgucugaccuccgauggcuuagcacggcacguaacucaguguccgaagcgaaaagagaaggucgaagagaccgagcuguaucuuaauuuggaaaggauuccuugggugguuagacgccuccugcaagugucagagagcacaggggucgcgcuaaaacggaguucuuggcugaucgugcuccugguacuuuucacuguguccuugagccccguucagucggcuccaauaucacauggaaagaccgucgaagccuaccaggcaagagagggcuauacagguaugugccuguuuguguuagggucuauucucuuccuggugaguugucuuaugaagggacuggucgacuccguuggcaacacguuuuuccccgguuugagcaucugcaaaaccuguucuauuagcuccaucaauggcuuugaaauagagucacacaggugcuacuguagucucuucugcuguccuuauugccgccauugcagcgccaacaaggagauccaccagcugcaccuaucuauuuguaaaaagcgaaaaacuggguccaacgugaugcuggcugugugcaagcggauguguuuucgugccacaauggaaguaucaaauagagcacucuucaucaggaguauuaucaacaccacuuuuguccugugcauacuuauuuuggcuguguguguugugagcacauccgccgucgagauggaaucucugccagcgggaaccugggagcgcgaagaggauuuaacgaauuucugccaucaagagugucaggugacugacaccgaaugccucugucccuacgaggcccugguucuucggagaccucuguuccuagauaacaucgugaaaggcaugaagaaucuccugaacucgacuagcuuggaaaccucacuguccaucgaggcuccguggggugcaauuaauguacagaguacuuacaagccaacagucucuaccgccaacaucgcuuuaagcugguccucaguggagcacaggggaaauaaaauucucgugucuggccgaagcgaaaguauaaugaagcuggaggaacgcacagguaucuccugggaccuuggggucgaggaugccagcgaaucuaaacuguugacuguuucagugauggaccucucccagauguauagucccguauuugaguaccugagcggagaccggcaaguggaggaauggccuaaggcaaccugcacgggcgauuguccagagagaugcgguugcacaucgucuaccugucuacauaaagaauggccccacuccaggaacuggcguugcaauccuacuugguguuggggcgucgggaccggaugcacauguugcggccuggacgugaaggaucuuuucacugacuauauguuuguuaaguggaaaauugaguacaucaagaccgaagcgauugugugugucgagcucacgagccaggagcgccagugcucacugaucgaagccgggacacgguucaacuugggaccggugaccauaacucugagugagcccagaaauauccaacagaaauuaccaucugaaauuaucacacuccauccuaggauugaggaaggcuuuuucgaucugaugcacguucagaaggugcuuuccgcuagcaccgucuguaaacugcagucaugcacucacgguguacccggggacuugcaaguguaucauaucggaaaccuccugaagggcgauaagguuaauggucaccuagugcauaaaauagagccacacuuuaacacaaguuggaugagcugggacggcugugaucuggacuacuauugcaacaugggggauuggccuuccugcaccuacacgggagucacucagcacaaucaugccucuuucgugaaccuucucaauauugagaccgacuacacaaagaacuuucacuuccauagcaaacgaguaaccgcacacggcgauacaccccagcuggacuugaaggcucggccaacuuauggggccggagaaaucaccguguuagucgagguugcagacauggaacugcauacgaaaaagaucgagauuuccggccucaaguuuacaucacugacuuguaccgguugcuacgccuguucuagugggauaucgugcaaagugcgcauccacguggaugagccggacgaacuuacaguccacguuaagagcgaugacccugaugugguagcugcguccucuucacugauggccagaaaauuggaguucggaaccgacagcacuuuuaaggcauucuccgcuaugcccaaaaccagucuauguuucuauauuguggaaagggaguacugcaagucuuguagcgaagaggauacacagaaaugcgucaauacgaagcuggagcaaccacagucaauccucauugaacauaagggcacuaucauaggcaaacagaacaauaccuguaaggcccgggccgggugcuggcuggaguccgugaaaaguuucuuuuauggacuuaagaacauguuaagcgguaucuuuggcaauguuuucauugggaucuuucuguuccucgcucccuuuauuuugcugauccucuucuuuauguucggauggcgaauacuguuuuguuucaaaugcugcagacgcacaaggggccuuuucaaguaccgucaccugaaggacgaugaagagaccgguuaucggaaaauuaucgaaagauugaacaauaagaaagggaagaacaaacuacuggacggagagaggcucgcagaucgccgaaucgccgaguuauuuucuacuaagacacauauuggcuga

SEQ ID NO: 10361 - RNA, 5055 nt, Artificial Sequence
  derived and/or modified CDS sequence (opt3) from CCHFV(Iran-53)__DQ446216.1__GP
augcacaucagccugauguacgccguguucugccuccagcuuuguggccuggggaagaccaacggaccccauaaugguacagagcacaacaauacucaugucaugacgaccccugacgauucccaaucuccagaaccgcccguuucaacagcuuugccugugacuccagaccccaguaccguaacaccuagcaccccagcauccggcuuagaggggucuggagaaguguauacuucgucacccauuacaaccaaaggccugagccuaccugaggccacgagugaaccaccggcgacuaccuccgucgugacaucuagcgcuuccgauacugacucaaguacccaggccgccggugggacacccaccccuacgguuagaacuagccucccaucuucccccucaacaccuagcaccagucagggaacucacuacccagugaggucucugcuuuccgucacaagccccaagccggaggagaccccuacgcccucgaaaucuggcaaggauaaccuggcaaccaauuccccacauccugcuacaucacggcccacugcaccacccaccacagcccagaaaccuacugaaaacaauagucacaacaccacagagcaauuggaaagccucacccaccuggcuacucugggcuccaugauaucuccaacgcagacagugcucccgcagagcguaaccucaaucgccauucaggacauccauacuagccccaccaaucgcuccaagcgaaacuuagauguugagauuauccugacacuuagccaaggguugaagaaauauuacggaaagauacugaaacuacuccaccugacccuugaggaagacacugagggucuguuggaauggugcaagcguaaucucggccuggauugugacgauacauuuuuccagaaaagaaucgaggaauuuuucauuacgggggagggacauuuuaacgagguguuacaguucaggacccugggcacucucucuacaaccgaaucaacacacgcggguaguccuacugucgagccauuuaagagcuauuucgcaaagggguuucuuuccaucgacucuggauacuucucggccaaaugcuauagccggaccuccaauucaggccugcaguugauuaacgugacgcgccacaguaccagaaucgcugauacacccggcccuaagauaacuaaucuaaaaaccauuaacuguaucaaccugaaggccucuguguuuaaagaacauagggaggucgaaauuaauguucuccugccacaaguggcaguaaaccuuagcaauugccacguggcuaucaagucccauaucugugacuacucacuggacacagauggggccauucgguugccccagauacaccaugagggaacuuucaucccggguaccuacaaaauugucaucgacaaaaagagcaagcucaacgaucgcugcacgcuguuuacaaauugugugauaaagggccgagagguuagaaaagggcagucuguguuaaggcaauauaagaccgaaauucggaucggacgugcguccacuggcagucgcagacugcuaagcgaggaaucuggugacgauugcaucuccaggacacagcuccugcggaccgagacugccgaaguccacggggacaacuacggcggaccuggcgauaaaauuaccaucuguaaugggucaacagugguagaccagcgacuuggaagugaguuggguugcuauacgauuaaccgcguuagaaguuucaagcugugcgaaaauucggcaaccggcaaguccugugaaauagauucuaucccagugaaaugcaagcagggguacugucucaaaauuacucaagagggaaggggccacgucaagcugagccgggguucagaagugguccuugacgugugcgauaguuccugugagguuaugauccccaaagggacaggcgacauccugguggacugcucuggaggccagcagcauuucuugaaggauaaccucguagaccugggguguccuaagauucccuuacugggaaaaauggcuauauauaucugccgcaugagcaaucacccaaagaccacaauggccuuucuauucugguuuuccuucgguuacgucauuacuuguauccucugcaaagcuaucuuuuuccugcuuauuauauuuggcaccuuggggaagagauucaaacaguauagggagcugaagccucaaacguguacaaucugcgaaaccacucccgugaacgccauugaugcagagaugcaugaccucaauugcucauacaacaucuguccauacugcgccagccgucugaccagugauggauuagcucggcacguuacacaguguccgcgaagaaaggaaaaaguggaggaaacugagcuguaucuuaauuuggagaggauuccuugggucgugcgcaagcuccugcagguaucugaauccaccggcacagugcuaaaacggagcucguggcugaucguucuccugguccuuuuuacggugucauugucucccgugcagagugcgccaauaggucacgggaagaccauugagacuuacagagucagggaagaguauacauccaucugccuguucguuuuaggcagcauucucuuuaucgugucuuuccugaugaaaggacuuguggacggcguagggaacauauuuuuccccggacugagcgucuguaagaccugcuccaucggcucaauuaacgguuucgaaaucgagagucauaaauguuacugcagcuuguuuuguugcccuuauugucgccacugcucugcagauggggagauucaucaacuccaccuguccaucugcaagaagcgaaaaacuggaucaaaugugaugcuagccguuuguaagcggaugugcuuccgugcuacaauggaagugaguaacaaagcccuguuuauaagaagcauuaucaauaccacguucgucguguguauccucauucuggcaguuugcgugguauccacuucugccgucgagauggaaucgcuuccagcuggcaccugggagagggaagaggacuugacaaacuuuugucaucaggagugccaggugaccgaaacugagugucugugccccuacgaagccuuagugcuccgccggccucuguuccuugauagcaucgucaaggguaugaaaaaucugcuaaacucaacaucccucgagaccagucugucuauugaggcaccguggggcgcgauaaauguucagagcacauauaagccaacuguguccaccgcuaacaucgccuugucauggucuagcguagaacacagagggaauaaggugcuggucaguggaagguccgagagcauuaugaaauuagaggagcgaacgggcaucucuugggaccucgggguggaagaugcaucagaguccaagcugcuuacaguuagugugauggaccugagccaaauguacucgcccgucuuugaguacuugucuggagaucgccagguggaagaguggccuaaagccaccuguacuggcgacugcccagaacggugugguugcaccuccagcacaugccuccacaaggaguggccccauucaagaaacuggagguguaauccuacuuggugcuggggaguugggaccggcuguacgugcuguggucuggacgugaaagaucuauucacagacuauauguuugucaaguggaagguagaauacauuaaaaccgaggcuaucgugugcguugagcugacaagucaggaacgucaauguucucuuauagaggccggcacucgcuucaaccucggguccgugaccaucacucugagcgaaccgcggaauauucagcagaaguugcccccagagaucauuacacugcacccuaaaaucgaagagggauuuuucgauuuaaugcauguccagaaggugcucucagcaaguaccguaugcaaacugcaaagcuguacgcacggcgugcccggggaccuucaggucuaucauauaggaaaccuguugaagggcgauagaguuaauggucaccucauucacaagaucgagcagcauuuuaacacuuccuggaugucuugggacgggugcgaucuggacuacuauuguaacaugggagauuggccaagcugcaccuacacaggcgugacccagcacaaucaugcuuccuucgugaaccuacugaauaucgaaacagacuauacuaaaaccuuccacuuucacucaaagagggucacggcccauggugauacaccucaacuugaccucaaagcgcgacccacuuacggcgccggggaggugaccguucugguagaaguggcugauauggaguugcacacaaagaaaauugagauaucuggauuaaaguucgcaggccugaccugcacuggguguuacgccugcaguucgggaaucagcuguaaaguccggauucauguggacgaaccagacgagcucaccguucacgugaaguccgaugacccggaugucguggcugccucuucaagccugauggcacgcaaacuugaauuuggcacagacuccacguucaaggcguuuagugccaugccuaagacuucucugugcuucuauaucguagagagagaauacuguaaaagcugcucaaaggaggauacccagaaaugugucaacacaaaguuggagcagccccaguccauucuaaucgaacauaaggguaccauaaucgggaaacaaaauaacacuugcacagcuaaggccaguuguuggcuggagagcgugaaauccuuuuucuauggacucaagaauaugcugggcggcauuuuugggaacguuuucaucggaauuuuuaccuuccuuacgccauucaucuuacugauacucuuuuucauguuugguuggaggauuuuguucugcuuuaaauguugccggcgaacuagaggccuguucaaguaccgccaccucaaggacgaugaagagacaggguauaggaaaaucaucgaacgucugaauaacaagaaaggaaagaaucggcuucuggacggcgagagauuggcagauaggaaaauugcugagcuauuuucuaccaagacccacaucgguuga

SEQ ID NO: 10362 - RNA, 5055 nt, Artificial Sequence
  derived and/or modified CDS sequence (opt3) from CCHFV(Iran-52)__DQ446215.1__GP
augcacaucagccugauguacgccguguucugccuccagcuuuguggccuggggaagaccaacggaccccauaaugguacagagcacaacaauacucaugucaugacgaccccugacgauucccaaucuccagaaccgcccguuucaacagcuuugccugugacuccagaccccaguaccguaacaccuagcaccccagcauccggcuuagaggggucuggagaaguguauacuucgucacccauuacaaccaaaggccugagccuaccugaggccacgagugaaccaccggcgacuaccuccgucgugacaucuagcgcuuccgauacugacucaaguacccaggccgccggugauacacccaccccuacgguuagaacuagccucccaucuucccccucaacaccuagcaccagucaggggacucacuacccagugaggucucugcuuuccgucacaagccccaagccggaggagaccccuacgcccucgaaaucuggaaaggacgaucuggcaaccaacuccccacauccugcuacaucacggcccacuaccccacccacaacugcacagaaaccuaccgaaaauaacagucacaauacaaccgagcaauuggaaagccucacucaccuggccacgcugggccucaugauauccccaacacagaccguguuaccgcagucuguaacuagcaucgcuauucaggacauccauaacucacccaccaaucgcaguaagcgaaaccuggauauggagauuauccuuacauugucccaaggccugaagaaauauuacgggaagauacuaaaacuccugcaccuuacccuggaggaagacacugagggauugcucgaauggugcaagcguaaucuggguuuagauugugacgauacauuuuuccagaaaagaaucgaggaauuuuucauuacgggcgaggggcauuuuaacgagguucugcaguucaggacccucggaacucuuagcacaaccgaaucuacacacgccggcucaccuacuguggagccauuuaagaguuauuucgcgaaggguuuucugagcaucgacuccggguacuucucugcaaaaugcuauucgcggaccagcaauuccggauugcagcuaauuaacgucacgcgccacucaaccagaaucgccgacacacccggcccuaagauaacuaaucugaaaaccauuaacuguaugaaccucaaggcuaguguguuuaaagaacauagggagguggaaaucaauguccugcuuccacaaguugccgugaaccugucuaauugccacguagcaauuaagagccauaucugugauuacuccuuggacacagauggcgcuauccggcucccccagauucaccaugaggggacuuucauaccgggaaccuacaaaaucgugauugacaagaagucaaaacugaacgaucgcugcacguuauuuacaaauugugucaucaagggucgagaggugagaaaaggccagagcguucugaggcaauauaagaccgaaauacggauugggcgugccucuacuggaucccgcagacuacucagugaggaaagcggcgacgauugcaucucuaggacacagcugcuucggaccgagacugcggaagugcacggugacaacuacgggggcccuggagauaaaaucaccauuuguaauggcuccacagucguggaccagcgauuggggucagagcugggaugcuauacgaucaaccgcguaagaaguuucaagcucugcgagaauagcgccaccgguaagucgugugaaauugauuccauaccaguuaaaugcaagcagggcuacugucugaaaaucacucaagaggggaggggacacgugaagcucucucggggcagcgaagucgugcuggacgucugcgacucaaguugugaggugaugauucccaaagguacaggggauaucuugguugacugcuccggcggacagcagcauuuccucaaggauaaccugguggacuuaggcuguccuaagaucccccugcuagggaaaauggcaauuuauauaugccgcaugucuaaucacccaaagaccacaauggcuuuucucuucugguuuagcuucggauacguaaucacuuguauucugugcaaagccaucuuuuuccuuuugauuaucuuugguacccugggcaagagauucaaacaguauagggagcucaagccucaaacguguacaauaugcgaaaccacucccgucaacgcuaucgaugccgagaugcaugaccugaauugcuccuacaacauuuguccauacugcgcaucacguuuaaccagcgaugggcuggcccggcacgugacacaguguccgcgaagaaaggaaaaaguugaggaaacugagcuuuauuugaaucucgagaggaucccuugggugguccgcaagcugcuacaggugagugaaucuaccggaacaguacugaaacgguccagcuggcucauugugcugcuuguuuuguuuacggucucgcugucacccgugcagucugcuccaaucggccacgguaagaccauagagacuuacagagugagggaagaguauacaaguauuugcuuauucguccucggguccauccuguuuauuguuagcuuccuuaugaaaggccugguggacggagugggcaacaucuuuuuccccggguugucuguauguaagaccugcagcauaggauccaucaacggcuucgaaauugagucacauaaauguuacugcagucucuuuuguugcccuuauugucgccacugcagcgcggauggugagauccaucaacugcaccuaucuauuugcaagaagcgaaaaacuggguccaaugucaugcuggcaguguguaagcggaugugcuuccgugccacaauggaaguuucaaacaaagcucucuuuaucagaaguauaauuaauaccacguucguggucuguauccugauccuugccgugugcguugugagcacuuccgcaguagagauggaaucuuugccagccggaaccugggagagggaagaggaccugacaaacuuuugucaucaggagugccaggucaccgaaacugaguguuuaugccccuacgaagcucucgugcugcgccggccucuuuuccuggauucgauugugaagggcaugaaaaaucuacucaacagcacaucacuggagaccuccuugaguaucgaggccccguggggugcaauuaauguccagucuacauauaagccaacuguuagcaccgcgaacauagcucuguccuggucaucuguggaacacagaggcaauaagguauuagugagcgggaggagugaguccaucaugaaacucgaagaacgaacgggaauuagcugggaccugggcgucgaagaugccucugagucaaagcugcugacaguguccguuauggacuugagucaaauguacagccccguguuugaguaccucucgggggaccgccaggucgaagaguggccuaaagcaaccuguacuggagauugcccagaacgguguggcugcaccucuuccacaugccugcacaaggaguggccccauagcagaaacuggagguguaauccuacuuggugcugggguguggggaccggauguacgugcuguggccuagacguuaaagaucuguucacagacuauauguuugugaaguggaaggucgaauacaucaaaaccgaggccauuguaugcguggagcuuacuucacaggaacgucaauguagucucaucgaggcugguacacgcuucaaccugggcucuguuaccauaacuuuguccgaaccgcggaauauccagcagaagcugcccccagagauuaucacauuacacccuaaaauugaagagggguuuuucgaucucaugcaugugcagaagguccugagcgccucaaccgugugcaaacuucaaaguuguacgcacggaguacccggcgaccuucagguguaucauaucgggaacuugcucaagggagauagagucaauggccaccugauacacaagauugagcagcauuuuaacacuagcuggauguccugggacgguugcgaucuagacuacuauuguaacaugggggauuggccaucuugcaccuacacaggaguuacccagcacaaucaugcaaguuucgugaaccugcuuaauaucgaaacagacuauacuaaaaccuuccacuuucacuccaagagggugacggcucauggcgauacaccucaacucgaccugaaagcccgacccacuuacggugcgggcgagaucaccgucuugguggaaguugccgacauggaguuacacacaaagaaaauugagauaucagggcugaaguucgcuggacuuaccugcacuggcuguuacgcaugcucuagugggaucucguguaaaguacggauucauguggaggagccagaugaacugaccguccacgugaaaagcgacgauccggacguuguggccgcuuccucuucacuuauggcccgcaagcuggaguuuggaacagauagcacguucaaagcauuuuccgcgaugccuaagacuagcuugugcuucuauaucgucgaaagagaguacuguaaaucuugcagcaaggaggacacccagaaaugugugaacacaaagcuagaacagccccagucaauucugaucgagcauaagggcaccauaaucgguaaacaaaauaacacuugcacagccaaggcuuccuguuggcucgaaaguguaaagagcuuuuucuaugggcugaagaauaugcuuggaggcauuuuuggcaacgucuucaucgggauuuuuaccuucuuaacgccauucauccugcucauauuguuuuucauguuuggauggaggauucuguucugcuuuaaauguugccggcgaacuagaggucucuucaaguaccgccaccugaaggaugacgaggaaacaggcuauaggaaaaucaucgagcgucuuaauaacaagaaagggaagaaucggcuguuggauggagagagacuagccgacaggaaaauugcagaacuguuuucuaccaagacccacaucggcuga

SEQ ID NO: 10363 - RNA, 5055 nt, Artificial Sequence
  derived and/or modified CDS sequence (opt3) from CCHFV(75024)__AB069671.1__GP
augcacaucagccugaugugcgccgugcucugucuucagcuguacggcuugggggagacccauggauccucuaacgaaacagagcacaauaagacuaacgucguuacgacccccggugacucacaaaguccugaaccauuagugagcacaacucugccgguaacccuagauuccucuacagugacccccacuaccccugcuucgggcccagaggggucaggagaagucuauaccagcccgccuauuacgacugagggccucaguccauccgaggcaaccucugaacugcccgccacaacugguauagggaucagcuccgcgucagacguggauaguagcacccaggcugccggagacacaucuaccccuacgguuagaacuuccccacccaauucaagcaguacacccccuaccucucaggauacucaucacccaaugaggaaccuucuguccgugaccagcuugaaacccgaggaaacaucggcaccuucuaaguccggcaaagagucaccagccgcuaguagcccccauccggucgcaucccggccucccacgccaccuaccacagcccagggccccauugagaauaacucucacaauacuaccgggcaacucgaaagcgugacacagucagcuacucugggaccaauggccagucccacccagacaguacugucccagaacguuaccagcaucgcgauucaagacacucacccuucuccaacgaaucgcucaaagcgaaaccucgagauggaaaucauauuaacacugccgcagggucuuaaaaaguacuauggcaagguguugcgucugcuacagcucacccuggaggaagauacugaggggcuucuggaguggugcaaaagaaauuugggacucgacugugaugacaccuucuuucagaagaggaucgaagaguucuuuauuacaggcgaaggucauuucaacgagguccugcaauuucggacccccgggacuuuaaguacaacggaaagcacccacgcagaguccccuacugccgagccauucaaaucuuacuuugcuaagggauuccugucgaucgauagcggcuauuuuuccgccaaaugcuacucacgcacaaguaauucuggccuccagcuuauuaacgugaccagacauagcacaaggaucgcagacacucccgggccuaagauaaccaaucugaagacgauuuccuguaucaacuugaaggcuucaguguucaaagaacaccgggaggucgaaauuaacguucuacugccacagguggccguaaaucucagcaacugccacgugaccaucaaaucucaugucugugauuauucccuggacaucgacggaacagugcgccuuccccacauucaucacgaggguacuuuuauaccgggcaccuacaagaucguuauugauaaaaagaauaaacugaacgaccgaugcacauuguucacuaauugugugaucaaggggagagaagucaggaagggacaaagugugcuccggcaguacaaaaccgagauacguauuggcaaggcgagcacggguucucgcagacuguuauccgaggaaucaggggaugacugcaucaguaggacacagcugcuacggaccgagacugccgaaauccauggcgauaacuauggaggcccuggggacaaaauuacaaucuguaauggaagcaccauuguagaucagcgacucgguucggagaugggcugcuacacuauaaaccgcguuaaguccuuuaaacugugcgaaaauucugcaaccggaaagagcugugaaaucgacucaauuccagugaagugcagacaaggguauugucuuaaaaucacacaggagggcaggggucacgucaaguugagucggggguccgaagugguccuggaugcuugcgacucuagcugugaggugaugauccccaaaggcacgggagauauucucguugacugcuccggcgggcagcagcacuuccugaaggacaaccuuauagaucugggauguccuucaauccccuugcucgguaaaauggccauuuacaucugccgcaugagcaaucauccaaagaccacuauggcuuuccuguuuugguucaguuuuggcuaugugauuacauguaucuuaugcaaggccauauucuaccugcuaaucauuguagggacccucggaaaaagauuuaagcaauauagggaacugaaaccucagacauguacuaucugcgagaccacgcccgcaaacgccauugacgcugagaugcacgaucuuaauugcucuuacaacaucuguccauacugcgcgucccguuugacaagcgacggccuggcacggcaugucacccaguguccgaagcgaaaagaaaagguggaggaaacugagcucuaucugaauuuagaaagaauaccuuggguugugaggaagcugcuucaggucucggagucaaccgguguggccuugaaacgcucuaguuggcucauuguacugcuagugcuguucgcuaucucccucagccccguucaaucugccccaauugggcacggcaagacaaucgagacuuaccaggcacgggaagaguauaccagcauaugccuguuuguccuuggauccaucuuguucauugugucaugucugaugaaaggcuuaguggauaguaucgggaacaucuuuuuccccggacucagcauuugcaagacauguucuauaggcuccauuaacgguuuugaaaucgagucacacaaaugcuacuguagucugcuuugcuguccuuauugcagacauugcagcgccgacagggaaauccaccagcugcauuuguccauuuguaagaaacgcaagacggggucuaaugucaugcucgcuguuugcaagcgaauguguuuccgggccaccauggaggugucgaacaaagcacugcuaauccguagcauuauaaauacuacauuugugguaugcauccugauucucgcggucugugugguuucaaccuccgcuguggagauggaaagucugccagccggaacuugggagagagaagaggaucuuacaaacuucugccaccaggagugucaagucaccgaaacggagugcuugugucccuacgaagcacugguguuaaggcgcccucucuuccuggacucuaucguucggggcaugaagaaucagcuuaacagcacuucccuggagaccucacuaucuauugaagccccguggggugcuaucaaugugcagagcacauauaaaccaaccguaaguacugccaacauagcacucuccuggagcucugucgagcauagaggcaauaagauccuggugucagggagguccgagaguauuaugaaauuggaggagcgaacaggaaucagcugggaucugggcguggaagacgcuucggagucuaaguuacucaccgucuccguuauggaucugagccaaauguacucacccguguuugaauaccuuaguggggaccgccagguagaggaguggccuaaggccacaugcacuggagauuguccagaacggugcggcugcaccacgucuacaugucugcacaaagaguggccccacuccagaaacuggaggugcaauccuaccugguguugggguguggggacuggaugcaccuguugcggcuuggacgucaaggaccucuucacagauuauaugauugugaaauggaagguugaauacaucaaaacugaggcgauagugugugucgaacugaccagccaggagcgucagugcucacuaauugaggccgguacgcgcuuuaaccugggcagugugacaaucacccuuagcgaaccgcggaauauccaacagaagcuacccccagagauuauaacucugcauccuagaaucgaagagggguucuuugacuugaugcacguucagaaggugcuguccgcuucuacagucuguaaauuacagagcugcacccauggaguacccggcgaucuccaaguguaucacguugggaaccugcuuaagggagacaaagugaauggccaucugauucacaagaucgagccacacuugaacacuuccuggaugucaugggaugguugugaccucgauuacuauugcaacaugggggacuggccuucuugcacauacaccggagucacgcagcauaaucacgcaaguuucgugaaccugcuaaauauugaaacugauuauaccaaaucguuucauuuccacagcaagaggguaacagcccacggcgacacaccccagcuggaucuuaaggcucgaccaacauacggugccggcgagaucacugugcucgucgaaguugcagacauggaguuuaccccgaaaaagauagaaaucuccgggcugaaauucgcgucuuugacguguacaggaugcuacgccuguucaagcggcauuuccugcaaggugcggauccauguggaugagccugacgaguuaacuguccacgugaaaagugacgaucccgacguuguagcugccucuagcucacugauggcacgcaagcucgaauuugggaccgauuccacauucaaggcuuuuagugccaugccaaaaaccagccuguguuucuauauuguggagagagaauacugcaagucuuguuccaaagaggacacucagaagugcgucaacaccaaacuugaacaaccccagucaauccugauagagcauaagggaacaauuaucggcaaacagaauaacacguguacugcaaaggccagcugcugguuggagucggugaagucuuucuuuuauggucucaaaaauaugcugagugggaucuucggaaaccucuuuaugggcauuuuccuguuucuugcuccuuucaucuuacugauacucuuuuucauguuuggcuggaggauuuuguucuguuuuaagugcugccggcgaaccagagggcuguucaaauaccgccaccucaaggaugacgaagagacaggauauaggcguaucauugaacggcugaauaacaaaaaggguaagaauaaacuucuggauggcgagagauuggcggacaggcgcaucgccgaacuauucuccaccaagacucauauaggguga

SEQ ID NO: 10364 - RNA, 5055 nt, Artificial Sequence
  derived and/or modified CDS sequence (opt3) from CCHFV(7803)__AB069672.1__GP
augcacaucagccugaugugcgccgugcucugucuucagcuguacggcuugggggagacccauggauccucuaacgaaacagagcacaauaagacuaacgucguuacgacccccggugacucacaaaguccugaaccauuagugagcacaacucugccgguaacccuagauuccucuacagugacccccacuaccccugcuucggagccagaaggcucaggggaggucuauaccagcccgccuauuacgacugagggacucaguccauccgaagcaaccucugagcugcccgugacaacuggcauagguaucagcuccgccucagacguugauaguagcacccaggcggcuggggacacaucuaccccuacggugagaacuuccccacccaauucacccagcacaccuccaaccagucaggauacucaucaccccaugaggaaccuucugucugucacauccuugaaaagcgaagagaccucggccccuucuaaguccggaaaagagucaccagcagccaguagcccccauccgguggcuucccggccucccacgcacccaauuaccgcacagggcccuacagaaaauaacucucacaauacuaccggccaacucgagagcguaacacagucagccacucuggggcccauggcuaguccaacccagacaguucugucccagaacgugaccagcaucgccauucaagacacucaucccucuccuacgaaucgcucaaagcgaaaccucgaaauggagaucauauuaacacugccacagggacuuaaaaaguacuaugguaaggucuugcgucugcuacagcucacccuggaagaggauacugagggccuucuggaauggugcaaaagaaauuuggggcucgacugugaugacaccuucuuucagaagaggaucgaggaguucuuuauuacaggagaaggccacuucaacgaagugcugcaauuucggaccccggguacuuuaaguacaacggagagcacccaugcggagucccccacugcagaaccuuucaaaucuuacuuugccaagggguuccugucgaucgauagcggauauuuuuccgcuaaaugcuacucacgcacaagugacucuggccuccagcuuauuaaugugaccagacacagcacaaggaucgccgauacuccaggccccaagauaaccaaccugaagacgauuuccuguaucaauuugaaagcaucagucuucaaggagcaccgggaaguugagauuaacgugcuacugccucagguagcugugaaccucagcaauugccaugucaccaucaaaucucacgugugugacuauucccuggacaucgaugggacaguucgccuuccacauauucaccaugaaggaacuuuuauacccgguaccuacaagaucgugauugacaaaaagaacaaacugaaugaucgaugcacauuguucacuaacugugucaucaagggcagagaggugaggaaggggcaaaguguacuccggcaguacaaaaccgagauacguauuggaaaggccagcacgggcucucgcagacuguuauccgaagagucaggugacgauugcaucaguaggacacagcugcuacggaccgaaacugcggagauccacggggacaauuauggcggaccgggcgauaaaauuacaaucuguaacgggagcaccauuguugaccagcgacucggaucggagauggguugcuacacuauaaaucgcgugaaguccuuuaaacugugcgaaaacucugccaccggcaagagcugugagaucgauucaauuccugucaagugcagacaaggguauugucuuaaaaucacacaggaaggaaggggccacgugaaguugagucgggguuccgaggucauccuggacgcaugcgauucuagcugugaagugaugauuccaaaagggacgggcgacauacucguugacugcuccggaggccagcagcauuuccugaaggauaaucuuaucgaccuggggugucccucaauuccuuugcucggaaaaauggcuaucuacauuugccgcaugagcaaccaccccaagaccacuauggccuuccuguuuugguucaguuuugguuaugugaucacauguauauuaugcaaggcuaucuucuaccugcuaauuaucguaggcacccucgggaaaagauuuaagcaauauagggagcugaaaccacagacauguacuauuugcgagaccacgccugccaaugcaaucgaugccgaaaugcaugaccuuaacugcucuuacaauauaugucccuacugcgcuucccguuugacaagcgauggacuggcgcggcacgucacccaguguccaaagcgaaaagagaagguggaagagacugaacucuaucugaacuuagagaggauuccguggguugugagaaagcugcuucaggucucggagucaaccggcguggcauugaaacgcucuaguuggcucaucguacugcuagugcuguucgccauuucccucagcccuguucaaucugcucccaucagccacgguaagacaauagaaacuuaccaggcccgggaggaauauaccuccaucugccuguuuguccuugggucaauuuuguucaucgugaguugucugaugaaaggcuuaguggacagcauuggaaauaucuuuuucccaggccucucuauaugcaagacauguuccauugggucaaucaacggauuugagaucgaaagucauaaaugcuacuguagccugcuuugcugucccuauugcagacacugcuccgcagauagggagauucaucagcugcacuugucuaucuguaagaaacgcaagacgggcucgaacgucaugcucgccgcuugcaagcgaauguguuuccgggccaccauggagguuagcaauaaagcacugcuaauucguucaauaaucaacacuacauuugugguguacauucugauccucgcgguaugcgucguguccaccagugcuguugaaauggagucucugccugccgguacuugggaaagagaggaggaccuuacaaauuucugucaucaggaaugccaagugaccgagacggaauguuugugcccauaugaggcacuggucuuaaggcgcccccucuuccuggauagcauugugcgggggaugaagaacccucuuaauuccacuucacuggaaaccucucuaagcaucgaggccccguggggagcuauaaacguucagaguacauacaaaccaaccguguccacugccaauaucgcacucagcuggucuucaguagagcacagaggcaacaagauucuggucuccgguaggagugaaagcaucaugaaauuggaggaacgaacaggcauuucgugggaccuggggguggaggaugcuucugaauccaaguuacucaccgugagcgucauggaccugucacagauguacagucccguuuuugaguaucuuucuggagaucgccaaguggaggaauggccuaaggccacauguacuggcgacugcccagagcggugugggugcaccacguccacaugccugcacaaagaauggccccauagcagaaauuggagguguaacccuaccuggugcuggggaguaggcacugguuguaccugcuguggguuggacgugaaggaucucuucacagacuacaugaucgucaaauggaagguggaguauauaaaaacucguggaauuguuugcguggaacugaccucacaggagcgccaguguagucuaaucgaggcgggcacgcgguuuaaucuggguagcgucacaaucacccuuuccgaaccgagaaacauucagcaaaagcuacccccagagauaaucacucugcacccuaggauugaagagggcuucuuugauuugaugcaugugcagaagguucugucugccagcacagugugcaaauuacaguccuguacccacgggguccccggagaccuccagguauaccaugugggcaaucugcuuaagggggauaaaguuaacggacaccugauccacaagauugagccacauuugaauacuucauggaugucuugggacggcugcgaucucgacuauuacuguaacaugggugauuggccuaguugcacauauaccggggugacgcaacacaaccaugcuucguucgucaaucugcuaaacaucgaaacugacuacaccaagagcuuucacuuccacuccaaacgagugacagcacauggagauacaccccagcuggaccuuaaggcccggccaacauacggcgcuggugagauaacuguacucguggaagucgccgauauggaguuuaccccgaaaaagaucgaaauuucuggccugaaauucgcaucauugacgugcacaggguguuaugcgugcagcuccggaaucaguuguaagguucgcauucacguggacgagccugacgaguuaacugugcaugucaaaucugaugaccccgaugugguugccgcuagcucaucccugauggccagaaagcucgaauuuggcaccgacaguacauucaaagcauuuagcgcuaugccaaagaccucucugugcuucuacaucguagagagggaauauuguaaguccugcucaaaagaggauacucagaagugugugaauaccaaacuugaacagccccaaagcauacugauugagcacaaggggacaaucaucggaaaacagaacaauacgugcacugccaaggcaucguguugguuggagucugucaagaguuucuuuuacggccucaaaaacaugcuguccgguauuuucgggaacuuuuucaugggaaucuuucucuuccuggccccuuuuauacuuuuaauucuguucuuuauguucggcuggcggauccucuuuugcuucaaguguugccgaagaacccgcggcuuguucaaauauaggcaucugaaggacgaugaagagacaggguaccgucggauuaucgaaagacucaauaauaaaaagggaaagaacaaacugcuugacggugagaggcuggcugaucgccgaauagcggaauuguuuagcaccaagacucacauuggcuga

SEQ ID NO: 10365 - RNA, 5055 nt, Artificial Sequence
  derived and/or modified CDS sequence (opt3) from CCHFV(Hodzha)__AY223476.1__GP
augcacauccugcucaugugcgccgugcuuugucugcagcaauacggcuugggggagacccauagacccaacaauggaacagaacacaacaagacuaaugucuuaacgaccccuggugacaaacugagcccagagcuaccgguuuccacagcucucucugugacucccgauucaaguaccguaacaccuaccacuccagugagcggccuggaaggguccggagacgucuauacaucucccccugugaccacgaagggccuuucgccaucaaaagcaacuagcgagcugcccgccaguuccgguauugauaccucuagcgcguccgacguugauucaaguacacaggcugccagggacacuagcaccuugacagugcggaccucuccuccauccucaccgagcacgcccccuacuagccaggauacauaccaucucguccgcaaccugcugucugugaccuccccauggcccgaagagacuacagcaccuagcaagucggggaaagagucuccaguagccaauagcccccacccgguuaccucacgaccuaguagucccccaauaacggugcagggaccuaccgaaaacuccucucauaauacaacuggccaacucgagagcauggcucagucaaccacauuaguccccauggcaaguccaacucagaccgugcugucccagagcgugacaucucuugccguccaagacgcucaccccucaccuaccaaccguaguaagagaaauuuggaaaugguuaucauucugacucuaccacagggccucaagaaauauuacgggaaggugcugaggcuucugcaguugacgcucgaggaggauacagaaggacuguuagaguggugcaaacggaaccugggucucgacugugaugacaccuucuuucagaagcgcaucgaagaguucuuuauuacuggcgaagggcacuucaaugagguacuucaauuuaaaaccccgagcacacuguccaccacugagucuacacaugccgugucgcccacggcggaaccuuucaagagcuauuuugcaaagggauucuuguccaucgauucaggcuacuuuagugccaaaugcuauucuaagaccagcaacuccggucuacagcugauaaaugucacuagacacucaacaaggaucgcugacaccccagggcccaaaauuacaaaccucaagacuaucagcuguauuaaucugaaagccucuguguucaaggagcaucgggaaguugagaucaacgugcuucugccucaggucgcagugaacuuguccaauugccacguaaccauaaaaagucacguuugugacuacagccucgauguggacggaacgguccgccugccacauauucaccauggcggcaccuuuauccccgggacauacaagauugugaucgauaagaaaaacaaguuaaaugaccgaugcacucuguauaccaacugugucaucaaaggaagagaagugaggaagggucaaucuauucuacggcaguacaaaacagagauacguaucggcaaggcuuccacugggucacgcagacuccugagugaggaaagcggagaugacugcauuucgaggacccagcuuuugcggacggagacagccgaaauccacggcgaugacuauggugggccgggcgauaagauaaccauuuguaauggauccacuaucguugaccagcgacugggcucugagcucgggugcuacacaaucaaccgcgugaaauccuucaagcugugcaaaaauucagcgaccggaaagaguugugaaauugauuccacuccuguaaaaugcagacaagguuauugucuuaagaucacccaggagggcagggggcaugucaagcugucucggggaagcgaggugguuuuggacgccugcgacuccucaugugaagugaugauuccaaaaggcacaggugauauacucgucgacugcagcgggggccagcagcacuuucugaaggauaacuuaaucgaccugggauguccccgcauuccucuacucggcaaaauggcaaucuacaucugcagaaugaguaaucaccccaagacgaccauggcuuuccuguucugguuuucuuucggguaugugauuacuuguauacuuugcaaagccaucuuuuacuugcugauuaucguaggaacacucgguaagagguucaagcaauaccgugagcugaaaccacagaccuguacaauuugcgaaacuaccccugcuaacgccaucgaugcagagaugcaugacuuaaauugcuccuauaacauaugucccuacugcgccagccggcugacgucggauggccuugcucgacacgugacacaguguccaaagagaaaagagaagguugaagagaccgaauuguaucucaaucuggagaggaucccguggauuguccgcaaacuacuucaggugucagaaucuacugggguggcgcucaagcggaguuccuggcugaucguccuuuugguucuguuugcagugagcuuaucuccugugcaaagcgcccccauuggacauggcaaaaccaucgagacauaccaggcuagagaggacuauacuuccauaugccucuucguacuggguucaauucuuuuuaucgucaguugucugaugaagggguugguggauagcauuggcaacaucuucuuuccaggacucaccauaugcaagacauguucuaucggcuccauuaauggguucgaaaucgagucacacaaaugcuacuguagucugcuaugcugucccuauugcaggcacugcagcgccgaccgcgaaauucaucagcugcaccucuccaucuguaagaaacgaaagacgggaucuaacguuaugcuggcagugugcaaacggauguguuuucgugccaccauggaggucucgaacaaggcucuuuugauaagaagcauuaucaauacuacauucgugguuugcauccugauuuuagccguguguguagucucaaccuccgcaguggaaauggagagucucccugcgggcacuugggagagggaagaggaucugacaaacuuuugccaucaggaaugucaagugaccgagacggaaugccuuuguccauacgaggcucugguccuacgccggccccucuuccuggacucuaucguuaaggguacuaaaaauuugcugaacagcaccuccuuagagacaucacucucuauugaagccccuuggggagcaauaaaugugcagagcaccuacaagccgacuguaaguacagccaacaucgcucuguccuggagcucuguggagcacagagggaauaaaauucuugucucaggcagguccgaaaguaucaugaagcuggaggagcgaaccgguauuagcugggauuugggcguggaagacgccucggagucuaaacuccugacaguuuccgugauggaccuaagccagauguauucaccagucuucgaauaccugaguggggaucgccaaguggaggaauggcccaaggcaacuugcaccggagacuguccugagcggugcggcugcacgucuuccacaugucuucauaaggaguggccacacagcagaaacuggaggugcaaucccaccugguguuggggaguugggacuggcugcaccuguugcggucucgaugugaaagaccuguuuacagauuauauguucgucaaguggaaaguagacuacaucaagacugaagcuauaguguguguugaguugaccucacaggaacgucagugcagucugguggaggccgggacgcgcuuuaacuuaggaccugucacaaucacccucagcgaaccgcggaauauucagcaaaaacugcccccagagaucauuacucuucacccuagaaucgaggaaggcuucuuugaucugaugcaugugcagaagguauuguccgcgucuacaguguguaagcuccagagcugcacccacgguguccccggcgaccugcagguuuaucauauagggaaccuacugaaaggagauaaggugaauggccaccuuauucauaaaaucgagccacacuucaacacuuccuggaugucaugggacgggugugaucucgacuacuauugcaauaugggagauuggccuucuugcacauacaccggcgugacgcaacacaaccaugccaguuuugucaaccuguugaauaucgaaacugacuacaccaagucguuccacuuucauagcaaaagggugacagcucacggugacacuccccaguuagaucugaaggcacgaccaacauauggggccggagagauuacuguucucguagaaguggcugacauggagcugcacaccaaaaagauagagaucacgggccuuaaguucgccucccugacauguacugguugcuacgcauguucuucaggcauuagcugcaaaguccggauccauguggaugaaccggacgaguugaccguucacgugaaguccgaugacccugaugucguggcggccaguucuagccuaauggcucgcaaacuggaauuugggacagacucaaccuucaaggccuuuuccgcaaugcccaaaaccagucucuguuucuauauuguagagagagaguacugcaagagcuguucuaaggaagauacccagaaaugcgucaacacaaagcuggagcagccacaauccauccuuauagaaaggaaaggaacgaucauuggcaagcagaauaacacuuguaccgcuaaagccucaugcugguuagagagcgugaagucguucuuuuaugggcugaagaauaugcucucuggaaucuucggcaacguuuuuguggguauuuucuuguuucuggcacccuucauccuccugauacuguuuuucauguuuggguggcggauucuguucuguuuuaaaugcugccgaagaacacgcggauuguucaaguacaaacaucuaaaggacgaugaagagaccggcuauaggcguaucaucgagcggcugaauaacaaaaagggcaagaauaaacucuuagacggggaaagacuggccgacaggcgcauugcugagcuuuucaguacuaagacacacaucggauga

SEQ ID NO: 10366 - RNA, 5055 nt, Artificial Sequence
  derived and/or modified CDS sequence (opt3) from CCHFV(Hodzha)__KX013448.1__GP
augcacauccugcucaugugcgccgugcuuugucugcagcaauacggcuugggggagacccauagacccaacaauggaacagaacacaacaagacuaaugucuuaacgaccccuagcgacaaacuguccccagagccgcccguuucuacagcucuaucagugacuccugauaguagcaccguaacaccaaccacucccguguccggucucgaaggcucuggggaggucuauacaucgccuccagugaccacgaagggacugucacccagcaaagcaaccagugaacuuccugccacuacaggcauugacacuuccucugcgagcgauguugacuccucaacccaggcugccagggauacaaguacccugacggugcggacuagcccaccgucuucccccucaacaccuccaaccagccaggacacuuaccauuugguccgcaaccuccugagugugacaucuccccgaccugaggagaccacggcaccauccaagagcgguaaagaaucgcccguagccaauucuccgcacccuguuaccucccgucccucaaguccaccuauaacagugcaggggcccacugagaacagcucccauaauaccacaggacaacuggaaucuauggcucagagcacuacccucgucccaauggcaucacccacacagaccguguuaagucaguccgugacuagccuggccguccaagaugcucacccuucuccaacgaacagaucaaagaggaaucuugagauggagaucauuuugacacugccgcagggccuaaagaaauauuacggcaagguucuccggcugcuucagcugaccuuggaagaggacacugaagggcuccuggaguggugcaaacgcaacuuaggacuggauugugacgauaccuucuuucagaagagaaucgaagaguucuuuauuacaggugagggccacuucaaugaagugcuccaauuuaaaacccccaguacucuuagcacaacggaguccacccaugccguaucuccuacugcggaaccauucaagucguauuuugcaaagggguuccugagcaucgacuccggauacuuuucagccaaaugcuauaguaagacaucuaacagcggcuugcagcuaauaaaugugaccaggcacuccacacggaucgcugauacucccgguccuaaaauuaccaaccugaagacgaucucauguauuaaucucaaagccagcgucuucaaggagcaucgcgaaguggagaucaacguucugcuuccacagguggcagucaaccugucuaauugccacgugaccauaaaaucccacguaugugacuacaguuuggacguugaugggacagugcgacucccccauauucaccauggaggcacuuuuaucccgggcaccuacaagauugucaucgacaagaaaaacaagcugaaugauagaugcacauuauauacuaacugugugaucaaagggagggagguccggaagggacaaagcauucugcgucaguacaaaaccgaaauacgcaucgguaaggcuucuacgggcuccagaaggcuacucucagaggaaaguggggacgauugcauuagccggacacagcugcuucgaaccgagacugccgaaauccacggagacgauuauggcgguccuggggacaagauaacaauuuguaauggcucgaccaucguggaucagcgcuugggauccgagcugggcugcuacacuaucaacagaguuaaaucuuucaagcucugcgagaauagcgcgaccgggaaaucaugugaaauugacaguacaccagugaagugcaggcaaggauauugucugaaaaucacgcaggagggucggggccauguaaaacuuucccgcgggucugaagucgugcuggaugccugcgacagcuccugugagguuaugauucccaagggaaccggcgacauauugguggauugcucaggugggcagcagcacuuucucaaagacaaccugaucgauuuaggcuguccuaggauuccccugcuaggaaagauggcaaucuacaucugcagaaugagcaaucacccagagacuacaauggcuuuccucuucugguuuaguuucggcuaugucauuaccuguauacugugcaaagccaucuuuuaccuuuugauuaucguggggacacugggaaagcguuucaaacaauaccgggaacucaagccucagacuuguaccauuugcgagacgacacccgcuaacgccaucgacgcagaaaugcaugaucugaauugcucuuauaacauauguccauacugcgccucccgauuaaccagcgacggucuggcuagacacguaacucaguguccgaagaggaaagagaagguggaagagaccgagcuuuauuugaaucucgaacgcaucccuuggauuguucggaaacugcuacaggucucggagucaacaggcguggcgcugaagagaucuaguuggcucaucgugcugcuugucuuguuugcaguuucccugagccccgugcaaucugccccaauugggcauggaaaaacuaucgaaaccuaccaggcuagggaggaauauacaagcauaugcuuauucgugcucggcuccauucuguuuaucguaucaugucuuaugaagggucuggucgauaguauugggaacaucuucuuucccggcuugacgauaugcaaaaccuguagcaucggaucuauuaauggcuucgagaucgagucccacaagugcuacuguucacuccugugcuguccuuauugccgccacugcccagccgaccgagaaauucaucagcuacaccugaguaucuguaagaaacggaagacugggagcaacgugaugcucgcaguuugcaaacguauguguuuuagagccacaauggagguguccaacaaggcucugcuuauaaggucuauuaucaauaccacuuucgucgugugcaucuugauucuggccguuugugugguaucgacaagcgcagucgaaauggagucauuacccgcgggaaccugggaacgcgaggaggaucucacgaacuuuugccaucaggaaugucaagugacugagaccgaaugccuguguccuuacgaggcucuugugcugcggagaccgcuauuccucgacuccaucgucaaaggcaagaagaaucuguugaacaguacaucucuggagaccagcuuauccauugaagccccauggggugcaauaaauguucagucaacuuacaaacccacagugucuaccgccaacaucgcucucagcuggaguuccguagagcacagggggaauaagauucuggugagcggacgaucugaaucaaucaugaaacuugaggaacgcacaggcauuuccugggaucugggugucgaggacgccagugagagcaaguugcucacugugucgguuauggaucugucucagauguauuccccuguguucgaauaccuaagcggcgaccggcaagucgaggaauggccaaaagcaaccugcacgggggacuguucagagagaugcggaugcacaaguucuaccugucugcauaaggaauggccccacuccaggaacuggcguugcaauccuacuugguguuggggcguggggaccggaugcacauguugcggccuugauguuaaggaccucuuuacugauuauauguucgugaaauggaaggucgacuacaucaaaaccgaggcuauaguauguguggagcugacgagccaggaacgccagugcucauugguugaggccgguacacgguuuaaccuggggccggugaccaucacuuuaagugaacccagaaauauucagcaaaagcucccaccugagaucauuacacugcaccccaggaucgaagagggauucuuugaucuuaugcauguccagaaagugcugagcgcguccaccguauguaaguugcagucuugcacucacggcgugccaggugaccuccaggucuaucauauaggcaaccugcuaaagggggauaaaguuaauggacaccugauucauaagaucgagccucacuucaacacaagcuggauguccugggacggcugugaucuugacuacuauugcaauaugggggauuggcccucaugcaccuacacgggagugacucaacacaaccaugccucuuuugugaaccuccugaauaucgaaaccgacuacacaaaaaguuuccacuuucauucgaagcgagucaccgcucacggcgauacaccacaguuggacuuaaaagcacggccgacuuauggugccggggagauuaccgugcugguugaaguagcugacauggagcuccacacgaagaaaauagagaucacaggacugaaguucgccagccuuacuuguaccggcugcuacgcauguuccucugguauuucaugcaaggugcgcauccaugucgaugaaccugacgagcugacagugcacguuaaaagcgaugaccccgauguggucgcggccuccaguucuuugauggcuagaaagcuagaauuuggcaccgacagcacuuucaaagccuuuucagcaaugccaaagaccucccuguguuucuauauuguggagagggaauacugcaaaaguuguagcaaggaggauacacagaagugcguaaacacgaaacucgagcagccccaaucuauccugauagaacagaaggggacuaucauuggaaaacagaauaacaccuguacagcuaaggccuccugcuggcuugagucagucaagagcuucuuuuauggcuuaaagaauaugcugucggggaucuucggaaacguguuuguuggcauuuuccucuuuuuggcaccuuucauccugcucauacuguuuuucauguuugguuggcggauucuuuucuguuuuaagugcugccgaagaacccgcgggcuguucaaauacaagcauuugaaagacgaugaagagacuggauauaggcguaucaucgaacggcuaaauaacaagaaaggcaagaauaagcugcucgacggcgagagauuagccgauaggcgcauugcugagcuguucucuacaaaaacccacaucggguga

SEQ ID NO: 10367 - RNA, 5055 nt, Artificial Sequence
  derived and/or modified CDS sequence (opt3) from CCHFV(Baghdad 12)__AJ538197.2__GP
augcacaucagccugauuuacgccgugcucugccuucagcuguauggcuugggggagacccauggauccucuucagguacagaacacaacagaacuaaugucguugcuacgcccggcgggagucaaagcccugagccauuaguguccaccacacugccgguaacucuagacucuucgaccgugacacccgcaacccaggccucaggaccugaaggcagcggugaggucuacacaaguccacccacuaccacggaagggcucuccccuucugaugcgacuagcgagcugccaaccacaacuggaauaggcaucuccucaaguagcgacgugaacucuuccacccaggcugccggcgauacaucaacccccacggcaaggacuagccuuccugacaguccaucuacaccgcccaccucccaggauacucaucacccuaugcggaaucuguugagcguuacaucgcucaagccagaggaaacccccgccccuucuaaauccgggaaggagucaccagcugcaaguagcccccauccgguggccucccgcccucccacgccaucuaccacagcucaaggaccuacugaaaacaauagccgaaacaccacaguccagcugaaaucagugacucagagugccacccugggucccauggcguccccaacacagaccguacucuuacaaagcguuacuucuauugcaauccaggacacgcaccccucaccuacaaaucguaguagaaggaaccuggagauggagauuauccuuaccuugccacagggccugaagaaauauuacgggaaggugcuacggcuccugcagcuuacucuggaagaggauaccgaaggauugcucgagugguguaagcgcaaucugggcuuagacugcgaugacacauucuuucagaaaagaauagaagaguucuuuaucaccggugaggggcacuucaacgaaguccugcaguuuaggacuccgggaacacucagcacgaccgaguccacucaugccggcucucccacaguggaaccuuucaagucguauuuugcuaaaggcuuccuucugauugauagcggguacuuuuccgccaaguguuauucacggaccaguaauucuggauugcagcuaaucaacgugacacgccacagcacuaaaauugcagacaccccaggucccaagaucacgaaucugaagaccauauccugcauuaaccucaaagcuagcaucuucaaggagcaucgagaaauugagaucaauguccugcuuccucaaguugccgugaaccugagcaacugucacguaacaaucaaaucucacgugugcgauuacuccuugaauauugacggcacugucaagcucccacauauacaccaugaggggaucuuuauucccggaaccuacaaaaucgugauagacaagaaaaacaagcugaaugauagauguacauuauucacuaacugcguuauuaagggcagggaagugcggaaaggucagaguguccugcgucaguauaagaccgagauccgcaucgggaaagcgagcacgggcucuagaaggcuacucuccgaagagucaggagacgauuguauuagucggacacgacugcuucgcaccgaaacugccgagauccacggcgacagcuacgggggaccgggugauaagauuacaauaugcaauggcucgaccaucguggaccagagauugggguccgagaugggauguuauacuauuaacaggguaaaaucuuuuaagcugugcgaaaauagcgcaaccggcaagucaugcaaaaucgauaguaucccuguuaagugucggcaagguuacugccucaaaauuacacaggaggggcgcggccaugugaagcuguccagaggaucugaagucgugcuugacgcuugugauagcuccugcgaggucaugauaccaaaaggcacgggggacauccugguggauuguucaggaggucagcagcacuucuugaaggacaaccucauugaccugggcugccccaauaucccuuuacuggggaagauggccauuuauaucuguaggaugagcaaccaccccaaaaccacuauggcuuuccuauuuugguucaguuuuggauacguuauaacaugcauccucuguaaggccauuuucuaucugcuuaucauugugggcaccuuggguaaacguuuuaagcaauaccgggagcugaaaccacagacaugcacuaucugugaaaccacgccuguaaaugcaauagaugccgagaugcaugaccucaacugcucuuacaauauuugccccuauugugcuucccgacugacaagcgauggguuagcgagacacgucacccagugcccaaagaggaaggaaaaaguggaggaaacugagcuguaccuuaacuuggagcgcaucccguggguugugcggaagcuccugcaggucucggaaucaaccggcguggcacuaaaaagaucuaguuggcugauuguacuccuggugcuuuuggccguuuccagcucuccuguccaaagcgcucccaucggauauggcaagacaauagagacuuaccaggccagggaaggguauaccuccaucugucuguucguguuaggaucaauucucuuuaucgugaguugccugacaaaaggccuugucgacagcauugguaauaucuucuuuccagggcugucuauauguaagacgugcuccauuggaucaaucaacggcuucgagguugaaagucauaaauguuacugcagcuugcucuguugccccuauugucgccacugcuccgcagaucgagagauccaccagcugcaucuaucuauuugcaagaagcggaaaaccgguucgagcgugaugcuggccguguguaagcguaugugcuuuagagcuacuauggagguaucaaacaaagcccuccugaucagguccauuauaaauacaaccuucgucguguguauccuuacuuuggcaguuugcguggucaguacaucugcgguggaaauggagagccugccugcuggcaccugggaacgcgaggaagacuuaacgaacuuuugucaccaggagugccaaguuacugagaccgaaugucucugcccauacgaggcccuggugcuucggaagccccuguuccuagauuccauuguaaaagggacaaagaaucuccugaacucaaccucuuuggaaacuagccugaguaucgaggcaccuuggggagccauuaauguccaguccacauacaagccgaccgugagcacagcuaacaucgccuuaucuuggucauccguggagcauagaggcaauaaaauacucgucagugggaggagcgaaucgaucaugaagcuggaggaacgaacuggaauuucuugggaccuuggcguugaggaugcauccgaaagcaaacuguugaccgugucaguaauggaccucagucagauguauucuccaguguucgaguaccuguccggugaucgccaagucgaggaauggcccaaggcuacguguacaggggacugcccugagcgguguggaugcaccacuucaaccugccuacacaaagaauggccacauucaagaaacuggagguguaaucccacauggugcuggggcguggguacuggcuguaccugcugugggcuggauguuaaggaccuuuuuacggacuauauguucgugaaguggaaagucgaguacaucaagacagaugccauugugugcguugaacucaccagucaggagcgucaguguagccugaucgaggcgggaacucgcuuuaacuugggcuccgugacaauaacccugucugaaccucggaauauucagcaaaaauuaccgcccgagaucaucacucuccacccaagaauugaagagggguucuuugaccugaugcacguccagaagguacuuagcgccuccacagugugcaaacugcagucauguacccauggaguuccuggcgauuugcaaguguaucacauagguaaccuccugaagggggacaaggucaauggacaucuaauccacaaaauugaaccccauuucaacacgucuuggaugaguugggauggcugcgaccuggauuacuauuguaauaugggugacuggccaucgugcacuuacaccggcgugacacaacacaaccacgcuagcuuuguaaaccuucucaauaucgagaccgauuacacaaaguccuuccauuuucacucuaaaagggugacugcacauggggacaccccucagcuggauuugaagguccgacccacguauggagccggcgagauuacaguuuuaguggaaguggcugacauggagcugcacacuaaaaagaucgaaauaucagggcucaaauucgccagccugaccugcacaggauguuacgcaugcuccaguggcaucucuuguaagguccggauucacguggaugagccagacgagcuuaccguucauguaaagagcgacgauccggacguggucgcggccucauccagucugauggcucgcaaauuggaauuugguacugauagcaccuucaaggccuuuucugcaaugccuaaaacaucccuaugcuucuauaucguggagagagaauacuguaagucaugcagcaaagaggacacgcagaaguguguuaacacuaagcuggaacagccccaaucgauucucaucgagcacaaagggaccauaauuggaaagcagaauaacacaugcaccgcuaaaacuucuuguuggcuggagagugugaaguccuucuuuuauggccuuaaaaauauguuaagcggcaucuucgggaacuuuuucaugggaaucuuucuguuccucgccccauuuauuuugcugauccucuucuuuauguucgguuggaggauacuguuuugcuucaaguguugccggcgaacaagaggccuuuucaaguaccgccaucugaaagaugacgaagagaccggguauaggcguauuaucgaacgguugaauaacaagaaaggaaagaauaaacuacuggauggcgagagacucgcagacaggcgcauugccgaauuauuuucaacgaagacucacaucgguuga

SEQ ID NO: 10368 - RNA, 5055 nt, Artificial Sequence
  derived and/or modified CDS sequence (opt3) from CCHFV(TADJ/HU8966 )__AY179962.1__GP
augcacaugcugcucaugugcgccgugcuuugucugcaguuguacggcuuagggggaacccugagaagcaacaaugguacagagcauaacaagacuaauguccuaacgacccccggcgacaaacucuccccugaaccaccgguuucuacagcucugcccgugacuccugauucaaguaccguaacaccaaccacucccgcaagcgggcuugagggauccggcgaaguguauacaucuccuccaaucaccacgaagggucugucgcccucagaggccacuagcgaaccuccagcgaccacagggaugggaauuaguuccgcuucuggcgucgacuucagcacucaagccgcaagggauaccuccacauugaccgugcucacgucaccgcccaacaguccuaauacuccacccacaagccaggacacccaccauccuguucggucucugcuguccgugacuucaccacgccccgaggagacaaccgccccgagcaaaaguggcaaggaaucuccugcugcaaacuccagccaccccgucacgucgcgaccaucuuccccucucauaaccgugcgugggcccacagaaaauucaagucauaacacuaccggacaguuagaaagcaugacacaguccacuacccugguaccaauggccucucccacacaaaccguucuuagccagucagugacuuccaucgcuguccaggaugcccacccuuccagcacgaauagaucuaaaaggaacuuggagauggagauuauccugacacuaccacagggucucaagaaguacuauggcaaagugcugcggcuucugcaauugacccucgaagaggacacugaagggcuguuagaguggugcaagcgcaaucugggacucgauugugacgauaccuuuuuccagaaaagaauugaagaguuuuucaucacaggcgagggucacuuuaacgaagugcuucaguucaggaccccggggacucugucaacaacggagaguacccaugcgggaagccccacugcagaaccuuuuaaguccuacuucgccaaaggcuuuuugucuauagacucgggcuauuucagcgcuaagugcuacucccggacaucaaauagugggcuacgccugaucaacgucacccgacacucuacaagaauugccgauacuccaggacccaagaucaccaaucucaaaacgauuagcuguaucaaccugagggcauccauauuuaaggagcaucgggaaguugagauuaacgugcuucugccucagguagcugugaauuugucaaacugccacgucgccaucaaaagccacgugugugacuauucucucgauguugacgguaccgugcgucugccacauauucaccauggcgggacauucauccccggaacuuacaagaucgucauugacaaaaagaauaaauuaaacgaucgcugcacccuguuuacaaauugugugauaaagggcagagagguaaggaagggucaauccauccuacggcaguacaaaacugaaauucgaaucgggaaggcgaguaccggcagccgcagacuccugucugaggaauccggagacgauugcauaucaaggacgcagcuuuugcggacagagaccgccgaaauucacggcgacgauuaugggggaccgggugacaaaaucacuaucuguaacggcaguacaauuguugaucaacgccuggggagcgagcucggaugcuacaccaucaauagagugaagucguucaaacugugcgagaacuccgcaacuggcaagaauugugaaauugacucugucccugugaagugcaggcaggguuauugucuuaaaauaacccaggaggggcguggccaugucaagcugagccggggaucagaagugguuuuggaugcuugcgacaguuccugugaggugaugaucccaaaaggcacaggggauauuucuguagacugcagcggaggucagcaacacuuccucaaggacaaccugaucgauuuaggcugucccaaaaucccucugcuagggaagauggccauuuacauaugccgaauguccaaucaccccaagacgaccauggcuuuucucuucugguuuucauucggauaugucaucacuagaauuuuauguaaagccaucuuuuaccuuuugauuaucgugggcacacuggguaagagguucaaacaguaucgcgagcucaagccacagaccugcacaauaugugaaacuaccccugcaaacgccaucgacgcugagaugcaugaucugaauugcagcuacaacauuugccccuacugugcgagucgguuaacgucugacgggcuggcaagacacguuacacagugcccaaaaaggaaggaacgcguggaggaaaccgagcuuuauuugaaucucgagcgaaucccguggauuguccggaagcugcuacaaguguccgaaagcacuggcguagcccugaaacguucgucauggcucaucgugcugcuuguuuuguuuaccgucucucugaguccugugcaguccgcucccauaggauacggcaacacaauugagacuuaucaggccagagaagaguacaccagcaucuguuuauucgugcucgggucuauucuguuuaucgucagcugccuuaugaagggacugguugauuccauaggcaacaucuucuuuccagguuugacaauuuguaaaacgugcucaaucgggaguauuaauggauucgaaaucgagagccauaaguguuauugcucucuccuguguugccccuacuguaggcacugcuccgcagaccgcgagauacaccagcuacaucugucaauuugcaaaaagcggaaaaccggcaguaacgugaugcucgccguguguaagagaaugugcuuuagggcuacuauggaaguaagcaauaaggcccugcuuauccgauccaucauuaacacaaccuucgucguguguaucuugauucuggcaguuugcauagugucuacuucggcggucgagauggaaagccugccugcugguacaugggagcgcgaagaggaucucaccaauuucugucaccaagagugccaggugacggaaacugagugucugugcccauaugaagcccuuguucugcggagaccccuauuucucgacucaaucgugaaaggcaugaagaacccucugaauaguaccaguuuggagacaucucugagcauugaggcaccguggggagccaucaacguacaguccaccuacaaaccaacugucucaacagcuaauauugccuuaucuuggagcaguaucgaacauagggggaacaauauacucguguccggccguagcgagucuaucaugaagcuggaggagcgcaccgggauuucaggagaucuuggcguggaagacgcauccgagaguaaacuguugacagucagcguuauggaucucucgcagauguacucucccguguucgaguaucuguccggugaccggcaaguagaagaguggccuaaggcuacuuguaccggggauugcccagaaagauguggaugcacgagcucaacaugccuacacaaggaguggccccauaguaggaacuggcgauguaauccuaccuggugcuggggcguggguacuggcuguaccugcugugggcuggacgucaaagaccuuuuuaucgauuacauguucgugaaguggaaaguugacuauauuaagacagaagccaucgugugcgucgagcucacuucucaggagcggcaguguucccugguggaagcgggaacccgcuuuaacuugggcccgguuacgauaacacugagcgagcccagaaauauucaacagaaauuaccaccugaaaucaucacccuccaccccaggauugaggaaggguucuuugaucugaugcacgugcagaagguccuuucagccaguacuguaugcaagcugcagagcuguacacauggagugccaggcgacuugcaaguuuaccacauagguaaccuccugaaaggggauaaggagaacggacaucuaauccacaaaauugagccucauuucaauaccuccuggaugucuugggacggcugcgaucuggacuauuacuguaacaugggugauuggcccagcugcacuuauacaggcgugacccagcacaaucacgcuuccuuugucaaccuucucaauaucgaaacggacuacacuaagucauuccauuuucacucuaaacgggugaccgcacauggggauacaccacagcuggacuugaaggcccgaccgaccuacggagcuggcgagauuacaguauuaguggaagucgccgauauggagcugcacacuaagaaaaucgagauaaccgggcucaaguucgcaagucugacgugcacaggauguuaugcgugcucgagcggcaucuccuguaaaguucgcauucacguggacgaaccugacgagcuuacugugcaugucaagucugaugaccccgaugugguugccgcuucaagcucccugauggccagaaaauuggaauuugguaccgacaguacauucaaggcauucucugcuaugccaaaaaccagccuaugcuuuuacaucguagagagggaauaucguaagucauguuccaaggaggauacucagaaaugcgugaacaccaagcuggagcaaccccagaguauucucaucgaacacaaagggacaauaauuggaaagcagaauaacacguguacugccaaagcaagcugcuggcuggagucugucaaguccuucuuuuacggccuuaagaauauguuaucaggcaucuucgggaacguguuuguuggaaucuuccuguuucucgccccuuucauuuugcugauccucuuuuucauguuugguuggcggauacugagcuguuucaaaugcuguagaaggacccgcggccuucugaagcaucgacacuugaaagacgaugaagagacaggguauagacggauuaucgaaaggcuaaauaacaagaaaggaaagaauaagcugcucgacggcgagcgcuuagcugaucguagaauugcggagcuguucucgaccaaaacucauaucgguuga

SEQ ID NO: 10369 - RNA, 5055 nt, Artificial Sequence
  derived and/or modified CDS sequence (opt3) from CCHFV(K168_40)__KX013457.1__GP
augcacaucagccugaugugcgccgugcucugucuucagcuguacggccucgggggaacccaugguuuacacaacggcacagagcauaauaagacuaacgcugucacgaccuccucuaauucacaaaguagcgaaucccccgcaagaacagccccuccaguuacuccggacucucccaccgugacaccuaccacuccagcgucggcucccgaggggucaggagaagcccacagcaguccuccaaacaauacagagggccccucccugccugaaucuaccagcgagccaccggcagccacguccacugguauucccucagcuagugauguaaacagcucuacccaggcagccagggacacauccacuccuaccgugcggacaucaccacccaauagcccuaguaccccacccacgccgcaggagacucaucacccuguccgcaaccuacucucugugacaucccacaaacccgaagagaccagcgcuccaucggaaucugggaaggaguccccugccgcaaauucaccccauccaguugcgagucgacccccuacuccaagcacaaccgcccagggaccgacggagaacaauaacuauaauaccacaggccaacuggaaucccuuacucagucuaccacacugggccccaugacuagcuugacccagacagaucucccucagucagugaccaguauagcuguccaagacacucacccaucccccacgaaccguagcaaaagaaaucuggagauggaaaucauucugacacucccucagggguuaaagaaauacuauggaaaggugcugaggcuuuugcagcugacccuagaggaagauacugagggucuccuggaguggugcaagcggaaccuuggccuggacugugaugacaccuucuuucagaaacgcaucgaagaguucuuuauuacaggggaaggacauuucaacgagguauugcaauuuagaaccccaggcacucucucuacaacggaaucaacccacgccggucugcccacugcagagccguucaagaguuacuuugcuaaaggguucuuaagcaucgauuccggauauuuuucugccaagugcuacucgaggacaagcaauuccggccugcagcucauaaacguuacccggcacucaacacgcaucgcggacacuccuggcccaaaaauuaccaaucuuaagacgaucaguuguauuaaccugaaggccucuguguucaaagagcaucgagaagucgagaucaauguguugcuaccccagguggcagucaaccugagcaauugccacguuaccauaaagucccaugugugugauuauucacucgacauugaugggacaguaagacugccucacauccaucacgacggaacuuuuauucccgguaccuacaaaaucgugaucgacaggaagaacaaacuuaaugaucggugcacacuguucacuaacugugucauuaagggccgugaagugcgcaaagggcaaagcguuuugagacaguacaagaccgagauaaggaucggaaaggcuucuacgggcucccggcgacuccugagugacgaaagcggugaugacugcauuucucgcacacaguuacugagaaccgagacugccgagauccacggggauaauuauggcggaccaggcgacaaaauaacaauuuguaacggguccaccaucguggaucagaggcuaggaucagaacucgguugcuacacuaucaaucgggucaagaguuuuaaacugugcgagaacagcgcuaccggcaagucgugugaaguggacuccauuccuguaaaaugccgccaaggguauugucuuaagaucacacaggagggaagaggccauguuaaguugucuagggguagcgaggugguccuggaugccugcgacucaaguugugaagugaugauucccaaagggacgggcgauauacucgucgacugcuccggaggccagcagcacuuccugaaggacaaucuuaucgaucugggguguccaaaaauuccguugcucggaaagauggcaaucuacaucugccguaugucuaaccauccuaaaaccacuauggccuuccuguuuugguucagcuuugguuaugugauuacauguauaguuugcaaggcuaucuucuacuuacugauuaucgugggcacccuagggaagcgguuuaaacaauaucgagagcucaagccccagacauguacuauuugcgaaaccacgccaacaaacgcgaucgacgcagagaugcacgaucugaauugcuccuacaacauaugucccuacugcgccucaagacuuaccagcgacggauuggcuaggcacguaacucauuguccuaaacgcaaggaaaaagucgaggagaccgaacuguaucucaaucuggagcggaucccaugggugguuagaaaguuacuucaggugagugaaucuacaggcgucgcccuuaagagguccagcugguugauugugcuccugguacuauucgcagugucgcugucacccguucagucugccccuaucggucacgggaaaacuauugagaccuaccaaguccgcgaagaguauacaaguaucugccucuuugugcugggcuccauacuuuucauugugagcuguuugaugaagggacuggucaacucuguuggcaauaucuuuuucccgggguuaagcauuugcaaaacguguuccaucggaucaauaaacggcuuugagaucgaaagucauaagugcuacuguagccuccugugcuguccauauugccgacacugcucugcugaucgggagauucaucagcuucaccuguccaucuguaaaaagcguaaaaccgguucaaaugugauguuggccgugugcaagagaauguguuucagggcaacuguagaagucaguaacaaggcgcucagcauucgcuccaucauaaauacaaccuuugugguuugcauucugauccuagcugugugugucgugucuacuucggccguugagauggaaagccugcccgcagggacaugggagcgggaggaagaccucaccaacuucugccaccaggagugucaggugacggaaacugagugccuguguccuuacgaggcccuuguauugagaaggccacuguucuuagauggaaucgucaaaggcaugaagaaucuccugaacucaaccucccuugaaacaagucugucuauugaggcucccuggggugccaucaaugugcaaagcaccuauaaaccuacuguguccgcagcuaacauugcccuaucauggucuagcgucgaacaucgaggcaauaagauacucguuagugggcgcuccgagagcaucaugaaacuggaggaacggacaggaauuucuugggacuugggcguggaggaugcgucagaauccaagcuguuaaccguaagugugauggaccucagccagauguacucgccggucuuugaguaccugucuggggauagacagguggaagaguggcccaaggccacaugcacuggagacuguccagaaaggugcggcugcaccuccagcacgugucuucacaaagaguggccucauucacguaacuggcgcugcaaccccacaugguguugggguguugggaccggaugcacuuguugcggccuggaugugaaggacuuguucaccgacuauauguuugucaaauggaagguggaguacaucaaaacagaagcuauuguuuguguggagcucacaagucaagaacggcagugcucucugaucgaggcagguaccagauucaaucuaggcccagucacgauaacacuguccgaaccuaggaacauccagcagaagcugcccccagagauuaucacccuccacccgcgaauugaggaaggguuuuucgaucugaugcauguacaaaagguguugagcgccucaacuguuuguaaacugcagaguugcacacacggagugccuggcgacuuacaggucuaucacaucgggaaucuccugaagggagauaaagugaacggccaucuuauacacaagauugagccccauuuuaauaccagcuggauguccugggacgguugugaucuggacuacuauugcaacaugggggauuggccaucuugcacuuacacaggaguaacccagcacaaucacgcuagcuucaucaacuugcucaauaucgaaacggacuauacuaaauccuuucauuuccacucaaagcgggugaccgcccauggcgauacaccccaacuggaccuaaaggcacgcccuaacuacggugcgggcgagauuaccguccugguugagguggccgauauggaacuucacacuaaaaagauagagaucucugggcucaaauuugcuagucugacuuguaccggaugcuacgccuguucgagcggcauuuccugcaaggugagaauccaugucgacgaaccagaugaguugacggugcacguuaaaucugacgaccccgauguaguggcagcuucaagcuccuuaauggccaggaagcuggaguucgggacagacaguacuuuuaaagcauucucugccaugccuaagaccagccucuguuucuauauugucgaacgggaguacugcaagucauguuccaaagaagauacacagaagugcgugaauaccaaacuggagcacccgcagaguauccuuauagaacauaagggaacuaucauuggcaaacagaacaauaccuguacagcuaagacgagcugcuggcuggagucuguuaaguccuuuuucuaugguuugaaaaacaugcuaucagggaucuuuggaaauguguucgucggcauuuuucuguuccucgcgccauuuauccugcuuauauuauucuuuauguucggcuggcgaauccuguuuuguuucaagugcugcagacgcacuaggggguuguuccguuacaaacacuuggaagacgaugaggagaccggauaucggagaauuaucgaaaggcugaacaacaagaaagguaagaauaagcuccuggacggcgagcgccuugccgaucgaagaauugcagaacuguuuagcacaaaaacccauaucggguga

SEQ ID NO: 10370 - RNA, 5055 nt, Artificial Sequence
  derived and/or modified CDS sequence (opt3) from CCHFV(K128_76)__KX013454.1__GP
augcacaucagccugaugugcgccgugcucugucuucagcuguacggccuagggggaacccaugguucccacaacgagacagaacauaauaagacuaacgcugucacgaccucuucagacagucaaagccccgagccuccaacaagaacuaccuuaccgguuacacccgauuccccuaccgugacuccaacaacccccgcaucugccccugaaggcucgggggagguacacacgucaccacccaauacuaccgaaggaccuagccugccagagaguacaccggagcccccuacugcgaccuccacaggcauuccaucugcuagcgacgugaacuccucaacccaggccgcaagggauacgaguacucccacaguccauaccagcccuccaaauucucccuccacuccgccuacacuacaggaaacccaccaccccaugcggaaccuccugucagugacgagccauaaaccagaggaaaccagugccccuucugaguccgguaaggagagccccgcugcaaauucgccacaccccguugccgaccgcccuucuacauccucaacuaccgcucaggggccaacagaaaacaauaguuauaacacuaccgagcaacuugaaagccugacacaguccaccacuuugggaccgaugacgucucucacacagaccgugcugagccagucagucacaaguauagccgugcaagauacccaucugucccccacaaaucgaagcaaacguaaccucgagauggaaaucauuuuaacccugccucagggccuuaagaaauacuauggcaagguauugagacugcuacagcucacucuggaggaggacacagaagggcuucuggaguggugcaagaggaauuuggaucucgacugugaugacacguucuuucagaaacggaucgaagaguucuuuauuaccggagaagguuacuucaacgagguucugcaauuucgcacuccaggcacauuaucuaccacagagucaacucacgcggggcugcccaccgcagaaccuuucaagaguuauuuugccaaaggauuccucagcaucgauuccggcuacuuuucugcuaagugcuauucgagaacgagcaauuccggucuucagcugauaaacgugaccaggcacucaacacggaucgccgacacuccagggcccaaaauuaccaacuugaagacaaucaguuguauuaaucuaaaggcaucugucuucaaagagcaucgcgaaguggagaucaacgugcugcucccgcaggucgcuguuaaucugagcaacugccacgugacuauaaagucccauguaugugauuacucacuugacauugacggaaccgugaaacugccucacauccaucacgauggcacguuuauuccaggcacauacaagaucgucaucgaccgaaagaauaaguugaacgauagaugcacccucuucacuaauugugugauuaaagggagggaaguucggaagggacaaagcgugcugcgucaguauaagacagagauacgcaucgguaaagccucuaccggcuccagaagguuacugagugacgagagcggggaugacugcauuucucggacucagcuacuccgaaccgaaacagcggagauccacggagauaacuacggcggucccggggacaagauaacgauuuguaauggcuccaccaucgucgaucagcgccugggaucagaacuuggcugcuauacuaucaacagagugaaaaguuuuaaguugugcgagaauagcgccacagggaaaucgugugagauugacuccaucccuguaaagugcaggcaaggauacugucugaagauuacccaggaaggucggggccauguuaaacucucucgcgggagcgaggugguccuggaugcaugcgacucaaguugugaagugaugauacccaagggaacaggcgacauccuugucgauugcuccggugggcagcagcacuuccugaaagacaacuugauugaucucggcuguccaaagaucccucuguuaggaaaaauggcuaucuauauuugcagaaugucuaaucaucccaagacuaccauggccuuccuguuuugguucagcuuuggcuacgugauaacguguaucguuugcaaggcuauuuucuaucuacucaucauuguggggacacugggaaaaagguuuaagcaauaccgugagcuuaaaccacagaccuguacuaucugcgaaaccacaccgacuaacgccauagacgcagagaugcacgauuugaauugcuccuacaacaucuguccuuauugcgccucacggcugaccagcgacggucucgcucgacacguaacacauugucccaagagaaaagagaaggucgaagagacggaacuguacuuaaaccuggagaggauuccaugggugguucgcaaacuucuccaggugagugaaucuaccggcgucgcgcucaaacgguccagcuggcugaucgugcuacugguacucuucgcagugucgcugucacccguucagucugccccuauuagucacgggaagacuaucgagacauaucaagucagagaggaauacaccuccauaugccuuuuuguguugggaagcauucuguucaucgugucuuguuuaaugaaaggccucgucaauagcguugguaacaucuuuuucccagggcuguccauuugcaagacuuguucaauaggcaguaucaauggauuugagauugaaagccauaaaugcuauuguucucuucugugcugucccuacugcaggcacugcuccgcugaucgcgagauccaucaguugcaccucucaauuuguaagaaacgaaagacaggcaguaacgugaugcuggccgugugcaagcggauguguuuccgugcaaccauggaaguaagcaauaaagcccuauuuaucagauccauaauuaacacgacuuucgucgugugcauccugauccucgcuguuuguguggucucuaccucggccguggagauggagagccugccugcagggacaugggaaagggaggaagaccuuaccaauuucugccaccaggagugucagguuacugagacagaaugcuuguguccguaugaggcgcugguguuacgccggccacucuuucaagauucaauuguaaagggaaugaaaaaccugcuuaauuccaccagucuggaaacaucucuaagcaucgaggcucccuggggcgccauuaacguccaguccacuuacaagccugcagugucagccgcuaauauagcccucucuuggagcaguguggaacauagagguuccaaaauccuggucagcgggaggucugagucaauuaugaaguuggaggaacgaaccggaaucuccugggaccugggcguugaggaugcaagugaaagcaaguuacucacggugucgguaauggaccugucucagauguacuccccaguguucgaguaucuuagcggugaucgccaagucgaagaguggcccaaagcuacaugcaccggcgacuguccugagcggugcgggugcacuucaaguaccugucugcacaaggaauggccgcauucuagaaacuggaggugcaaucccacaugguguuggggagugggcacugggugcaccuguugcggauuggacguuaaagaucucuuuacggacuacauguucgugaaguggaaagucgaguauauuaagacagaagccaucguguguguugagcugaccucccaggaacgucagugcagccuaauagaggcgggcacucgcuuuaaccuggguccagugacaaucacccuuucagagccucggaauauucagcaaaaguugcccccagaaaucauuacucugcacccuagaaucgaggaaggguucuuugauuugaugcauguccagaaaguacugagugccagcacaguguguaaguuacaguccugcacccacggaguucccggcgaccuccagguguaccacauagguaaccugcuuaaaggcgauagggucaacgggcaucugauucacaagaucgagccacauuucaauacgucuuggaugagcugggacggaugugauuuggacuauuacugcaacaugggcgauuggccguccugcacuuauaccggggugacacaacacaaucacgcuucauuuguaaaccuccugaauaucgagaccgacuacacaaaaucuuuccauuuucacaguaagcgagugacugcacauggagauaccccucagcuagaccugaaggcccggcccaacuacggcgcuggugaaauuacgguccuuguugagguggccgauauggaacuccacacuaaaaagauagagaucucggggcugaaauucgcgagcuugacuuguaccggaugcuaugcauguuccucuggcauuucaugcaaggugcgcauccaugucgacgaaccagacgaguuaacagugcacguuaaaagcgaugaccccgauguaguggccgcuuccaguucucugauggccagaaagcucgaguuugguaccgacagcacuuucaaagcauucucagcuaugccuaagaccucccuguguuuuuacauugucgaaagggaguauugcaagaguuguagcaaagaagauacacagaagugcgugaauacgaaacuugagcagccacaaucuauccugauagaacacaagggcacuaucauugggaaacagaacaauaccuguacagccaagaccuccugcugguuggagucaguuaagagcuucuuuuacggauugaaaaacaugcugucgggcaucuucgggaauguguuugucggaauuuuccucuuucuggcacccuucauccuuuuaauacuguuuuucauguuuggcuggcggauucucuucuguuucaagugcugccgaagaacucgcgguuuguuuagguauaaacaucuggagaacgacgaagagacaggguaccgucggaucaucgaaagacucaauaacaagaaaggaaagaauaagcugcuugauggcgagaggcuggccgaccgccgaauugcugaauuguucucuaccaaaacgcacaucggcuga

SEQ ID NO: 10371 - RNA, 5055 nt, Artificial Sequence
  derived and/or modified CDS sequence (opt3) from CCHFV(K168_125)__KX013460.1__GP
augcacaucagccugaugugcgccgugcucugucuucagcuguacggccuugggggaacccaugguuuacacaacggcacagagcauaauaagacuaacgcugucacgaccuccucuaauucacaaaguagcgaaucccccgcaagaacagccccuccaguuacuccggacucucccaccgugacaccuaccacuccagcgucggcucccgaggggucaggagaagcccacagcaguccuccaaacaauacagagggccccucccugccugaaucuaccagcgagccaccggcagccacguccacugguauucccucagcuagugauguaaacagcucuacccaggcagccagggacacauccacuccuaccgugcggacaucaccacccaauagcccuaguaccccacccacgccgcaggagacucaucacccuguccgcaaccuacucucugugacaucccacaaacccgaagagaccagcgcuccaucggaaucugggaaggaguccccugccgcaaauucaccccauccaguugcgagucgacccccuacuccaagcacaaccgcccagggaccgacggagaacaauaacuauaauaccacaggccaacuggaaucccuuacucagucuaccacacugggccccaugacuagcuugacccagacagaucucccucagucagugaccaguauagcuguccaagacacucacccaucccccacgaaccguagcaaaagaaaucuggagauggaaaucauucugacacucccucagggguuaaagaaauacuauggaaaggugcugaggcuuuugcagcugacccuagaggaagauacugagggucuccuggaguggugcaagcggaaccuuggccuggacugugaugacaccuucuuucagaaacgcaucgaagaguucuuuauuacaggggaaggacauuucaacgagguauugcaauuuagaaccccaggcacucucucuacaacggaaucaacccacgccggucugcccacugcagagccguucaagaguuacuuugcuaaaggguucuuaagcaucgauuccggauauuuuucugccaagugcuacucgaggacaagcaauuccggccugcagcucauaaacguuacccggcacucaacacgcaucgcggacacuccuggccuuaaaauuaccaaucugaagacgaucaguuguauuaacuugaaggccucuguguucaaagagcaucgagaagucgagaucaaugugcuacugccacagguggcagucaaccucagcaauugccacguuaccauaaagucccaugugugugauuauucacuggacauugaugggacaguaagacuuccccacauccaucacgacggaacuuuuauuccugguaccuacaaaaucgugaucgacaggaagaacaaacugaaugaucggugcacauuguucacuaacugugucauuaagggccgugaagugcgcaaagggcaaagcguucucagacaguacaagaccgagauaaggaucggaaaggcuucuacgggcucccggcgacuguuaagugacgaaagcggugaugacugcauuucucgcacacagcugcuaagaaccgagacugccgagauccacggggauaauuauggcggacccggcgacaaaauaacaauuuguaacggguccaccaucguggaucagaggcucggaucagaacuggguugcuacacuaucaaucgggucaagaguuuuaaacuuugcgagaacagcgcuaccggcaagucgugugaaguggacuccauuccaguaaaaugccgccaaggguauuguuugaagaucacacaggagggaagaggccauguuaagcugucuagggguagcgaggugguccucgaugccugcgacucaaguugugaagugaugauuccuaaagggacgggcgauauacuggucgacugcuccggaggccagcagcacuuccuuaaggacaaucugaucgauuuggggugucccaaagugccacuccugggaaagauggcaauuuacaucugccguaugucuaaccauccgaaaaccacuauggccuucuuauuuugguucagcuuugguuauguuaucacauguauugugugcaaggcuauauucuaccugcuaaucauuguaggcacccucgggaagcgguuuaaacaauaucgagagcugaagccucagacauguacuaucugcgaaaccacgcccacaaacgcgauugacgcagagaugcacgaucuuaauugcuccuacaacaucuguccauacugcgccucaagauugaccagcgacggacuggcuaggcacgucacucauugucccaaacgcaaggaaaaaguggaggagaccgaacucuaucugaauuuagagcggauaccuuggguugugagaaagcugcuucaggucagugaaucuacaggcguggccuugaagagguccagcuggcucaucguacugcuagugcuguucgcaguuucgcucucaccaguccagucugcccccauuggucacgggaaaacuaucgagaccuaccaagugcgcgaagaguauacaaguauuugccuguuugugcuuggcuccaucuuguucauagucagcugucugaugaagggauuaguuaacucugugggcaauauuuucuucccugggcucagcaucugcaaaacguguuccauuggaucaaucaacggcuuugagauagaaagucauaagugcuacuguagccugcuuugcuguccguauugccgacacugcucugcugaucgggagauccaucagcugcacuuguccauuuguaaaaagcguaaaaccgguucaaaugugaugcucgccguaugcaagagaauguguuucagggcaacugucgaagugaguaacaaggcgcugagcauccgcuccauuaucaauacaaccuuuguugugugcauacuaauucuggcugucugugugguuucuacuucggccguggagauggaaagccucccagcagggacaugggagcgggaggaagaccugaccaacuucugccaccaggagugucagguaacggaaacugagugccuuugucccuacgaggccuugguccugagaaggccuuuauuccucgauucaaucgugaaaggaaagaaaaaucugcuuaacuccaccagucuggaaacaucucuaagcaucgaggcuccauggggcgccauuaaugugcaauccaccuauaagcccacugucucagcagcuaacaucgcccucucuuggagcaguguugaacaucgagguaauaaaauucugguguccggccgcagcgagucuauaaugaaguuggaggaacggacagggaucucaugggaccugggaguagaggaugcguccgaaaguaaguuacucaccgugagcgucauggaccugucgcagauguacucuccuguguuugaguaccuuuccggcgauagacagguugaagaguggccgaaagccacaugcacuggggacugucccgaaaggugcggaugcaccagcucaacgugucugcacaaggaguggccacauagucguaacuggcgcugcaacccuacaugguguuggggcguggguaccgggugcacuuguugcggauuggaugucaaagaccucuucaccgacuauauguuugugaaguggaaaguugaguacauuaagacagaagcuaucgugugugucgagcugacuucucaagaacggcagugcucccuaauugaggcaggcaccagauucaaucugggucccguaacgaucacacuuagcgaaccaaggaacauacagcagaagcucccucccgagaucauuacccugcacccacgaaucgaggaaggcuuuuucgauuugaugcaugugcaaaaaguucugucagccaguacuguguguaaguuacagagcugcacacacggggucccgggagaccuccagguguaucacauuggcaaucugcuuaaaggggauaagguaaacggacaucugauccacaaaauagagccucauuuuaauaccuccuggaugucuugggacggcugugauuuggacuacuauugcaacaugggugauuggcccagcugcacuuacacaggggugacccagcacaaucacgcuuccuucauuaaccuccugaauaucgaaacggacuauacuaagucauuucauuuccacucuaagcgggucaccgcccauggagauacaccacaacuagaccugaaagcacgccccaacuacggcgcgggugagaucaccguucuuguggagguggccgauauggaacuccacacaaagaaaauugagauaaguggccugaaguuugcuucguugacuuguaccgggugcuacgccuguagcuccggaaucucuugcaaagucaggauucauguggacgaaccugaugaguuaacgguucacguaaagucagacgacccagauguggucgcagcuagcuccagucugauggccagaaaacucgaauuuggcacagacucuacuuuuaaggcauucagcgccaugcccaagaccucacuguguuucuauaucguggagcgggaguacugcaaauccuguaguaaggaagauacacagaaaugcguuaauaccaaguuggagcacccucagagcauucugaucgaacauaaagggacuauaaucggaaagcagaacaauaccuguacagcuaagacgucuugcugguuggaguccgugaaaucauuuuucuauggccuaaagaacaugcugagcgguauuuuugggaaugucuucgugggaaucuuucucuuccuggcgccguuuauucuuuuaauccuguucuuuauguucggcuggcgaauacucuuuuguuucaaaugcugcagacgcacuaggggcuuguuccguuacaagcaccuggaagacgaugaggagaccggguaucggagaauuaucgaaaggcucaacaacaaaaagggaaagaauaaacugcuugacggugagcgccuggccgaucgaagaaucgcagaauuguuuucgacaaagacccauauuggcuga

SEQ ID NO: 10372 - RNA, 5052 nt, Artificial Sequence
  derived and/or modified CDS sequence (opt3) from CCHFV(Kosova Hoti)__EU037902.1__GP
augcacacccugcucgugugcuucauccuuuaccugcaguuguuaggccuagggggagcccauggucaaagcaacgcuacagagcacaauggcacuaacacgaccacagcacccgggacuucccagucuccuaagccaccggccucaaccacacccagucaugcgccugaaccaagcaccauuaaacugacuacacccaccuccgagacggaaggaucuggcgagacuaccccuccaacaaauacuacccaggacucgcccccucucgaaacaaccccagagagaucagcuacgacugccacaagcaccagugguacugauaacaugaacuccacaacccagaugacggacaauaccccgacaucuacugucagcaccucccugucaaguagccccucuacaccuuccacuucacaagggaugcaccauccaguuaggagccuucugagugugucuucccccaagaccgcaacaaccccuacuccaaugagccccggagagaugucgucugaaacguccucacagcacagugccaugagccggacaccgaccccucacacugcuacccagguauccacagagaaugcaaaccgcucuaccagccgacagucagaaaguuccgcccaacccgcuacucagagcccagugacaucuccugcccagucaauauugcucaugagugcgacgcccaccacuauccagaauauucauccaagccccacaaaccguuccaaaagaaaucuggagauggagaucauucugacccucucucaaggcuuaaagaaauauuacggcaagauccugaaacuuuugcaccugacacuagaagaggauacugaagggcuccuggagugguguaaaaggaaccuuggaucgaauugcgacgaugacuuuuuccagaagcggauagaagaguuuuucaucaccggugagggcuauuuuaacgaaguccugcaguucaaaacguugagcaccccuuccucaacagagccaagucaugcacgccucccgacugccgaacccuuuaagucuuacuucgcuaaaggguuucugagcauugauuccggauauuucucagccaaguguuacccuagaagcucuaccuccggcuuacaacugaucaaugugacacagcacccagcaaggauugcugagacucccgguccuaagaccacgagucucaaaacaaucaacugcauaaaccuucgggccagcguuuuuaaggaacaccgcgagguggagauuaauguccuguugccacagaucgcggugaaccuaucuaauugucauguaguuauuaacucccacgugugcgacuauucacuggauaccgacgggcccguccgacucccgagaaucuaccaugaaggaacuuucaugccuggcacauacaaaaucgugauugauaggaagaauaaacugaacgaccgguguacccuugugacuaauugcgucauaaagggccgugagguucgcaaagggcagagugugcugagacaauauaagaccgaaaucaagauuggaaaagccccaacagguagcaggaaguugcucucggaggaacccggcgaugacuguaucucccggacgcagcuguuacgaaccgagacugcagagauacacgacgauaacuacgggggaccuggcgacaaaauuacaaucugcaaugguucuaccaucguagaucagcgccuggggagcgaacuaggcuguuauacaauuaacagagugaagucauuuaaacucugcgagaauagugcuacuggaaagaccugcgaaaucgacuccacgcccgucaaguguaggcagggcuucugccugaaaauuacacaaaaggggcggggacaugugaaacuuucucgcgguagcgagguuguguuggaugccugugacuccaacugcgaggucaugauaccaaagggcaccggggauauccugguggacuguucaggaggccagcagcacuuccucaaagauaaucugauugaccuugguugcccucacaucccccuguuggggaagauggcuaucuacauuuguagaaugagcaaccauccaaagacuaccauggccuuucucuucugguuuaguuucggcuauguaauaacaugcaucuuuuguaaagcacuguucuacucuuuaauuaucauuggaacucugggcaagaaaaucaagcaguauagggaacuaaaaccgcaaaccugcacaauaugugagacggccccuguuaaugcuaucgaugcggaaaugcacgaccucaacugcuccuacaacauuugccccuacugugcaagccgucugaccucggacgggcuugcccggcaugugaagcagugcccaaagcgaaaagagaaggucgaagagacugaguuguaucugaaucucgaaagaauccccuggguggucaggaaacuguuacaggugucagagucuacaggaguugcucugaagcgcaguuccuggcuuauuguguugcucguacugcuaaccgucagccugucuccugugcagagcgccccaguuggucacggcaaaacuaucgaaacauaccaaacccgggagggguuuacguccauaugucucuucaugcugggaucaauucuuuuuaucgugaguugcuuggucaagggccugguggauagcguaucugacuccuucuuucccgguuuaucaguguguaaaacuugcaguauugggagcaucaacggcuucgaaauagagucccacaaguguuauugcucucucuuuuguugcccuuacuguagacauugcucggcagauagggagauccaccagcugcaucuuaauauuugcaagaaacgcaagaccggaagcaacguuaugcuggccgucuguaaacgaaugugcuuccgggcuacaaucgaagccucacguagagcauugcucauuagguccaucauaaauaccacuuucgugauuuguauccugacacuaaccaucugcguggucaguacaucugcgguugagauggaaaaccugccggcuggcacuugggagcgcgaagaggaccucaccaauuuuugucaccaggagugccaagugacggaaacagagugucugugcccauaugaagcccuuguguugcggaagccccuguucuuagauagcauuguaaaagggaugaagaaccuccuuaauuccaccucacuggagacuucucugagcaucgaggcaccuuggggagccauuaacguccagaguaccuuuaagccaacaguguccacugcuaauauagcccuaagcuggucuucaguugaacauagaggcaacaaaauccucgugaccgguagguccgagaguauuaugaagcuggaggaacgaacggggaucagcugggacuugggagucgaagaugcaucggagucuaaacuguuaacaguguccauuauggaccucagccagauguacucacccguuuucgaguaucugaguggcgaucgccagguggaagaguggccuaaggcuaccuguacuggugacugcccgcaacgguguggcugcacaucuuccacaugccuucacaaagaauggccccacagcagaaauuggagguguaacccaacuuggugcuggggaguaggaacaggcuguaccugcuguggggucgaugugaaggaccuguuuacggaucauauguucgugaaguggaaagucgaguacaucaagacugaagccauaguuugcguggaguugaccucacaggagcgucaguguagucucaucgaagcgggaacacgcuuuaaucugggcccuguaaccauuacacuaagcgagccccggaacauccagcaaaaacugccaccugaaauuaucacucuucaccccaagauagaggaagguuucuuugaccucaugcaugugcagaaaguccuguccgccucuaccgugugcaaguugcagagcuguacgcacgggauuccaggagaccugcagguuuaccauaucggcaacuuacucaagggugauagagugaauggccaccugauccacaaaauugagccgcauuucaacacauccuggaugucaugggacgggugcgaucuugacuauuacuguaauaugggagauuggccuucuugcacuuauaccggcgucacacaacacaaccaugcugcauuugugaaucuguugaacauagagaccgacuacacuaagaccuuccacuuucacaguaaaaggguuacagcccauggggauacgccccagcucgaccugaaggcucgaccaacuuauggagccggcgaaaucaccgugcuagucgagguagcagauauggaacugcacaccaaaaagguggagauuucgggucuuaaauucgcgagccucgccugcaccggguguuacgcuugcuccucuggaaucucauguaagguucggauucauguggacgagcccgaugaacugacuguccacguaaagagcuccgacccugaugugguggccgcaggcacaaguuugauggcucgcaaauuagaguucgguaccgacucuacguuuaaggccuucagcgcaaugccaaaaacuucacugugcuuuuauaucgucgaaaaggaguacuguaaauccugcagugaagacgauacaaagaaguguguugacaccaaacucgagcagccccaaagcauacugaucgagcauagaggcaccauuaucgggaagcagaaugauacuugcacagccaaggcuucuuguuggcuugaauccgugaagucauucuuuuacggacugaaaaacauguugggcagcguguucgggaacuuuuucauuggaauccuacuguuucucgcgccuuucguccugcuuguguuauuuuucauguucggcuggaagauacuguuuugcuucaaguguugcaggcggacccgaggucucuuuaaauauagacacuugaaggacgaugaggaaacaggguaccgcaggauuaucgagcgucugaauaauaaaaaggggaaaaaccggcuccuggacggcgaaagacuugccgauaggaagaucgcagagcuguucucgacuaagacgcacauuggcuga

SEQ ID NO: 10373 - RNA, 5049 nt, Artificial Sequence
  derived and/or modified CDS sequence (opt3) from CCHFV(Oman)__DQ211632.1__GP
augcacacccugcucguguacgccgucuucugccuucagcuguggagccccggcgggacaagaggauuguccaacgagacucaacauaaugaaacggguaucaccagggcuccugagggcucucaggggccaucauuaccgguuaguacagcaagccccauuauguccgacccuucuauaacuaccccaucggccucaacaagcggacuggaaggcaguggugauaccacucccccugcgaucacacaggggccaacgcccccugagaccacuccagaaccguccaccacaacuggaaccaacgcuuuuucuacagccauugcaaaugugagcacccagacgguaaaggacacucccacaccuaccgugcaaacuuccccacccucaacaccugaugccaguaccaucccacagggcacgcaccauaccgcucggggccuacucagcgucacagugacuaaacccgaggagguuccgaccccuacagggcccgaacaggcaucuauugagacuaacuccccacgccuggccaccucaaagacaccuagccccaguccaaccgcucaggugacuacggaaaauucuaaccccaauacaucccgacaacuuguccugagcacccagccugccacuucgucuccagugaccuccccggcgcaguugaucuucguacagucagcaacaaccguugccgugcaagacgcucaccccaguccuacuaaccguagcaaaagaaaucucgagauggaggucauacugacacugucccagggacucaggaaguauuacggucggaucuuaaaacugcuugauuugacgcuggaagaggacaccgaaggccuacucgagugguguaagcgcaaccuggggcuuacuugcgaugacaauuucuuccagaagagaauugaagaguuuuuccugacaggagagggccauuuuaacgaaguguugcaauucaaaaccccaucuacacucagcucaacugagagugccuccgugggucugcccaccgucgaaccuuuuaagagcuauuucgcaaaaggguuuuuaucuaucgauucaggauacuucagugcuaaguguuauccaagggccagcaauuccggccugcagcucauuaacguuacgcagcacucugcgcggaucgccgacacccccggcccgaaaauaacaaaucuuaagacuauuaacugcaucaaccugaaggcauugguguuuaaagagcaccgcgaaauugagaucaauguacuacugccucagguggcugucaaccucucgaauugucaugugcacaucaagagccauguuugcgauuacucccuggacauugaugggaccgugcgacuuccaagaauacaccacgagggaacauucauccccgguacuuauaaaauugucaucgacaagaaaaacaagcaaaaugacagguguaaccuggugaccaauugcguaauaaaaggccgggaaguucguaaggggcagucaguguugcgccaguacagaacggagauuaggaucggaaaggccaguucuggcagccggcgacuccuguccgaagagucaggugaagauuguaucagccgcacacaguuacugagaaccgagacugcugagauucauggggacaacuacggcggaccuggcgauaaaaucacaauuugcaaugggucuaccauagucgaccaaaggcuaggauccgaacucgguuguuauacuaucaaccgggugaagaguuucaaacugugcgagaauagcgccaccggcaagucuugcgaaauugauaacacacccgucaaauguaagcagggguuuugccuuaagaucacgcaggagggacgcggccacgugaaauuguccagagacucagagguugugcuggaugcaugugacaguagcugcgaaaucaugauuccaaaggguaccggggauauacucguagacuguucgggcggacagcaacauuuccugaaagauaaucuuaucgaccugggcugcccuaacauucccuugcucgggaagauggccaucuacauuuguaggauguccaaucacccaaaaacuacaauggcuuuucuguucugguuuucuuucggauaugucauaaccugcaucuuauguaaggugaucuuuuaccugcuaauuguuguggguacacucggcaagaaauucaagcaguaucgugagcugaaaccgcagacuugcaccaucugugaaacgacaccugucaacgcgauugacgcagagaugcaugaucuuaacugcagcuacaauaucugccccuauugugccucacgguugaccagugacgggcuggcucgacacgugaugcagugcccaaagagaaaagaaaagauagaggagacugaacucuaccugaacuuagagaggauucccuggguagugcgcaagcugcuucaaguuuccgaaucuaccggagucgccuugaaacggagcuccuggcucaucgugcugcuagugcugcucacagucucacugagcccuguucagagugcaccaauuggccacgguaagacuaucgagaccuaccagacaagagaaggguauacgucuauaugucuuuuuguguugggcuccauccuguucauugugagccauuuaaugaaaggacucguagauucggucggcaauucauuuuuccccgggcugucuaucugcaagaccuguaguauuggauccaucaacggcuuugagauagagagccacaaaugcuucuguucucuuuucugcuguccuuacugcaggcauuguagcgccgacaaggaaauucacaaacugcacuuguccaucugcaagaagcgcaaagcugguucaaaugugaugcucgccguuugcaagcgaauguguuuucgggcaacuauggaggugaguaacaaagcgcugcuaauccguagcgucauuaauacaaccuucgugguuugcauccugauucucgcuguguguguagucucuacuuccgccguggaaauggagucacugccggcagggacaugggaaagagaggaggaucuuaccaacuuuugccaucaagaaugucaggugacggagacugaaugcuuguguccauaugaggcccuggucuuaaggaagccccucuuccuggacaguauagcuaaaggaaugaagaaucuucugaacagcaccucccuagagacaucucucucgaucgaagccccuuggggcgcaauuaauguucagagcaccuuuaagccaacugugucaacagcuaacaucgcccuguccuggaguucuguagagcaccgcgguaauaaaauuuuggugagcggccgguccgaaucaaucaugaagcuggaggaaagaaccgggauaucuugggauuuaggagucgaggacgcgagcgagaguaaacuccugacaguguccguuauggaucuuagccagauguacucucccguguucgaauaucugucaggcgacaggcaagucgaggaauggccuaaggccacuugcaccggggauuguccggagcgaugcggauguacguccaguacaugcuugcauaaagaauggccccacagccgcaacuggcggugcaauccaaccugguguuggggcguggguacugggugcaccuguugcggacucgacguuaaggaucuguuuacagacuacauguucgugaaguggaaagucgaguauaucaagacugaggcuauuguauguguggaacuaaccucgcaggagagacagugcucucugaucgaagcaggcacgagguuuaaccuugguccuguuacaauuacccucuccgagccccguaacauccagcaaaaacugccaccugaaauagugacuuugcauccccgcauugaggagggcuucuuugaccugaugcacguccagaagguguuaagcgccucaacaguauguaaacuccagaguugcacccacggggugccaggagaucugcaggucuaccauaucggcaaucuucugaagggggacaagguuaacggacacuugauccauaaaguggaaccgcacuucaauacuucuuggauguccugggauggcugugaccucgauuacuauugcaacaugggugacuggccuagcuguacauacaccggggugacgcaacauaaucacgcugccuuugucaaccugcuaaauauugagacugauuauaccaagaacuuccacuuccauucaaaacgggugacagcacacggagacacaccccagcuggaucuuaaggcgagaccaaauuacggcgccggugaaguuaccguacucguggaggucgcugacauggagcugcauacuaaaaagauagaaaucaguggcuugaaauuugccagcuuaaccugcacggggugcuaugcauguuccucuggaauuagcugcaaggugaggauccacguugaugagcccgacgaacugacagugcacgucaaguccgaggauccugacauuguggcugccucaucuagucucauggcacgaaaacuggaauuuggcacugacucgaccuuuaaggccuucagcgcuaugccaaaaacaucccuuuguuuuuacaucguagagcgggaguauugcaagucuuguucaaaagaagauacccagaagugcgucaacgcgaagcuggagcgcccccaaagcauauugaucgaacauaaagggacuauuaucggaaagcagaaugacaccuguacagccaaagcauccugcuggcuagagagugugaagucuuucuuuuacggccugaaaaacaugcucagcgguauuuucgggaauguuuuuaucggaauauuccuguuucuugcuccuuucauuuuacugauccucuucuuuauguucggcuggagaaucuuguuuuguuucaagugcuguaggcggacgcgaggccuguuuaaguacagacaccucaaagaugacgaagagacuggguaucgcaagauuaucgagaggcugaacaauaaaaagggaaagaacaaacuucuggauggugaacguuuggccgaccggaagauagccgagcuauucucaaccaaaacacauauuggcuga

SEQ ID NO: 10374 - RNA, 5049 nt, Artificial Sequence
  derived and/or modified CDS sequence (opt3) from CCHFV(Oman_812956)__KY362518.1__GP
augcacacccugcucguguacgccgucuucugccuucagcuguggagccccggcgggacaagaggauuguccaacgagacucaacauaaugaaacggguaucaccagggcuccugagggcucucaggggccaucauuaccgguuaguacagcaagccccauuauguccgacccuucuauaacuacccugucggccucaacaagcggacuagaaggcaguggugauaccacuccacccgcgaucacacaggggccuacccucccagagacgacucccgaaccuuccaccacaacuggaaccaacgcuuuuucuacagccauugcaaaugugagcacccagacgguaaaggacacuccaacaccgaccgugcaaacuucacccccuuccacaccagaugccaguaccaucccccagggcacgcaccauaccgcucggggccugcuuagcgucacagugacuaaaccugaggagguuccaacccccacagggccggaacaggcaucuauugagacuaacuccccucgccuggccaccucaaagacacccagcccaaguccuaccgcucaggugacuacggaaaauucuaaccccaauacaucccgacaauugguccucagcacccagccagccacuucgucucccgugaccuccccugcgcagcugaacuucguacagucagcaacaaccaucgccguucaagacgcucacccaaguccgacuaaucguagcaaaagaaaccuggagauggaggugauacucacauuaucccagggacugaggaaguauuacggucggauccuuaaauugcuggaucuaacgcucgaagaggacaccgaaggccugcuugagugguguaagcgcaaucugggguugacuugcgaugacaacuuuuuccagaagagaauugaagaguuuuuccucacaggagagggccauuuuaaugaaguccugcaauucaaaacccccucuacauuaagcccuacugagucagccagugugggucugccaaccguggaacccuuuaaguccuauuucgcaaaaggguuucucagcaucgauucuggauacuucucagcuaaguguuauccuagggccaguaacagcggccuucagcugauuaaugucacgcagcacuccgcgcggaucgccgacaccccaggccccaaaauaacaaacuugaagacuauuaacugcaucaaucuaaaggcacugguuuuuaaagagcaccgcgaaauugagaucaacgugcuccugccgcagguagcugugaaucuuucuaacugucauguccacaucaagucgcaugugugcgauuacagccuggacauugaugggaccguucgauugccuagaauacaccacgagggaacauucaucccagguacuuauaaaauugugaucgacaagaaaaauaagcaaaacgacagguguaaucucgucaccaacugcgugauaaaaggccgggaaguacguaaggggcaguccguucugcgccaguacagaacggagauuaggaucggaaaggccucaaguggcucucggcgauuacugagcgaagaguccggugaagauuguaucucacgcacacagcuacucagaaccgagacugcugagauucauggggacaauuacggcggacccggcgauaaaaucacaauuugcaacgggagcaccauaguggaccaaaggcugggaucugaacuugguuguuauacuaucaaucgggucaaguccuucaaauugugcgagaacagugccaccggcaagagcugcgaaauugauaauacaccugugaaauguaagcagggguuuugccugaagaucacgcaggagggacgcggccacgucaaacucucuagagacuccgaggugguucuggaugcaugugacucaaguugcgaaaucaugauucccaaggguaccggggauauacuuguggacuguagcggcggacagcaacauuuccugaaagauaacuugaucgaccucggcugcccaaauauuccucuguuagggaagauggccaucuacauuuguaggaugucgaaccaccccaaaacuacaauggcuuuucuguucugguuuuccuucggauauguaauaaccugcauccuauguaaggucaucuuuuaccuccugauugugguugguacacuuggcaagaaauucaagcaguaucgugaguugaaaccacagacuugcaccaucugugaaacgacaccggugaacgcgauugacgcagagaugcaugaucugaauugcucuuacaacaucugcccuuauugugccagccggcucaccucagacgggcuggcucgacacgucaugcagugccccaagagaaaagaaaagauagaggagacugaauuauaccugaaucuugagaggauuccaugggugguacgcaaguugcuccaagugagugaauccaccggaguugcccugaaacggucuagcuggcuaaucguccugcucgugcugcuuacaguguccuugucacccguccagagcgcaccuauuggccacgguaagacuaucgagaccuaccagacaagagaaggguauacgaguauaugucuguuuguuuuaggcucuauccucuucauugugucccaucugaugaaaggacuuguggauagcguaggcaacucguuuuucccagggcugucaaucugcaagaccuguucuauuggaaguaucaauggcuuugagauagagucccacaaaugcuacuguagcuuguucugcugucccuauugcaggcauuguucugccgacaaggaaauucacaaacuccaccugagcaucugcaagaagcgcaaagcugguuccaacgucaugcuagccgugugcaagcgaauguguuuccgggcaacuauggagguuucaaauaaagcgcugcucauccguagugugauuaacacaaccuuugucgugugcauccugauucuugcuguuugugugguaagcacuucugccgucgaaauggaguccuugccugcagggacaugggaaagagaggaggaucugaccaauuucugccaucaagaaugucaggugacggagacugaaugcuuauguccguacgaggcccucgugcugaggaagccacuguuuuucgacucaauagcuaaaggaaugaagaaccuucuaaauaguaccagccucgagacaucccugucuaucgaagcccccuggggcgcaauuaacguccagucgaccuuuaagccuacuguuagcacagcuaauaucgccuugucaugguccaguguggagcaccgcgguaacaaaauucugguaucuggccggagcgaauccaucaugaaguuagaggaaagaaccgggauaucaugggaucucggaguggaggacgcgucugagagcaaacugcuuacagucagugugauggaucugucccagauguauagcccaguuuucgaauacuugucuggcgacaggcaaguggaggaauggcccaaggccacuugcaccggggauuguccugagcgaugcggauguacgucauccacaugccuccauaaagaauggccgcacagucgcaauuggcggugcaaccccaccugguguuggggcgucgguacugggugcaccuguugcggacuggacgugaaggaucuauuuacagacuauauguucguuaaguggaaaguggaguacaucaagacugaggcuauugucuguguagaacugaccagccaggagagacagugcucgcuuaucgaagcaggcacgagguuuaaccucgguccagugacaauuacccugucugagccucguaauauccagcaaaaauugcccccagaaauaguuacucugcauccucgcauugaggagggcuucuuugacuuaaugcacgugcagaagguccucuccgccagcacaguguguaaacugcagucaugcacccacgggguacccggagaucuucagguguaccauaucggcaaccuguugaagggggacaaggucaauggacaccucauccauaaaguugaaccacacuucaacacaaguuggaugucuugggauggcugugaccuggauuauuacugcaauaugggugacuggccguccuguacuuauaccggggugacgcaacauaaccacgcugccuuugugaaucuacugaacauugagacugauuacaccaagaauuuccacuuccauagcaaacgggucacagcacacggagacaccccucagcuugaucucaaggcgagacccaacuauggcgccggugaaauaacagugcugguugagguagcugacauggaguugcauacuaaaaagaucgaaauuucaggcuuaaaauuugccagucugaccugcacggggugcuacgcauguagcuccggaaucucuugcaaggugaggauucacgucgaugagccagacgaacucacagugcacguuaagagcgaggaucccgacaucguggcugccuccucaucucugauggcacgaaaacuugaguucggcacugacaguaccuuuaaggccuucucggcuaugccuaaaacaagccuguguuuuuauauagucgaacgggaguacugcaaguccuguucuaaagaagauacccagaagugcgugaaugcgaaguuggagcgcccacaaucaauccuaauugaacauaaagggacuaucauuggaaagcagaacgacaccuguacagccaaagcaagcugcuggcuggaguccguaaagaguuucuuuuacggccucaaaaauaugcugucugguaucuucgggaacgucuuuauaggaauuuucuuauuucuugcucccuucauccugcucaucuuguucuuuauguucggcuggaggauucuguuuuguuucaagugcuguagacggacgcgaggccucuuuaaguauagacaccugaaagaugacgaagagacuggguaccgcaagaucauagagaggcuuaauaacaaaaaggguaaaaacaagcuguuggauggagaacgucuagccgaccggaagauugccgagcuguucagcaccaaaacacauaucggcuga

SEQ ID NO: 10375 - RNA, 5049 nt, Artificial Sequence
  derived and/or modified CDS sequence (opt3) from CCHFV(Oman-199809166)__KR864901.1__GP
augcacacccugcucguguacgccgucuucugccuucagcuguggagccccggcgggacaagaggauuguccaacgagacucaacauaaugaaacggguaucaccagggcuccugagggcucucaggggccaucauuaccgguuaguacagcaagccccauuauguccgacccuucuauaacuacccugucggccucaacaagcggacuagaaggcaguggugauaccacuccacccgcgaucacacaggggccuacccucccagagacgacucccgaaccuuccaccacaacuggaaccaacgcuuuuucuacagccauugcaaaugugagcacccagacgguaaaggacacuccaacaccgaccgugcaaacuucucccccuucaacaccagaugccaguaccaucccccagggcacgcaccauaccgcucggggccugcuuagcgucacagugacuaaaccugaggagguuccaacccccacagggccggaacaggcaucuauugagacuaacuccucacgccuggccaccagcaagacaccuagucccucuccaaccgcucaggugacuacggaaaauuccaacccuaauacaagccgacaauugguccucucgacccagcccgccacuucuuccccagugaccucacccgcgcagcugaacuucguacagagugcaacaaccaucgccguucaagacgcucacccuagcccaacuaaucguuccaaaagaaaccuggagauggaggugauacucacauuaucucagggacugaggaaguauuacggucggauccuuaaauugcuggaucuaacgcucgaagaggacaccgaaggccugcuugagugguguaagcgcaaucugggguugacuugcgaugacaacuuuuuccagaagagaauugaagaguuuuuccucacaggagagggccauuuuaaugaaguccugcaauucaaaaccccgagcacauuaucacccacugagagugccuccgugggucugccuaccguggaaccauuuaagagcuauuucgcaaaaggguuucucucuaucgauucaggauacuucagugcuaaguguuaucccagggccagcaacuccggccuucagcugauuaaugucacgcagcacucugcgcggaucgccgacaccccuggcccaaaaauaacaaacuugaagacuauuaacugcaucaaucuaaaggcacugguuuuuaaagagcaccgcgaaauugagaucaacgugcuccugccccagguagcugugaaucuuucgaacugucauguccacaucaagagccaugugugcgauuacucccuggacauugaugggaccguucgauugccgagaauacaccacgagggaacauucaucccugguacuuauaaaauugugaucgacaagaaaaauaagcaaaacgacagguguaaucucgucaccaacugcgugauaaaaggccgggaaguacguaaggggcagucaguucugcgccaguacagaacggagauuaggaucggaaaggccaguucuggcagccggcgauuacuguccgaagagucaggugaagauuguaucagccgcacacagcuacucagaaccgagacugcugagauucauggggacaauuacggcggaccaggcgauaaaaucacaauuugcaacgggucuaccauaguggaccaaaggcugggauccgaacuugguuguuauacuaucaaucgggucaagaguuucaaauugugcgagaacagcgccaccggcaagucuugcgaaauugauaauacacccgugaaauguaagcagggguuuugccugaagaucacgcaggagggacgcggccacgucaaacucuccagagacucagaggugguucuggaugcaugugacaguagcugcgaaaucaugauuccuaaggguaccggggauauacuuguggacuguucgggcggacagcaacauuuccugaaagauaacuugaucgaccucggcugccccaauauuccacuguuagggaagauggccaucuacauuuguaggauguccaaccacccuaaaacuacaauggcuuuucuguucugguuuucuuucggauauguaauuaccugcauacuauguaaggucaucuuuuaccuccugauugugguugguacacuuggcaagaaauucaagcaguaucgugaguugaaaccccagacuugcaccaucugugaaacgacaccagugaacgcgauugacgcagagaugcaugaucugaauugcagcuacaacaucugcccguauugugccucacggcucaccagugacgggcuggcucgacacgucaugcagugcccuaagagaaaagaaaagauagaggagacugaauuauaccugaaucuugagaggauucccugggugguacgcaaguugcuccaaguguccgaaucuaccggaguugcccugaaacggagcuccuggcuaaucguccugcucgugcugcuuacagugucauugagcccaguccagagugcacccauuggccacgguaagacuaucgagaccuaccagacaagagaaggguauacgucuauaugucuguuuguuuuaggcuccauccucuucauugugagccaucugaugaaaggacuuguggauucgguaggcaacucauuuuucccugggcugucuaucugcaagaccuguaguauuggauccaucaauggcuuugagauagagagccacaaaugcuacuguucuuuguucugcuguccauauugcaggcauuguagcgccgacaaggaaauucacaaacuccaccuguccaucugcaagaagcgcaaagcugguucaaacgucaugcuagccgugugcaagcgaauguguuuccgggcaacuauggagguuaguaauaaagcgcugcucauccguagcgugauuaacacaaccuuugucgugugcauccugauucuugcuguuugugugguaucuacuuccgccgucgaaauggagucauugcccgcagggacaugggaaagagaggaggaucugaccaauuucugccaucaagaaugucaggugacggagacugaaugcuuauguccuuacgaggcccucgugcugaggaagccgcuuuuucuggacaguauagcuaaaggaaugaagaaccuacucaauagcaccucccuggagacaucuuugucgaucgaagccccauggggcgcaauuaacguccagagcaccuucaagcccacuguuucaacagcuaauaucgcccuguccuggaguucuguggagcaccgcgguaacaaaauuuuaguaagcggccgguccgaaucaaucaugaagcucgaggaaagaaccgggauaucuugggaucugggaguggaggacgcgagcgagaguaaacuucugacagucuccgugauggauuugagccagauguauucuccuguuuuugaauaccucucaggcgacaggcaaguggaggaauggccaaaggccacuugcaccggggauugucccgagcgaugcggauguacguccaguacaugccugcauaaagaauggccucacagccgcaauuggcggugcaacccgaccugguguuggggcgucgguacugggugcaccuguugcggacuagacgugaaggaucuguucacagacuauauguuuguuaaguggaaaguggaguacaucaagacugaggcuauugucuguguagaacuuaccucgcaggagagacagugcucucucaucgaagcaggcacgagguucaaccugggucccgugacaauuaccuuguccgagccacguaauauccagcaaaaacugccucccgaaauaguuacuuuacauccacgcauugaggagggcuuuuucgaccucaugcacgugcagaagguccugagcgccucaacaguguguaaacuucagaguugcacccacgggguaccuggagaucuccagguguaccauaucggcaacuugcucaagggggacaaggucaauggacaccugauccauaaaguugaaccccacuuuaacacuucuuggauguccugggauggcugugaccuagauuauuacugcaauaugggugacuggccaagcuguacauauaccggggugacgcaacauaaccacgcugccuucgugaaucugcuuaacauugagacugauuacaccaagaauuuucacuuccauucaaaacgggucacagcacacggagacaccccgcagcucgaucugaaggcgagaccuaacuauggcgccggugaaauaacaguguugguugagguagcugacauggaguuacauacuaaaaagaucgaaauuaguggccugaaauucgccagccugaccugcacggggugcuacgcauguuccucuggaaucagcugcaaggugaggauucacgucgaugagcccgacgaacugacagugcacguuaaguccgaggauccagacaucguggcugccucaucuagucuuauggcacgaaaacuggaauuuggcacugacucgaccuucaaggccuuuagcgcuaugcccaaaacauccuuguguuucuauauagucgagcgggaguacugcaagucuuguucaaaagaagauacccagaagugcgugaaugcgaagcuagagcgcccucaaagcauccugauugaacauaaagggacuaucauuggaaagcagaacgacaccuguacagccaaagcauccugcuggcucgagaguguaaaguccuuuuucuacggccugaaaaauaugcuuagcgguaucuuugggaacgucuucauaggaaucuuuuuauuccuggcuccauuuauccucuugauccuguucuucauguuuggcuggaggauucucuucuguuuuaagugcuguagacggacgcgaggccuguucaaguauagacaccuuaaagaugacgaagagacuggguaccgcaagaucauagagaggcugaauaacaaaaaggguaaaaacaaguugcuagauggagaacgucuggccgaccggaagauugccgagcucuuuucaaccaaaacacauaucggcuga

SEQ ID NO: 10376 - RNA, 5055 nt, Artificial Sequence
  derived and/or modified CDS sequence (opt3) from CCHFV(BA66019)__AF350448.1__GP
auguacacccugcucgugugcgccguccuuuguccccagcuguggagcuuggagggcacacacguuccucauaacgaaacuaagcacaaugggacgggaaucaccgcugcaccaggugagucccaaggcccgaugucucccgccucaacagcggugccuuuaacuccagaacccccuaacaccaaaccagcugccagugcaagcgagcuggaauccucuggggagggacauacaucgcuacucgccaccacucagggccugacaucacccgaggcuaccccugaacuuccaacgacuaccgacacagguguaagcaguacuuccguggucgauauugggacccagauggcaaaggacacaccgaccucuacggcccacacuagccugcccuccaauccuucagcuccaaguacagcccagggaacccaucacacuauaagaggcuugcucagcgugacaucuaccaaacccgaggaagcguccacgccuaccgauccaggcaaggcaggggccgagacaggaucacccaggccggcuaucagccggaaaccuacucugagucccaccgccgaggcaccaacagaaauuaacaauucuuccacuccuaagcaacccgagccaagcauccagcccgcuaccccuucgcugguuauuucuccagcccagccggcguucccccaguccgccacaucaaccgcagcucaagacaucuauaguagcccuacuaaccgcuccaagcgaaaucucaaaauggaaauaaucuuaacgcugucucagggucuuaagaaauacuauggcaagauucagaaaacauuggggcugacccuagaggaagauacugagggacuccuggaguggugcaagcguaaccuuggccugaccugugacgauaacuuuuuccagaagagaaucgaagaguuuuucuugacaggugaaggguacuuuaaugaggugcuccaauucaaaaccccaagcacucccggaucaacagaaccuacgcacgccgaggcuccaaccgucaagcccuuuaaaaguuauuucgccaggggcuuucugacuauuaauuccggcuacuucagcgcaaagugcuauucuuggacaucaaacaguggguuacagcugaucaaugugacccagcauccggcccggauagcugacacaccuggaccaaaaauuacuaaccucaagaccaucaauuguauuaaccuuaaagcgagcguauuuaaggagcaccgcgaaaucgagaucaacguucuguugccccaaguggcagucaaucuauccaacugccaugugcugauuaagucucacgugugugauuacucgcucgacauagaugguacgaucagacugccuaggauuuaccacgaaggcaccuucauccccgggacauauaaaauagucauugacaagcgggauaaacagaaugaccgcugcacucuuguuaccaacugugugaucaagggacgagagguaagaaaaggccagagcgcccugaggcaguaccggacagaaauccguauugguaaggcuuccgccgggucacgcagauugcucagugaggagucuggcgacgauugcaucagcaggacucaacuguuacggaccgaaacggcagaggugcauggagacaauuauggcgggccaggagauaagauuacaauauguaacgguuccaccaucgucgaccagcgacugggcucagaacuagggugcuacacuauuaaucgcgugaaauccuuuaagcucugcgagaacucuggaacaggcaaauccuguaagaucgauaaacacccuguuaagugcagacaggguuucugucugaagaucacccaggaggggaggggccaugugaaacuuagucggggaagcgaagucguguuggacgccugcgauucuuccugugagauuaugauacccaagggcacuggggacauccugguagauugcucaggaggucaacagcacuuccucaaagacaaucugguugaucuuggcuguccaaacauuccgcuguuggggaagauggcuaucuauauuugccgcaugaguaaucauccuaaaaccacaauggccuuucucuucugguuuagcuucggauacgugaucacguguauauuuugcaagaucauuuucuaucuguuaaucgucgugggcacccuggguaagaaauuuaagcaguacagagaacuaaaaccccagacuuguacaauuugcgagaccacaccaacuaacgcaaucgacgcggaaaugcacgaccucaagugcucguacaauauaugucccuauugcgcuuccaggcugaccucugaugggcuugcccgucacgucacgcaauguccuaaacggaaggagaaaguggaggaaacagaguuguaccugaaccucgaacgaaucccauggauuguuagaaagcuguuacaggugagcgagucaaccggcguagcacugaagaggaguuccuggcuuauugucuugcucgugcugcuaacuguuucucugagccccgugcaguccgccccuaucggacauggcaaaaccauagaagcauaucagacacgcgagggguacacuucagucugccucuucaugcugggaggcauccuuuuugugguaagcuguuugaugaagggucugguggacaguguuucuaauuccuucuuuccgggguuaagcauuugcaaaaccuguucgaucggaucagucaacggcuucgagauugaaucucacaagugcuauuguagucuccugugcugucuuuacugccggcauugcuccgccgauagagagauccaccaacugcacuugagcauauguaaaaagaggcgcgcugguggcaacgugaugcucgcugugugcaagcgaaugugucugcgggccacaauggaagucucuaauaaaguucuauuuauucguagcaucaucaacacgaccuucgugauuugcauccuggugcucgcgguauguauugucuccacuucagccguggagauggaaagucugccagcugggacaugggagagagaggaagaccuuaccaauuucugccaucaggagugucagguuacugaaacagagugcuugugucccuaugaggcacugguguuaaggaagccucucuuuagcgauucuauagucaaaggaaugaagaaccugcuuaauuccaccucacuggaaacgagucuaagcaucgaggccccauggggcgcuauuaacgugcaauccacuuucaaacccaccguuucuacagccaauaucgcacucucguggagcucaguggaacaccgcgggaacaagauucugguauccggacggagugagucuaucaugaaguuggaagagagaaccggcauaagcugggaccugggugucgaggaugcguccgaaucaaaauuacucacugugucugugauggaccugagccagauguacaguccugucuuugaguaccuuuccggggauaggcagguugaagaguggccgaaggccacaugcaccggagacugucccgaucgaugcggcugcacaagcucuacuugucugcauaaagaauggccacacucacgcaauuggcggugcaacccuaccugguguuggggugugggcacggggugcacauguugcggauuggacguaaaggaucucuucaccgacuauauguuugugaaauggaaggucgaguacaucaagacugaggcuauuguguguguugaacugaauagccaggagagacaaugcagucuaaucgaagccggcaccagguucaaccuggggcccgugacaauuacucuuagcgagccacguaauauccagcagaaacucccucccgaaauaauuacccugcauccacgcaucgaggagggauuuuucgacuugaugcacguccagaaggugcugucggcaucuacgguuuguaaauuacaauccugcacacacggcgugccgggugaucuccagaucuaucauauugggaaccugcuuaagggagaccgggucaauggccaccugauacauaaaaucgaaccucacuuuaacaccagcuggaugucaugggaugguugugacuuggauuacuauugcaacaugggcgacuggcccaguugcacuuacacagggguaacccagcauaaucacgcugccuucgugaaccuccugaauauugagacugauuauacaaagaacuuucacuuccauucuaaaagaguuaccgcacacggagacacgccacagcuagaucugaaggccaggcccacuuacggcgcuggggaaaucaccgugcuugucgagguggcggacauggagcuccauacaaagaaaauugccaucuccggacugaaguuugcaagccuaaccuguacaggcugcuacgcuuguucaagugguauaagcugcaaaguacgaauccacguggaugaaccugacgaguuaacuguccacguuaaguccgaagauccagacauuguggccgccucuagcucccugauggcucggaaacucgaguucgggaccgacucaacguucaaggcauuuucugccaugcccaagacaagucuguguuucuauaucguggaacgcgaguacugcgagucguguagcaaagaagauacucaaaagugcgucaauaccaaacuugagcagccucaguccauucugaucgaacauaagggaacaauaauuggcaaacaaaacgacaccuguacugcgaaggcuucuugcugguuggagucaguuaagagcuuuuucuauggcuugaaaaauaugcuguccgggaucuuuggaaacguguucaucgguauuuuucucuuccuggccccguuuauccuuuuaauacuguucuuuauguucggcuggaggauucucuucuguuuuaagugcugcagacggacccgaggguuguucaaauacagauaucugaaggaugacgaagagaguggauaccgcaggaucauugagcgucucaauaacaaaaagggcaagaauaaacugcuugauggugaacggcuggcagacagaaggaucgccgaguuguuuucuacaaagacgcacauaggguga

SEQ ID NO: 10377 - RNA, 5055 nt, Artificial Sequence
  derived and/or modified CDS sequence (opt3) from CCHFV(SPU 18/88)__KJ682810.1__GP
auguacacccccuuacucugcgccauccuuugucugcaguuguggagcuuagagggcauuuaugggcuguccaacaagacacaacacaaugacacuucuacgauaaaagugccugaagagucacagaagaccagucuaccagcuaacacagcaagcccgaucacuuccgaucccucuucggccaccucaacagcgcucgcuagcggaccugaagguaguggcgacaccuccacuucuccaagcgucacaacccaggggcccacgcugcuugagacuaccccugaaccacauacaacuauugauaucgacgaguccucaaccgccauugcagauaucaguacacagaccguuaaagacauacccacgccuacuacacacaccagccugccaucuacuccguccgcccccacaaucccucaagaggcucaucacaccgcaagaggauugcucucagugacgagcaccaagccaggcgaaacaaguacucccaccucuccuggugaggccuccacagaagcuagcucgccacagcccacuauuucugagaccccguccccucccccaacaacccaggccccuacugagaucaauaaccccaauacgucaaggcagccaaugcccaguacacaaccugcggcaccaaacagcguaaccccgcccgugcagccuacuuucucccagucugaugucagcaccguggcccaggacauucauccaucacccacaaaucggaguaaacgcaaccuggaaauggagaucauacugacccucucccaaggguuaaagaaguacuauggaaaaguucugaaacuuuuggaucugacucuagaagaggacacagaaggccuccuggaguggugcaaacgaaaucuuggccugacgugugaugacaacuuuuuccagaagcguauugaggaauuuuucuugaccggggagggacacuuuaaugaagugcuccaguucaaaacuccuagcacacugucuccaaccgagcccgcuagagucgaaucaccgacaguggagccuuuuaagaguuacuucgccaaggguuuucugagcauggauuccggcuauuucucugcaaaaugcuacccaaagucgagcaacuccgggcugcaacucaucaauguaacucagcacucaauuaggaucaccgacacgcccggaccuaaaaucaccagucuuaagacaauuaacuguauaaaucugaaggcuuugguuuuuaaggagcaucgggaaaucgagauuaacgugcuacugccccaggucgccgugaaccucucuaauugccacgugcugaucaaaagccaugcgugugacuauucccuugauauagacggcccaguccgccugccuaggauucaccacgaagguacuuucauccccgggaccuacaagaucguuauugauaagaaaaacaagcagaaugacagaugcacauuggugacuaacuguguaaucaaaggacgggagauucgcaagggccaaucagugcuccgacaguacagaaccgaaauaaaaaucggcaaggccagcucuggguccaggcggcuguuaagugaggagagcaaugaugacugccugucucguacgcagcuacuccgcacagaaaacgcagagauucauuccgauaauuauggagguccaggcgacaagaucaccaucuguaacgggucaacuauugucgaucagagacugggaagugaacuuggcugcuacacaauaaauagggugaaaucguuuaaguugugcgagaacagcgcuaccgguaaauccugugagaucgacucuacuccgguucggugccgacaaggguucugucugaagauuacccaggaaggccgcggacacgugaaacucagcagaggcucagaggucgugcuggaugccugcgacaguuccugugaaaucaugauuccuaaggggacaggagacauccuuguagauugcucugguggccagcagcauuuccugaaggacaauuugguugaucucgggugucccaacauaccacuguuaggaaaaauggcuaucuauauuugcaggaugagcaaucaccccaagacgaccaugggcuuucuguucugguuuuccuucgguuacgugaucacuuguauucuaugcaaagucaucuuuuaucuccugauaguggucgggacacuuggcaagaaauucaagcaauaccgggaguugaagccucagaccuguacaauuugcgaaacuaacccagugaaugccaucgacgcagagaugcaugaucugaacugcucauauaacauuugucccuacugcgccagccgccucaccagugacggacuggcuagacacguuaugcaguguccuaaaaggaaggagaaaaucgaagagacggaauuauaccugaaucuugagcguauaccgugggugguacggaaguugcuccaggucucugaauccacaggcguggcgcugaaacgaagcucguggcuaguuauccugcucgugcugcuuaccgucucauugucuccagugcaaagugcacccauuucccacggggagacuguagagguguaucagaccagagaaggauacacaagcaucugccuguuuguuuuagguucuauucucuuccuggucagcugucuuaugaagggccugguggauuccguggggaacucauuuaguccuggauugagcaucugcaaaacuuguucuauaggcuccauuaaugguuucgagaucgaaucacauaagugcuauuguagucucuuuugcuguccauacugcaggcacugcagcgccgacaucgagauucauaagcugcaccuauccaucuguaaaaagcgcaaaaccgggucuaacgucaugcuggcuguuugcaagcggauguguuucagagccacaguggaagugucgaauaaagcacuccugauuaggaacauaaucaauacgaccuuuguagucugcauucuuaucuuggccguguguguugugagcacuucagcugucgagauggagaaccugcccgccggcacaugggaaaaggaggaagauuuaaccaauuucugccaccaggagugucaagugacugagacagaaugccucuguccuuaugaggcacugguucuucgcaagccgcuguuccuagacuccauugugaaaggaaagaaaaaccuccugaauaguaccucuuuggaaacgagccuguccaucgaggcgcccuggggcgcuauaaacguacagucaacuuuuaagccaaccgucucugccgcaaauaucgccuuaagcuggaguuccguggaacaucgagggaacaaaauucucgugagcggacggucugagucaaucaugaagcuggaggaacguacaggcauuuccugggaucuuggugucgaggacgcuagugaaagcaagcuguugaccguuucggugauggaucucucucagauguacuccccuguauucgaguaucugagcggggacagacagguggaagaguggcccaaagccacuugcacaggagacuguccagagaggugcggcugcaccucaaguacaugucuacacaaggaauggccucauucucgcaauuggcggugcaaccccacuugguguuggggugucggcaccgggugcacguguugcggacuggaugugaaagaccuuuuuacagauuacauguucguuaaguggaaaguggacuacaucaagaccgaggcaauagucuguguggaacucacuucccaagagagacagugcagccugauugaagcuggcaccagguuuaacuuggggccaguuacaaucacucugucagagccgcgaaauauccagcagaaguuaccucccgagauugugacccuccacccacgcauagaagagggauucuuugaucugaugcauauccaaaaaguccuuagugccagcacgguauguaagcugcaguccugcacacacggcgugcccggugacuugcagauuuaucacaucgggaaccuccugaaaggagauaagguuaauggccaucuaauucacaaaaucgaaccucauuucaacaccucuuggaugagcugggacgguugugaucuggacuacuauugcaauaugggcgauuggccauccugcucauacacuggggugacacagcacaaccaugcggccuuugucaauaugcuuaacauagagaccgacuauacuaagaauuuccacuuucacucuaaacgggugacagcucauggagauacgccccaacucgaccugaaggcaagaccuaccuacggcgccggggagaucacuguauugguggaagucgcugacauggaguuacacaccaagaaaauugaaaucaguggacugaaguucgccucgcucacauguaccggcugcuaugcauguagcuccgguauuucuugcaaaguuaggauccauguggaugagccggacgaacugacagugcacgucaagucagaggauccagacauaguggcggccagcuccagucuuauggcucguaaacuggaguuugggacugauucuaccuucaaggccuucagcgcaaugcccaagacgucauuguguuuuuacauuguugaacgcgaguacugcaaauccuguaguaaggaagacacacagaaaugcguaaacacuaagcuagagcagccucaaagcauccugaucgaacacaaaggaaccauuaucggcaagcagaaugauacauguaccgguaaggcuggcugcuggcucgagucuauaaaauccuucuuuuaugggcugaagaacaugcuuucaggaauuuucggcaauguguuuaucgggauuuucuuauuucuggcccccuucaucaugcucauauuguuuuucauguuuggauggcggauucuguucuguuucaaaugcugcagaaggacucgaggccucuuuaaguaccggcaucugaaagacgaugaggaaaucgguuaucgcaagaucauugagagacuuaagaacaaaaaggggaaaaauaagcuguuggacggagaaaggcuagcagaucggaaaaucgccgagcuguucagcaccaagacacacauuggcuga

SEQ ID NO: 10378 - RNA, 5055 nt, Artificial Sequence
  derived and/or modified CDS sequence (opt3) from CCHFV(66019)__AB069669.1__GP
auguacacccugcucgugugcgccguccuuuguccccagcuguggagcuuggagggcacacacguuccucauaacgaaacuaagcacaaugggacgggaaucaccgcugcaccaggugagucccaaggcccgaugucucccgccucaacagcggugccuuuaacuccagaacccccuaacaccaaaccagcugccagugcaagcgagcuggaauccucuggggagggacauacaucgcuacucgccaccacucagggccugacaucacccgaggcuaccccugaacuuccaacgacuaccgacacagguguaagcaguacuuccguggucgauauugggacccagauggcaaaggacacaccgaccucuacggcccacacuagccugcccuccaauccuucagcuccaaguacagcccagggaacccaucacacuauaagaggcuugcucagcgugacaucuaccaaacccgaggaagcguccacgccuaccgauccaggcaaggcaggggccgagacaggaucacccaggccggcuaucagccggaaaccuacucugagucccaccgccgaggcaccaacagaaauuaacaauucuuccacuccuaagcaacccgagccaagcauccagcccgcuaccccuucgcugguuauuucuccagcccagccggcguucccccaguccgccacaucaaccgcagcucaagacaucuauaguagcccuacuaaccgcuccaagcgaaaucucaaaauggaaauaaucuuaacgcugucucagggucuuaagaaauacuauggcaagauucagaaaacauuggggcugacccuagaggaagauacugagggacuccuggaguggugcaagcguaaccuuggccugaccugugacgauaacuuuuuccagaagagaaucgaagaguuuuucuugacaggugaaggguacuuuaaugaggugcuccaauucaaaaccccaagcacucccggaucaacagaaccuacgcacaccgaggccccaacugucaagcccuuuaaaaguuauuucgcuaggggcuuucugacaauugacuccggcuacuucagcgccaagugcuauucucggaccucaaauaguggguuacagcugaucaacgugacacagcauccggcacgcauagccgauacuccuggaccaaaaauuaccaaucucaagacgaucaacuguauuaaucuuaaagcuagcguauuuaaggagcacagagaaaucgagaucaacguucuguugccccaaguggcggucaaccuauccaauugccaugugcugauuaagucucacgugugugacuacucgcucgauauagacgguaccaucaggcugccucggauuuaccacgaaggcacauucauccccgggacuuauaaaauagucauugauaagcgcgacaaacagaacgaccgaugcacccuuguuacaaauugugugaucaagggaagagagguaaggcggggccagagcgcacugcgucaguaccgcacugaaaucagaauugguaaagccuccgcugggucaaggcgguugcucagugaggagucuggcgaugacugcaucagccgaacccaacuguuacgcacggaaacagccgaggugcauggagauaacuauggcgggccaggagacaagauuaccauauguaaugguuccacuaucgucgaucagagacugggcucagaacuagggugcuacacaauuaacaggguuaagagcuuuaaacucugcgaaaauucuggaaccggcaaguccuguaaaaucgacaacacuccugugaagugccggcaggguuucugucugaaaaucacccaggaggggcgcggccacgugaaacuuaguagaggaagcgaagucguguuggaugcaugcgacucuuccugugagauuaugauacccaagggcacaggggauauccugguagacugcucaggaggucaacagcauuuccucaaggauaaucugguugaccuuggcuguccaaacauuccgcuguuggggaagauggccaucuauauuugcaggaugaguaaucacccuaaaacgaccauggcuuuucucuucugguuuagcuucggauacgugaucacuuguauauuuugcaagaucauuuucuaucuguuaaucgucgugggcacacuggguaaaaaguuuaagcaguaccgugaacuaaaaccccagaccuguacaauuugcgagacuaccccaacgaacgccaucgacgcagaaaugcaugaucucaagugcucguacaauauaugucccuauugcgcgucccggcugacaucugacgggcuugcucgacacgucacccaauguccuaaaagaaaggagaaaguggaggaaacugaguuguaccugaaccucgaaaggauuccauggaucguucgcaagcuguuacaggugagcgagucaaccggcguagcccugaaacggaguuccuggcuuauugucuugcucgugcugcuaacaguuucucugagccccgugcaguccgcaccuaucggacacggcaagacuauagaagccuaucagaccagagagggguacacaucagucugccucuucaugcugggaggcauccuuuuugugguaagcuguuugaugaagggucugguggauaguguuucuaauuccuucuuuccgggguuaagcauuugcaaaacguguucgaucggaucagucaacggcuucgagauugaaucucauaagugcuauuguagucuccugugcugucuuuacugcaggcacugcuccgcugaccgcgagauccaucaacugcacuugagcauauguaaaaagcgacgggccgguggcaacgugaugcucgcagugugcaaacguaugugucugagagcuaccauggaagucucuaauaagguucuauuuauuaggagcaucaucaacacuacauucgugauuugcauccuggugcucgccguauguauugucuccaccucagcgguggagauggaaagucugccagccgggacuugggagcgcgaggaagaucuuacaaauuucugccaccaggagugucagguuaccgaaacggagugcuugugucccuaugaggcucugguguuacggaagccucucuuuagcgacucuauagucaaaggaaugaagaaccugcuuaauuccacuucacuggaaaccagucuaagcaucgaggcaccauggggcgccauuaacgugcaauccacauucaaacccaccguuucuacugcuaauaucgcccucucguggagcucaguggaacauagagggaacaagauucugguauccggaaggagugagucuaucaugaaauuggaggagcgaacaggcauaagcugggaucugggugucgaggacgcauccgaaucaaaguuacucaccgugucugugauggaucugagccagauguacaguccugucuuugaguaccuuuccggggaccgccagguugaagaguggccgaaggcgacaugcacuggaaauugucccgaucggugcggcugcaccagcucuacgugucugcacaaagaauggccacauucaagaaacuggaggugcaauccuacaugguguuggggugugggcaccgggugcacuuguugcggauuggacguaaaggaucucuucaccgacuauauguuugugaaauggaaggucgaguacaucaaaacagaggccauuguguguguugaacugaacucccaggagcgucaaugcagucuaaucgaagcuggcacucgcuucaaucuggggcccgugaccauuacgcuuagcgagccacggaacauccagcagaagcucccuucggaaauaauuacacugcaccccagaaucgaggagggauuuuucgacuugaugcauguccagaaggugcugucugccuccaccguuuguaaauuacaaagcugcacucacggcgugccaggugaucuccagaucuaucacauugggaaucugcuuaagggagacagggucaacggccaucugauacacaaaaucgaaccgcauuuuaacacaucauggaugaguugggaugguugugacuuggauuacuauugcaauaugggcgacuggccuucuugcaccuacacugggguaacacagcacaaccaugcagcuuucgugaaucuccugaacauugagaccgauuauacgaagaauuuucacuuccacuccaaacgaguuacugcccauggagacacaccccagcuagaucugaaggcacggccaacauacggcgccggggaaaucaccgugcuugucgagguggcugacauggagcuccacaccaaaaagauugcgaucagcggacugaaguuugccucauugacuuguaccggcugcuacgcauguaguagcgguauauccugcaaaguacgcauccauguggaugaacccgacgaguuaacgguccacguuaagucugaagauccugacauuguggcugccagcuccucacugauggccagaaaacucgaguucgggacagacucuacuuucaaggcuuuuagugcaaugccaaaaaccucgcuguguuucuauaucguggaaagggaguacugcgagagcuguuccaaggaagauacacaaaagugcgucaacaccaaacuugagcagccccagucuauucugaucgaacacaagggaacuauaauuggcaaacaaaaugacaccuguacagccaaggcgucaugcugguuggagagcgugaaauccuuuuucuauggccuaaagaacaugcugagugggaucuuuggaaauguuuucaucgguauuuuucucuuccuggcuccuuuuauccuuuuaauacuguucuuuauguucggcuggcggauucucuucuguuuuaagugcugccgaagaacgcgcggguuguucaaauacagguaucugaaggaugacgaagagucuggauaccgucggaucauugagagacucaacaauaaaaagggcaaaaacaagcugcuugauggugaaaggcuggccgaccgccgaaucgcagaguuguuuagcacuaagacccauauaggguga

SEQ ID NO: 10379 - RNA, 5052 nt, Artificial Sequence
  derived and/or modified CDS sequence (opt3) from CCHFV(Gaib)__KX013445.1__GP
auguacaucccccugguguaugccgucauuuaccuccagcuuuauggccuugggggagcucacgguuuguuaaacaagaccgagcaaaaugaaacaggcauaacugcaacgcaugggagaguucagggaccuccaagcgccuccaucacccugccggugacacccgacccucuaucugcgacuucagcugccaguaccagcggcccagaggguuccggggaaguacccacaucuccuucgaccauuacucagggacucacaucaagcgagaacaccccacagcugcccacggcaacugauaccggcaucaguuccacaucuauuaucgacgugagcacucaaaccgccggcgauacauccaccccuacggcucacacuucacuuccaaauaguccgagcgcacccuucacaucucaggacaccaggcauacuguccgggggcuguugacagugaccuccacgaaaucagaugaagccagcacccucacagacccuaaggaggcuaguacugaggcccgcucuccaucccccagcauaucgcgaaccccuacaccaucucccacuguucaggcguccaccgaaaacaauacaccgucaaccccucgucagcccgagccaacuacgagaccugcacugcccaguccaacaaccagccccacucaaccuucccugucucagagcgccaccucagcugccauccaggauaugcacccaaguccgacaaacaggucccggcgcaaucucgaaauggagauuaucuuaacccugagccagggacuuaaaaaguacuaugguaaaauuuugaagcugcuagaccucacucuggaggaagauacagagggccuucuggaauggugcaagagaaacuuggaccucacgugugaugagaacuuuuuccugaaaaggaucgaagaguuuuucuuaucuggggagggacauuuuaaugaagugcugcaauucaaggcacccucaaccaugaguagcacugagccuacacacgcuggcccacccaccgucgaaccuuuuaaauccuacuucgccaaggguuuucucucuauagacucgggguauuucagcgcgaaaugcuacccacggacauccaauucaggacuucagcugauuaacgugacucagcacaccgcccgcaucgcagauacgcccggcccgaagauuaccaauguaaagacaaucaacuguaucaauuugaaagcuaguguuuuuaagaaacaucgagagguggaaauuaacguccuacugccucaaauagccgugaaccucucuaauugccacgugcugaucaagagccaugucugugacuacucccuuaacuucgacggcaugguuagacugccaaggauucaccacgaggggacuuuuauccccggaaccuauaaaauagugauugaucggaagaauaaacagaacgaccguugcacauugguaacuaauugugugaucaagggucgcgaggucagaaagggccagucagcucucaggcaguaccggaccgaaaucaaaauuggggaggccagcaucggaucucgacgccuguuauccgaagagaguagcgaugacugcauuucuagaacgcaacugcuaaggacagaaaccgcagagauacauaacgauaauuauggcgguccuggggacaagaucacuauuuguaacggcuccacaaucguggaucagcggcucggaucagagcugggcugcuacaccaucaaucgcguuaaaaguuucaagcugugugaaaacagcgccacugggaaaucgugcgagauugacuccauacccgugaagugcagacagggauucuguuugaagaucacccaggaagguaggggccacgucaaacugucucgugggagcgaggugguacucgaugcuugcgacucaaguugugagauuaugaucccaaagggaacaggcgauauucugguugacugcuccggugggcaacagcauuuucuuaaagacaaucugaucgauuugggcuguccuaacauaccccuccugggaaagauggcgaucuauauuugccggaugucuaaucacccaaaaacgaccauggcauucuuauuuugguucagcuuuggcuacgugaucacuuguauuuucugcaaggccaucuuuuaucugcuaauaauugucgggacacucggaaagaaauucaagcaguaccgagaacugaaaccgcagaccuguacaaucugcgagacuaccccugugaacgcuauugacgccgaaaugcaugaucuuaauuguuccuacaacaucugccccuauugcgcaucaagauugacgagcgacggucuggccaggcacgucgugcacuguccaaagcgcaaagagaagauagaagagacagagcucuaccugaacuuagaacggguucccugggugguaagaaagcugcuucaagucagugagucuaccggcguggcuuugaaaagguccagcuggcucaucguucugcuagugcugcucacugucucgcugucaccugugcagucugccccaauugggcauggaaagaccaucgaaacauaucagacucgcgagggcuacaccaguauuugccuuuuuguauugggugggauccuguucauaguguccuguuuaaugaaaggccucguugauagcgucggaaauaacuuuuuccccggccugacaauuugcaagacguguucuaucagcuccaucaauggguuugaaauugagucacacaaaugcuauuguagucuucugugcuguccuuacugccgacauuguagcgcagaccgggagauccaccaguugcaccucucuauuugcaagaaacguaagaccggauccaacgugaugcuggcggugugcaagagaaugugucuaagggucacuacagaaguuucaaaucgcgcucuguucauacggaguaucauuaacaccacuuucgugaucugcauucucauccuggccguguguguaauaagcacauccgcagucgagauggaaaaucuuccggccggcaccugggagagagaagaggauuugacgaacuuuugccaucaagagugucaggugacugaaaccgagugccuguguccauaugaagccuuaguucucaggaaaccccuguucucugacucgaucgugaaggguaugaaaaaucuucugaacagcacaucacuagagaccucccucaguauugaggccccuuggggagcaaucaauguccagucuacuuuuaagccaacagugagcaccgcuaacauugcccuguccuggucaucuaucgaacaccgagggaauaaaauauugguuagcggccgcagugaguccauuaugaagcuggaggaacggacagguaucagcugggauuuaggcguggaagacgcgucugagucaagacuccugacuguauccgucauggaucuuagucaaauguacagccccguguucgaguaccugucgggggaccgucagguggaagaguggccuaaggcuaccugcacgggagauuguccggaaaggugcggcuguacaucuuccacaugcuugcauaaagaguggccccacagccgcaacuggcggugcaauccaacuugguguuggggagucgggaccggcugcacauguugcggucucgacguuaaggaccuguuuacugauuauauguucgugaaauggaagguagaauacaucaaaaccgaggcuauugugugugucgagcuaacgucacaggaaagacagugcagucugauagaggcagggacaagguuuaaccuuggaccugugaccaucacucucucugaaccccgaaacauucaacagaagcugccaccugagaucauuacauugcauccccggaucgaagagggcuucuuugaccugaugcacguucagaagguguuauccgccagcaccgucuguaaacuccagucaugcacucacggugugccaggcgaucugcaaguuuaucauauagggaaucuucugaagggagacaaagugaacggccacuugauccauaagauugagccgcacuucaauacaaguuggaugagcugggaugggugugaccucgauuacuauugcaacaugggagacuggccuuccuguaccuacacgggcgucacucagcauaaucacgcugccuuuguaaaccugcuaaauaucgaaaccgauuauaccaaaaacuuccacuuucauucuaagcgcgugaccgcacacggugacacaccccagcuggaucuuaaggcgagaccaacuuacggggccggagagauuaccguucucguggaagucgcugacauggagcugcauacgaaaaagaucgagauaagcggcuugaaauucgccuccuuaacaugcacugguugcuacgcauguucaucuggcauuaguugcaaggugaggauccacguagaugaacccgacgagcugaccgugcacgucaaaucggaagacccugauaucguugcugccagcuccucucucauggcacggaagcuggaguucgggacagacucaaccuuuaaagccuucagcgcuaugccaaagacuucccuuuguuuuuauauuguggaacgagaguacugcaagaguuguucuagagaggauacccagaaaugcgugagcacaaagcuggaacaaccccagucaaucuugauagagcauaaaggaacgauuaucggcaagcagaauaacacuuguaccacaaaaaccacuugcuggcuagaauccgucaagaguuucuuuuaugggcugaagaauaugcucagcucuauuuucggaaacguguuuguuggcaucuucuccuuucuggcgccuuucauacuuuuaauucuguuuuucauguucgguuggcgcauccucuuuuguuucaaaugcuguaggcguacacggggguuguuuaaguacagacaccugaaagacgaugaggaaaccggauauaggcgcaucauugagcgacucaauaacaagaaaggcaagucaaagcugcuugacggcgagagacuggccgaucggaaaaucgcagaauuguucagcacgaagacucauauuggguga

SEQ ID NO: 10380 - RNA, 5055 nt, Artificial Sequence
  derived and/or modified CDS sequence (opt3) from CCHFV(SPU415/85)__DQ211635.1__GP
auguacacuccccuggugugcgccgucaucugucuccagcuuuggaaccugggcgggacauugguuuucauuaauagaacucaacacaacgagacgggaaccguggcuacaccugaagguacuuuaaggccacggcugccgguaagcaccgcacuacccacaaaguccgaccgcccuucugugggcccagccgcgucaaguagcgggcucgagggauccggcgaacccaauaccucuccuucgauaacuacaaaaggucugaccccacccgagacgacuccugcccuuccaaccgcuacagauacugacgcaucaagcaccggggucguggauguuaguacacagaugaccaaggacaucccgauguccacggccuauacuaaucccccuucuacaccaagcgcucccuccaccccucagggaacucaucacacagcacgaggccuguugucaguggccaguaccaaaagcgaagaggucucuauguccacgucaccagcuaagaccagcacagagaccaguucucccccgccugccaccuccgaaacacccacuccaagcccuaccacacaggugcccaccggcaacaacaauccaaacacuucgcgucaacccacgccuucugcgcagccagcaauguccaauccggccacaucacccgcucagccuaaccucagucagagcgccccacccaccgcagaucaagggguacauccuuccccaacuaauagaucuaaaaggaaccuggagauugaaaucauucugacccucagccagggauuacggaaguacuaugguaagauccugaaacuuuuggaccugacacuagaggaggauaccgaaggccuccuggaguggugcaagcgcaaucuugggcugacuugugacgauaacuuuuuccagaaaagaauagaagaguuuuucuugacaggagaaggcuacuuuaaugagguucuccaguucaaggugcccucaacgcugaguuccaccgagccgacucacacaaggccuccaaccgucgaacccuuuaaaagcuauuucgcuaaggguuuucuuucuaugaacucaggguacuucagugccaagugcuauccucggacaagcaacuccggacugcaacucaucaaugugacuaaacauucugcgaagauugccgacacccccggcccaaaaaucacgaaccuuaagaccauuaauuguaucaaccugcgcgcaucgguguuuaaagagcaccgagaagucgagauaaauguuuugcuaccucagguggcuguaaaccugagcaauugccacgcccagauuaagucccaugugugugauuacucacucgcuacagacggcauggucagacugccccacauccaucacgaagggacuuucauuccaggaaccuacaaaaucgugaucgauaagaagaacaaacaaaaugacaggugcacacuuguuacuaacugugugauuaagggucgggagguccguaaaggccagagugcccugcgccaguauaagaccgagauaagaaucgggaaagcaucuagcggauccaggcgguugcucucagaagagagcgacggcgauugcauuucucgaacgcagcuguuacgcacagaaaccacugagauccacuccgacaauuacggugggccgggcgauaagauaacaauuuguaacggaaguaccaucguggaccaaagacugggcagcgaacuagggugcuauacuaucaauaggguaaagucuuuuaaacucugcgagaacuccgccaccggaaagucaugugagauugauaguacaccuguuaaaugccggcaggguuucugucugaagaucacgcaggaaggccgcgggcaugugaaacuuagcagaggaucggagauugucuuggacgcuugcgauuccaauugugaaauaaugauccccaagggcaccggugacauucugguggauugcucugggggccagcaacacuuccucaaggacaaccugaucgaucuuggauguccaaacaucccccuguugggcaaaauggcgauuuacauaugcaggaugagcaaucauccuaagacuacaauggcauuucucuucugguuuucauucggguaugucaucaccuguauucugugcaaagugaucuuuuacuuacugauuguugccggaacaguggguaagaaauucaagcaguaucgugagcuacggccacagacuuguaccaucugcgagacgauacccguaaacgcuaucgacgccgaaaugcacgaccucaauugcaguuacaacauuuguccuuacugcgcaucccgacugacaucugauggccuugccagacaugucaugcaguguccgaagaggaaagagaagguggaagagaccgaauuguaucugaaucucgagcgcaucccauggguugugcggaaacuguuacaagucagcgaguccacugggguggcucugaagagaucaagcuggcuuaccguauugcucgugcugcuaauuguuagucugucucccguccaguccgccccuaucggacacggcaaaacaauagaaacuuaccaggcaagggaggguuauaccagcuuuugccucuucauucuggggucgauccuuuuuguggugucauguuuggucaagggccugauugacucuguuggaaacaguuucuuuccaggcuuauccaucugcaaaacauguagcauagggucuaucaauggauucgaaauugagagccacaagugcuacuguucccucuuuugcugucccuauugccgccauugcucagcggaucgagaaauccacaagcugcaucuuaguauuuguaaaaagcggaaaacgggcagcaacgugaugcuggcugugugcaagcguauguguuucagagccaccaucgagguaucuaauagggcauugcucauacgcaacauuaucaauacuacauucgucgugugcauccugacccuagccguuuguguggucuccacuucagcuguggagauggaaagucugccugccgguacaugggagaaagaagaggaccucaccaacuuuugccaccaggaaugucaaguuacggagacugagugccuguguccguacgaagcacuuguguugcggaagccccuguucuuagauagcauuguaaaggggaugaaaaaucuccugaacuccaccucucuugagacaucgcugagcaucgaagcuccauggggagccauuaauguccagucaaccuuuaagccuacuguguccgcggccaacauagcucuaaguuggucuagcguggagcacagaggcaacaaaauccucgucuccgguaggucagagucuauuaugaagcuggaggaacgaacaggcaucagcugggacuuggggguugaagaugcaagugaguccaaacuguuaaccgugagcguaauggaccucucucagauguauucacccguguucgaauaccuguccggagaucgccaagucgaggaguggccaaaggccacaugcacuggcgacuguccugaacggugcgggugcaccaguagcacgugucuucauaaggaguggccccacucgagaaauuggaggugcaacccaacaugguguuggggagugggcaccgguugcacuuguugcgggcuggauguuaaagacuuguuuaccgauuacauguucgugaaguggaaagucgaauauauuaagacagaggcuaucguguguguugaacucacuucucaggagcgucagugcucccugauagaggccggaacccgcuuuaaucuaggcccggugacgaucacacugagcgaaccucggaacauucagcaaaaacuucccccagagaucauuacccuccaucccagaaucgaagaggguuucuuugaccugaugcacguccagaggguauugucagcaaguacuguguguaagcugcagucuugcacacauggcguuccuggggacuuacagguguaccacauaggaaaucuccugaagggcgauaaagucaacgggcaccuuauucauaagaucgaaccacacuucaauaccuccuggaugagcugggacggaugugaucuggacuauuacugcaacaugggcgauuggcccucaugcacuuauacaggugugacccaacauaaucacgcggccuuuguaaacuugcucaauaucgagacggacuacacuaaaaacuuccauuuucacaguaagcgagugaccgcucacggggauacaccucagcuggaccuaaaagcccggccgaccuauggagcaggcgaggucacaguucugguggaaguggcugauauggagcuucauacuaagaaaauugaaauaagcggucucaaguucgccucccugaccuguacgggcugcuacgcauguucuagcgggaucuccugcaaggucaaaauucacguggacgagccagaugaguugacaguucauguaaagucagaagaccccgauaucguggccgcuggaucuaguuuaauggcgcgcaaacuggaguucggcgccgacucgacuuuuaaggcauucagcgcuaugccuaaaaccucccucuguuuuuacauugucgaaagagaguauugcaagucuuguucaagggaagacacacggaagugcgugaauaccaaacuggaucgaccccagagcauccuuauagagcacaaggggacuaucauuggaaaacagaacaauaccuguacagccaaggccuccugcuggcuggagaguguuaaaucuuucuuuuacggcuugaagaacaugcuaagcgguaucuucgggaacguguuuauuggaaucuuccuguuuauagcuccauucguccuccugauuuuauuuuucauguucggcuggagaaucuuauuuuguuucaagugcugccgcaggacgcguggccuguuuaaauaucggcaccucaaggacgaugaagagacuggguacagaaaaaucauugaaagguugaauaacaagaaaggaaagaauaagcugcucgacggugagcgccuggcagaucgaaaaaucgccgaacuuuucucaaccaagucccauauaggcuga

SEQ ID NO: 10381 - RNA, 5055 nt, Artificial Sequence
  derived and/or modified CDS sequence (opt3) from CCHFV(SPU 431/85)__KJ682812.1__GP
auguacacaccccuugugugcgccgucaucugucuccagcuuuggaaccugggcgggaccuugguuagcacuaauagaacgcaacacaacgagaccggaacaguggcuacuccugaagguaccuuaaggccacggcugccgguauccacagcacuacccaccaagucugaccgcccuucagugggcccagccgcgaguagcuccgggcucgagggaucuggcgaacccaauacuucgccuucaauuacaaccaaaggucugacgccacccgagacuaccccugcccuuccaacagcuacugauaccgacgcaagcaguacaggggucguggauguuuccacccagaugacgaaggacauaccgaugucuacugccuauacaaaucccccuagcaccccauccgcucccucaacuccucagggaacacaucacaccgcacgaggccuguugaguguggccagcacgaaaucugaagaggucuccaugucaaccagcccagcuaagacaaguacugagaccucuucucccccgccugccacaagcgaaacucccaccccaucgccuacaacccaggugcccacuggcaacaacaauccaaacacgucucgucaacccacaccuuccgcgcagccagcaaugucaaauccggccaccagucccgcucagccuaaccucagccaguccgccccacccacugcagaucaagggguacauccuucuccaaccaauagaagcaaaaggaaccuggagaucgaaauuauccugacacucucacagggauuacggaaguacuaugguaagauucugaaacuuuuggaccugacccuagaggaggauacugaaggccuccuggaguggugcaagcgcaaucuugggcugacaugugacgauaacuucuuucagaaaagaaucgaagaguucuuuuugacgggagaaggcuacuucaaugagguucuccaguuuaaggugcccaguacccuguccagcacugagccgacacacaccaggccuccaacagucgaacccuucaaaucuuauuuugcuaaggguuucuuaucaaugaacaguggguacuuuagcgccaagugcuauccucggacuuccaacucuggacugcaacucauaaaugugaccaaacauucggcgaagaucgccgacacgcccggcccaaaaauuaccaaccuuaagacaaucaauuguauuaaccugcgcgcaagcguguucaaagagcaccgagaagucgagaucaauguuuugcuaccucagguggcuguaaaccuguccaauugccacgcccagauaaagucacaugugugugauuacagucucgcuacugacggcauggucagacugccccacauucaucacgaagggaccuuuaucccaggaacauacaaaauugugaucgauaagaagaacaaacaaaaugacaggugcacucuuguuaccaacugugugaucaagggucgggagguccguaaaggccagucugcccugcgccaguauaagacggagauuagaauagggaaagcaagcuccggaucaaggcgguugcucagcgaagagucugacggcgauugcaucucccgaacacagcuguuacgcaccgaaacuacagagauucacagugacaauuacggugggccgggcgauaagaucaccauauguaacggaagcacuauuguggaccaaagacugggcucugaacuagggugcuauaccaucaauaggguaaaguccuucaaacucugcgagaacucagccacaggaaagaguugugagaucgauagcacgccuguuaaaugccggcaggguuuuugucugaagauuacccaggaaggccgcgggcaugugaaacuuucgagaggauccgagaucgucuuggacgcuugcgauucuaauugugaaauuaugauacccaagggcacuggugacauccugguggauugcagcgggggccagcaacacuuccucaaggacaaccugauugaucuuggauguccaaacaucccccuguugggcaaaauggcgaucuacauuugcaggaugucaaaucauccuaagacaaccauggcauuccucuuuugguucaguuuuggguaugucauaacauguauccugugcaaagugauuuucuacuuacugaucguugccggaacuguggguaagaaauuuaagcaguaucgugagcuacggccacagaccuguacgauuugcgagacaauccccguaaacgcuauagacgccgaaaugcacgaccucaauugcuccuacaacaucuguccuuacugcgcaucucgacugaccagcgauggccuugccagacaugucaugcaguguccgaagaggaaagagaagguggaagagacugaauuguaucugaaucucgagcgcauuccauggguugugcggaaacuguuacaagucuccgagucaaccgggguggcucugaagagaagcaguuggcuuacaguauugcucgugcugcuaaucguuucucugucccccguccagagcgccccuauuggacacggcaaaacuaucgaaaccuaccaggcaagggaggguuauacaucguucugccucuuuauacuggggucaauucuuuucguggugucuuguuuggucaagggccugaucgacaguguuggaaacuccuuuuucccaggcuuaagcauuugcaaaacguguucuaucgggagcauaaauggauuugaaaucgagucccacaagugcuacuguucacucuucugcugucccuauugccgccauugcccugcggaucgagaaauucacaagcugcaucuuaguaucuguaaaaagcggaaaaccggcagcaacgugaugcuggcugugugcaagcguauguguuuuagagccacuauugagguaucuaauagggcauugcucauccgcaacauaauuaauacaaccuucgucgugugcauccugacucuagccguuuguguggucuccacaucagcuguggagauggaaagucugccggccgguaccugggagaaagaagaggaccucacgaacuucugccaccaggaaugucaaguuacugagaccgagugccugugucccuacgaagcacuuguguugcggaagccacuguuuuuagauagcaucguaaaggggaggaaaaaucuccugaacuccacaucucuugagaccucgcugagcauugaagcuccuuggggagccaucaauguccagucaacuuucaagcccacaguguccgcggccaacauugcucuaaguuggucuagcguggagcacagaggcaacaaaauacucgucuccggucgaucagagucuaucaugaagcuggaggaacgcaccggcauuagcugggacuuggggguugaagaugcaagugaguccaaacuguuaacagugagcguaauggaccucucucagauguauucaccaguguuugaauaccuguccggagaucggcaagucgaggaguggccuaaggccacuugcaccggcgacugucccgaaagaugcgggugcacgaguagcacaugucuucauaaggaguggccacacucgaggaauuggcguugcaacccgaccugguguuggggagugggcacugguugcaccuguugcgggcuggauguuaaagacuuguucacagauuacauguuugugaaguggaaagucgaauauaucaagacugaggcuauuguguguguugaacucaccucucaggagcgccagugcucccugaucgaggccggaacgcgguucaaucuaggcccugugacaauaacccugagcgaacccagaaacauccagcaaaaacuuccacccgagauuaucacucuccauccuaggauugaagagggcuuuuucgaccugaugcacguccagcgaguauugucagcaaguacaguguguaagcugcagucuugcacccaugguguuccaggggacuuacagguguaccacaucggaaaucuccugaagggcgauaaagucaacgggcaccuuauacauaagauugaaccccacuuuaauacuuccuggaugagcugggacggaugugaucuggacuauuacugcaacaugggcgauuggccuucaugcacauauaccggugugacgcaacauaaucacgcggccuucguaaacuugcucaauaucgagacugacuacaccaaaaacuuucauuuccacaguaagcgggugacagcucacggggauaccccgcagcuggaccuaaaagcccgcccaacauauggagcaggcgaggucacuguucugguggaaguggcugauauggagcuucauaccaagaaaaucgaaauuagcggucucaaguuugccucccugacguguacaggcugcuacgcauguucuagcgggauauccugcaaggucaaaauccacguggacgagcccgaugaguugacuguucauguaaagucagaagacccugauauuguggccgcuggaucuaguuuaauggcgagaaaacuggaguucggcgccgacucgaccuucaaggcauuuagcgcuaugcccaaaacaucccucuguuucuacaucgucgaaagggaguauugcaagucuuguucacgggaagacacccgaaagugcgugaauacuaaacuggauagaccacagagcauucuuaucgagcacaaggggaccauaaucggaaaacagaacaauacauguacggccaaggccuccugcuggcuggagaguguuaaauccuuuuucuacggcuugaagaacaugcuaagcgguauuuuugggaacguguucaucggaauuuuucuguucaucgcuccuuuuguccuccugauacuuuucuuuauguucggcuggcgcauuuuauucuguuuuaagugcugcaggcguacucggggccuguucaaauauagacaccucaaggacgaugaagagaccggguacaggaaaaucaucgaacgcuugaauaacaagaaaggaaagaauaagcugcucgacggugagcgacuggcagauagaaaaauugccgaacuguuuucaacaaagucccauaucggcuga

SEQ ID NO: 10382 - RNA, 5055 nt, Artificial Sequence
  derived and/or modified CDS sequence (opt3) from CCHFV(8402)__AB069674.1__GP
auguacacuccccugcucugcgccgugcuuugucugcaguuguggagcuuagagggcucccacgggcugucuaacaagacacaacauucaaauaccaguacgaccaaagcuccugaagucagccaggagcuaggacucccaguuuccacagugucuacuaucaccucggacccgcccucaauuacaagcgcaguaaguguguccgguucugaaggcagcggggauaccaacacuuccccuucagucacaacccagggaccaacgcugcccgagacuacccuugaaccucugacaacuaccgacacagaugccaguagcaccgugguuguggacgucucuacgcagacugugaaggauacaccaauauccaccacuuauacaucauugcccagcaccccuagugagccaacgaccccgcaaggcacacaccauacugcgagaggucuccugucuguaaccuccacaaaacccgaggaagcuagcacucaggccaauccugggaagaucucgauggagaccaacggaccaaggcuggcaauuucugaaacacccuccuucucaccuaccacucaggccccaacggagaauaguaaccccaucacaagcaaacagcucauguuauccgcucaaccgguuaccccuaaucccaugacuucuccagugcagccugcacugagccagucagacaccaguacagccauucaggauguccaccccuccccaaccggccggagcaagcgcaaccuugagauggaaaucauauugacucugucucaaggccuaaagaaauacuaugggaagauccucaaacugcuugaccugacauuggaggaagauacggagggacuccuggaauggugcaagcgaaauuuaggucuggugugugacgauaacuuuuuccagaaacguauugaggaguuuuuccucaccggcaaggggcauuuuaaugaagugcuucaguucaagacucccucaacacugaguccuaccggaccagcuagaacaggcagcccgacugucgagcccuuuaaauccuacuucgccaagggguuuuugucuauggacucggguuauuucagcgcgaaaugcuacccuagggcauccaacucaggacuacaacugaucaauguuacccagcacaguacgcggauuaccgauacaccaggccccaagaucacuaaccucaaaaccauaaauuguauuaaccugaaggccucuguguuuaaagaacaccgcgagaucgaaauuaacguacuucugccucagguggcugucaauuugagcuccugccaugugcucaucaagucacacguuugugacuauagccuggacaucgauggcccagugagauuacccaggauucaucacgaggggacauucauaccgggaacuuacaagaucgucauugacaaaaagaacaaacagaaugaucggugcacccuggugacgaacuguguaaucaagggucgcgagauacgaaaaggccaaucuguucuaagacaguacaggacagaaauuaagaucgggaaggccuccaguggaagccggcgucuccugucugaggaauccggcgacgauugcaucucacgcacccagcuuuugagaacugagacagcagaaauucacaaugacaacuauggugggccuggcgauaaaaucaccauuuguaauggaaguacuguggucgaccagaggcugggcagcgagcucgggugcuacaccauaaaccgggugaagucguuuaaacugugcgaaaauuccgcuacaggaaagucuugugaaaucgauagcacgccagucaaaugccgacaagguuucugucuuaagauuacccaggagggccgcgggcaugugaagcugucaagaggaagugaaguuguguuggacgccugcgauuccucuugugagaucaugauccccaaaggcacuggugacauucucguagacugcagcgggggccagcagcacuuccugaaggauaacuuaauagaccugggauguccuaauaucccccuacucggcaaaauggcgauuuauaucugcaggauguccaaccauccaaagacaaccauggccuuucuguucugguuuucauucggguacgucgugacauguauucuuugcaaaguuaucuuuuauuugcugauaguggucggaacucucgguaagaaguucaaacaauaccgggagcugaagccucagaccuguacgaucugcgaaacaacccccgugaaugcaauugaugcugagaugcacgacuuaaacugcagcuauaauaucuguccauacugcgccagucgccugacuucugauggccuugcuagacauguaaugcaguguccgaaaaggaaggagaaaauugaggaaaccgaguuguaccucaaccuggagcguaucccuugggugguucggaagcuacugcaggucuccgaaagcacagggguggcccucaaacgaucgucauggcuggugguccuuuugguucuguuaacugugucucucagucccgugcaauccgcaccaauaggacacggcaagaccguagagacauaucagacgagagaagguuacaccagcauuugccuguuuguccuugggucuauccuguucauugugagcuguuugaugaagggccucguugacuccgugggaaacucauuuuuccccggccugaguaucugcaaaacuuguagcauagggucugucaauggauuugagaucgaaucccacaagugcuauuguucacuauucugcuguccuuacugcaggcauugcagugccgaucgcgagauucaccggcugcaucucagcaucuguaaaaagagaaaaacaggcuccaacgugaugcuggcuguuugcaagaggauguguuuucgcgcgaccguggagguaucuaauaaggcacuuuugauucgaaacaucauaaauacuacauucguccugugcauuuuaauccucgccguguguguggucucgaccagcgcuguugaaauggagucacugccagccgguacgugggaacgggaggaagaccuuacuaacuucugccaccaggagugucaagugaccgagacagaaugccugugucccuaugaggcccuaguacuccguaaaccucuguuuuccgauaguaucgugaaggggaugaaaaauuugcugaacucuaccagcuuagaaacuucccucucaauugaggccccguggggagcuaucaauguccagucuacauucaagccaaccgugagcgccgcaaacauugcgcugaguugguccagcguugagcacagaggcaauaaaauacuugugucugguaggucagaauccaucaugaagcuggaggaacgcacaggcauuaguugggacuugggggucgaggaugcuagcgaaucgaagcuccugacugugucuguuauggaccuaucccagauguacagccccguguuugaguaucugucaggagaucggcaggucgaggaauggccuaaagcaaccugcacgggcgacuguccagagagaugcgggugcacaaguucuaccugucuucauaaggaauggccccacuccaggaacuggcgaugcaauccuacuugguguuggggaguaggcaccgguugcacauguugcgggcucgacgugaaagaucuguucacugacuacauguuuaucaaguggaaaguugaguacauuaagaccgaagcaaucgugugugucgaguugacgagccaagagcgccagugcacacugauagaagccggaacccgguucaacuuaggcccggugacuaucacacucucagagcccagaaauauucagcagaagcugccaccugaaaucguaacccuucaucccaggauugaggaaggcuuuuucgaucugaugcacgugcaaaaagucuugagugcuagcacuguuuguaagcuccaguccugcacacauggugugccaggggaccuacagguguaucacaucggaaaccugcugaaaggcgauaaggucaacgggcaccuuauacauaaaauugagccucacuuuaauaccucuuggaugagcugggacggaugugaucucgacuacuauugcaacaugggcgauuggcccuccugcacguacacuggugugacccagcauaaucacgccgcauucguuaacaugcugaauaucgagacagacuauaccaagaacuuucauuuccacucaaaacguguaacagcucacggggauacuccacaauuggacuuaaaggcccgcccgaccuacggagcgggcgaaaucacggugcuggucgagguggccgauauggaacuccauacaaagaaaauugagauaucuggucugaaguuugcuagucuuacuuguaccggcugcuaugcauguucgagcgggaucuccugcaaaguucggauucacguggacgagccugacgaacugacaguccaugugaagucugaggaucccgacaucguagccgcuucaagcuccuugauggccagaaaacuagaguucggaaccgauaguacuuucaaggcauuuucugcgaugccaaagaccagccuguguuucuacauugucgaaagggaauacugcaaaucauguuccaaggaggacacacagaaaugcgugaauacgaagcucgagcagccccaaaguauccugauagaacacaaaggcacuaucauugggaagcagagcaacaccuguacagccaaggcuucuugcuggcuugaguccguuaaaucauuuuucuauggauuaaagaauaugcugagcggcaucuuugguaacguguucauuggggucuuucucuucuuugccccuuucaucuugcugauacucuuuuucauguucggauggcggauucuguuuuguuucaaaugcugccgacgcaccagaggccuuuuuaaguacaggcaccugaaagaugacgaagagacuggcuaucggaagaucaucgaacgauugaauaacaagaaagggaagaauaaacuacuggauggagagagacucgcagaccgcaagauugcugaguuauucucgacaaaaacccauaucgguuga

SEQ ID NO: 10383 - RNA, 5055 nt, Artificial Sequence
  derived and/or modified CDS sequence (opt3) from CCHFV(SPU 383/87)__KJ682806.1__GP
auguacacuccccugcucugcgccauccuuugucugcaguuguggagcuuagagggcauuuaugggcuguccaacagaacacaacacaaugacacuucuacgauaaaggugccugaagagucacagaaaaccagucuaccagcuaacacagcaagcccgaucacuuccgaucccccuucuaccacaucgaccgccucagcgagcggaccagaagguaguggcgacacuuccacaucucccccugucaccacgcaggggccaacucccccugagaccacaccagaaccgcauacuaccauugauaucgacaagagcuccacagcuauugccgauaucucaacccagacgguuaaagacauacccacuccuacaacccacaccagucucccaagcacacugucugcacccaccaucccucaagaggcccaucacacggcuaggggacuucuguccauuaccucaacaaagccaggcgaggcaagcacucccaucaguccgggugaagccucuaccgaggcuuccagcccucagcccacaauuucggaaacuccaucuccucccccaaccgcccaggcgcccacagagaucaauuccccuaacaccucacggcagccaaugccgaguacucaacccgcagccccuaauagcgugacgcauccagcucagcccacaccuucccagucugauguaccaaccgccgcacaggacauacaccccaacccgauuaaucgcagcaaacgaaacuuggagauggaaaucauucucacucugucacaagggcugaagaaguacuauggaaaagugcucaaguuacuggaucuuaccuuggaggaagacacagagggccugcuagaaaguugcaaacguaaucucggccugaccugugaugacaacuucuuucagaagagaaucgaggaguucuuucuuacuggggaaggacacuucaaugagguccugcaguuuaaaacaccuuccacguugagcccaaccgaacccgcuaggguggagucuccuacuguugaacccuucaagucauacuuugccaaggguuuccucaguauggauagcggcuauuuuuccgcgaaaugcuacucuaagucgagcaacuccgggcugcaauuaaucaaugugacacagcaucugauucggauaaccgacacaccaggaccuaaaaucacuaaccucaagaccauuaauuguaucaaccuuaaagcccuggucuucaaggagcaccgcgagauagaaauuaacguguugcuaccccagguagcaguuaaucugucaaacugccaugugcucaucaaaagucacgucugugacuauucucuggauaucgacggcccagugagacuuccgaggauucaccaugaggguacguuuaucccugggaccuacaagauugugauagauaagaauaacaaacagaaugaccggugcacacuggucacuaacuguguuaucaagggacgcgaaauucgaaaaggccaaagcguguugagacaguacaggaccgagaucaagaucggcaaggcuuccucagggagccggcgucuccugucugaagaguccaaugaugacugcuuaagucgcacacagcugcuaagaacugagaacgccgaaauucacagcgauaauuauggaggucccggcgacaagauaaccaucuguaacgggucuacgauuguagaucagaggcucggauccgagcugggcugcuacacaaucaaucgggugaagucauucaaacuuugcgaaaacagugcuaccgguaagagcugugagauugacucgacuccaguccgaugccgccaaggguuuuguuugaaaaucacacaggagggcagaggacaugugaagcuguccaggggcucugaaguugugcucgaugccugcgacagcucaugugagauaaugauccccaaagggaccggagacauucuggucgauugcagugguggccagcagcacuuccuuaaggacaaucugguggauuugggguguccuaacaucccacuccugggaaagauggcaauuuauaucugccggauguccaaucaucccaaaacuaccauggccuucuuauuuugguucucuuuuggcuacguaauaacauguauucugugcaagguuaucuucuaucuacucguggucguggguacgcuggggaaaaaguuuaaacaauaccgcgaacuuaagccucagaccuguacuauuugcgagacaaacccggucaacgcuaucgacgcggaaaugcacgauuugaauugcagcuauaacauauguccauacugcgcauccagacugaccucagacggccucgccaggcacgugauccagugucccaagcguaaagagaagauugaggaaacagagcuguacuuaaaucuggaacggaucccuuggguugugcgaaaacuuuugcagguaagcgagaguacuggagucgcucucaagagaucuuccuggcuggugauucuacugguucuccugaccgugagccuuucgccaguccaaucagcccccaucucucauggcgaaacgguggagguauaucagacaagggagggguacaccaguauaugcuuguucgugcugggauccauuuuauuucucguuagcugucugaugaaaggucuugucgauucugugggcaacagcuucuuuccugggcuguccaucugcaagacuuguucaaucggaaguauuaauggcuucgaaaucgagagccacaaaugcuauuguucuuuguuuugcuguccguacugccgccauugcuccgcagacauugaaauacaccggcuccaccugucaaucuguaagaagagaaaaaccgguaguaacgugaugcuagccgucugcaagaggauguguuuccgcgcuacaguugaggugagcaauaaagcccugcucauucgaaacaucauuaauacuaccuuugugguaugcauccugauacuugcagucugugugguuuccacaucugcgguggaaauggagaacuugcccgcugggacgugggagaaggaagaggaucugaccaauuucugccaucaggaaugucaagucacugagacagagugcuuauguccauaugaagcccucgugcugcggaaaccucuuuuccuggacucgaucguuaagggcaugaagaaccuacucaauagcaccucacuggagacuuccuugaguauugaagcacccuggggagccaucaacgugcagucuacauuuaaaccaaccguaagcgcugccaauauugcacuguccuggucaucugucgagcaccguggcaacaagaucuuagugagcgggagaagugaauccauaaugaaacucgaggagaggacgggaauuagcugggaucugggcguggaagacgcuucugagucaaaacuucugacugucuccguuauggauuugagucagauguacagcccuguguucgaauaucucucgggugaccgccagguagaggaauggcccaaagcgaccugcacaggggacuguccagagcggugcggaugcaccucuuccacuugucugcauaaggaguggccgcacagcagaaacuggaggugcaauccuacaugguguuggggcguggguaccggcugcacauguugcgggcuagaugucaaggaccuguuuacugauuacauguucgugaaauggaagguugacuacaucaaaaccgaagccaucgugugugucgagcuuacgucacaagaacgacagugcagucucauugaggccggaacacgcuuuaaccugggccccgugaccauaacuuugucugaaccacggaauauccagcagaagcugcccccugagauuguuaccuuacauccaagaaucgaggaaggguucuuugaucucaugcacauucaaaaagugcuguccgcuagcacagucuguaaacuucagucaugcacucacggaguacccggcgaccugcagaucuaucauauagguaacuugcucaagggggauaaagugaauggacaccugauccauaagauugagccucacuucaacaccaguuggaugagcugggacggcugugaucuagacuacuauugcaauaugggugauuggccguccugcucuuacacgggcguuacacagcauaaccacgcagccuuugugaauaugcugaacaucgaaaccgacuauacuaaaaauuuccacuuucauagcaagagggucacagcucacggggauaccccacaacuugaccucaaagcccgucccacuuacggagcaggcgagauuacagugcugguagagguggcggacauggaauugcauaccaagaaaaucgagauauccggguuaaaguucgccucacugacguguacuggaugcuaugcuuguucuaguggcauuucgugcaagguccgcauccacguugaugaaccugacgagcucaccgugcacgugaaaagcgaagaucccgacaucgucgccgcauccucuucacugauggcucggaaacuugaguuugguacagauagcaccuucaaggccuucuccgcaaugccaaagacaagucuguguuuuuacauuguggagagagaauacugcaaaucuuguagcaaggaggacacucagaagugcguuaacaccaaauuggaacagccucaaucaauccuaauagagcauaaggggacgauuuucggaaaacagaaugauacauguacugccaaggcuuccugcuggcuggaaaguguaaagagcuuuuucuauggccucaagaacaugcugucugguaucuuuggcaauguguucauuggggucuuucuuuucuuagcgcccuuuaucaugcugauacucuucuuuauguucggauggaggauuuuguucuguuuuaagugcugccgacggacccgcggccuguucaaauacagacaccucaaggacgaugaggagaucggguauaggaaaaucauugaacggcugaacaacaagaaaggaaagaauaaacuucuggacggcgagcgauuggccgauagaaagaucgcagaacuauuuuccacaaagacccauauugguuga

SEQ ID NO: 10384 - RNA, 5055 nt, Artificial Sequence
  derived and/or modified CDS sequence (opt3) from CCHFV(SPU 497/88)__KJ682808.1__GP
auguacacuccccugcucugcgccauccuuugucugcaguuguggagcuuagagggcauuuaugggcuguccaacaagacacaacacaaugacacuucuacgauaaaagugccugaagagucacagaagaccagucuaccagcuaacaucgcaagcccgacaacuuccgaucccccuucugccaccucgacagcgucagcuagcggaccagaagguaguggcgacaccuccacuucucccagcgucacaacccaggggccuacgccacucgagauuacucccgaaccucauaccacaaucgauauugacaaauccucaaccaguaucgccgauauaagcaccagaacaguuaaggacaucccaaccccgacgacucacacaucucugcccuccaccccuucagcaccaacuauuccccaggaggugcaucacacagccaggggacuucugagcguaaccaguacgaaaccugaggaagcuagcaccuugacauccccaggcgaggcaagcacugaagccucgucuccccaaccgaccaucuccgagacaccuucacccccaccuacuacccaggcucccacagagauuaauaacccaaauaccagucggcagcccaugccuagcacucagccagccgcgccgaacuccgugacgcccccuguccaaccaacauucucucagagcgaugugucaaccgcagcccaggacauccaucccaguccuacuaaucgcuccaagcgaaaccucgaaauggagauaauucugacccugagccagggucucaagaaauacuaugggaagguuuuaaaacugcuugauuugacacuggaagaggacaccgaaggacuacucgaguggugcaagcguaaucugggccuuacuugugaugacaacuuuuuccaaaagagaaucgaggaauuuuuccugacaggcgaggggcacuuuaaugaaguguugcaguucaagacgccaucuacccucucacccacugagccggcuagggucgaaaguccuacaguggagccauuuaagagcuacuucgccaaaggauuucuguccauggauucugguuauuucucggcaaagugcuaccccaaaagcuccaacucaggcuuacagcugauuaauguaacccaacaccucauccggaucacagacacuccugggcccaagauuaccaaccuuaaaacgauaaauuguaucaaccugaaggcuuugguuuuuaaagagcaucgcgaaauugagaucaacgugcuacugccacaggucgccgugaaucucaguaacugccacgugcugauaaagucucaugucugugacuauagccuugauauugacggaccuguuagacugcccaggauccaccacgaaggcaccuucaucccagguacauacaagauugugaucgauaaaaagacuaaacagaaugaccggugcaccuugguaacaaacugugugauuaaggggcgcgagauacgaaaaggacaguccguccucagacaauacaggacugaaaucaagauuggcaaggcgucaagcggcucucggcgucuguuauccgaggagaguaaugaugacugccugagccgcacccagcuacucagaacggaaaacgccgagauccauucugauaauuaugggggaccgggugacaaaaucacaauuuguaacggcuccaccauaguggaucagaggcuggggucagaacuuggaugcuacacuaucaaucggguuaagaguuuuaaauugugcgagaacagcgcaacaggcaagucgugugagauugacuccaccccugugcgaugccgccaggguuucugucugaaaaucacucaagaagggaagggccacgucaagcucucuagaggaagcgaggugguacuggaugcuugcgacucaaguugugaaauuaugauccccaaaggcaccggggacauacuuguugauugcuccggaggucagcagcauuuccugaaggacaauuugguggaucucggcuguccaaacaucccccuguuagggaaaauggccauuuauaucugcaggaugucuaaucacccuaagacaacgauggucuuucuguucugguuuagcuucggauacgugauuaccuguauccuaugcaaagucauauuuuaucuccugauugugguuggcacucuugguaagaaguucaaacaguaccgggaguugaagccacaaacauguaccaucugcgaaacaaaccccgugaaugcuauugacgccgagaugcaugaucugaacugcuccuauaacaucuguccuuacugcgcaucacgccucacuagcgacgggcuggccagacacguaaugcaguguccgaaaaggaaggagaaaauagaagagaccgaauuauaccugaaucuugagcguaucccaugggucgugcggaaguugcuccagguuagugaaucuacgggcguggcucugaaacgauccagcuggcuagucauucugcucgugcugcuuacaguaucguugucacccgugcagucugcgccuaucagucacggagagaccguugaggucuaucaaacuagagaaggcuacaccuccauuugccuguuuguguuagggggaauccucuuccuggugagcugucuuaugaagggucuggucgauucuguuggcaacagcuuuuucccaggguuguccauaugcaagacauguucaauuggaaguaucaauggcuuugagaucgaaagccauaaaugcuauuguucucucuucugcugucccuacugcaggcacugcuccgcagacauugagauccauaagcugcaccuaucaauuuguaaaaagcgcaaaacuuggaguaacgugaugcuggccgugugcaagcggauguguuuuagagcuaccguagaagucagcaauaaggcccuccugauaaggaacaucauuaauacaacguucgugguuugcauccuuauuuuggcaaucuguguggucuccaccucugccguggagauggagaaccugccugcugguacuugggaaaaagaggaagauuuaacaaauuucugccaccaggagugucagguuaccgagacugaaugccucuguccguaugaggcccuggugcuucgcaagccccuguuucuagacucgauaguaaaagggaugcgaaaccuccugaauagcacaucauuggaaaccucccugaguaucgaggcaccauggggcgcgauuaacguccaaucuacguucaagccuacugugagcgcugccaauaucgcauuauccuggucaucuguggaacaucggggaaacaaaauucucgucagcggccguagugaguccaucaugaagcuggaggaaagaaccgggauaagcugggaucuuggaguugaggacgccucugaaucaaagcuguugacaguguccguaauggaucucagucagauguacagccccguguuugaguaucugucgggcgacaggcaggucgaagaguggccaaaagcuaccugcacuggugacuguccugagcgcugcgggugcacaucuuccaccugucuacacaaggaauggccccauagccggaauuggagaugcaacccaacaugguguuggggagugggcacugguugcaccuguugcggccuggauguuaaagaccuuuucacggauuacauguuugugaaguggaaagucgacuacauuaagacagaggccaucguguguguugaacucaccucacaggagaggcaaugcagucugaucgaagcagggacucgauucaacuugggaccggugaccauuacacugucugagccucgcaauauacagcagaaguuacccccagagaucgucacucuccacccccggauugaagagggcuuuuucgaucugaugcauauccagaaaguacuuuccgcuagcaccguguguaagcugcaaucaugcacgcacgggguuccuggagacuugcagauuuaucacaucggcaaccuccugaaaggugauaaggugaaugggcaucuaauacacaaaaucgaaccacauuuuaacacaaguuggaugagcugggacggaugugaucuggacuacuauugcaauaugggcgauuggcccuccugcucuuacaccggugucacucagcacaaccaugccgcguucgugaauaugcuuaacauugagacagacuauaccaagaauuuucacuuccacagcaaaagaguaacugcccauggcgauacaccucagcucgaccugaaggcuaggccgaccuacggggcaggagagaucacgguguuggucgaaguugccgacauggaguuacacacuaagaaaauugaaaucuccggccugaaguuugcuucacucaccuguacagggugcuaugccuguucuaguggaauaucgugcaaagugcguauucauguggaugagccagacgaacugaccguccacgugaagucugaggaucccgacaucguugcagcguccucuucacuuauggcccgcaaacuggaguucggcacagauagcacuuucaaggcuuuuuccgccaugccuaagaccaguuuguguuucuacaucguagaacgggaguacugcaaaucuuguagcaaggaagacacgcaaaaaugcgugaacacaaagcuagagcagccccagucaauucugaucgaacacaaagguacuauaauugggaagcaaaaugauaccuguacagcaagagcuuccugcuggcucgagaguaucaagagcuuuuucuauggacugaaaaacaugcuuucuggcauuuuugguaaugucuucaucggcauauuuuuauucuuugccccauucauuaugcugauccucuuuuucauguucggguggaggaucuuguuuuguuucaagugcugccgacggacccgcggacuguuuaaauacagacaucucaaggacgaugaggaagugggcuauaggaaaauuaucgagcggcugaacaauaagaaggggaaaaacaaacuucuggacggagaacgauuggcagauagaaaaauugccgagcuauucuccacuaagacccacauaggcuga

SEQ ID NO: 10385 - RNA, 5055 nt, Artificial Sequence
  derived and/or modified CDS sequence (opt3) from CCHFV(88166)__AB069675.1__GP
auguacacuccccugcucugcgccgugcuuugucugcaguuguggagcuuagagggcucccacgggcugucuaacaagacacaacauucaaauaccaguacgaccaaagcuccugaagucagccaggagcuaggacucccaguuuccacagugucuacuaucaccucggacccgcccucaauuacaagcgcaguaaguguguccgguucugaaggcagcggggauaccaacacuuccccuucagucacaacccagggaccaacgcugcccgagacuacccuugaaccucugacaacuaccgacacagaugccaguagcaccgugguuguggacgucucuacgcagacugugaaggauacaccaauauccaccacuuauacaucauugcccagcaccccuagugagccaacgaccccgcaaggcacacaccauacugcgagaggucuccugucuguaaccuccacaaaacccgaggaagcuagcacucaggccaauccugggaagaucucgauggagaccaacucuccaaggcuggcaauuuccgaaacacccucauucaguccuaccacucaggccccaacggagaauagcaaccccaucacauccaaacagcucauguuaucugcucaaccgguuaccccuaaucccaugacuagcccagugcagccugcacugucacagagugacaccuccacagccauucaggauauccaccccagcccaaccggacggucuaagcgcaaccuugagauggaaauaaucuugacucugucacaaggccuaaagaaauacuauggcaagauucucaaacugcuugaccugacauuggaggaagauacggaggggcuccuggaauggugcaagcgaaauuuaggacuggucugugacgauaacuuuuuccagaaacguaucgaggaguuuuuccucaccgguaagggccauuuuaaugaagugcuucaguucaagacucccaguacacugagcccuaccgggccagcuagaacaggauccccgacuguggagcccuuuaaaucuuacuucgccaagggcuuuuugucgauggacagcgguuauuucuccgcgaaaugcuacccuagggcaucaaacagugggcuacaacugauuaaugucacccagcacucuacgcggaucaccgauacaccaggacccaagauaacuaaccucaaaaccauuaauuguaucaaccugaaggccagcguuuuuaaagaacaccgcgagauugaaaucaacgugcuucugccucagguagcugugaauuuguccucaugccauguccucaucaagagccacgugugugacuauucucuggacauugauggcccaguuagauuacccaggauacaucacgagggcacauucaucccggggacuuacaagauugugaucgacaaaaagaacaaacagaaugaucggugcacccuggucacgaacugugugauaaagggacgcgagauucgaaaaggucaauccguacuaagacaguacaggacagaaaucaagaucggcaaggccaguagcgggucucggcgucuccuguccgaggaaucaggagacgauugcauuagucgcacccagcuuuugagaacugagacagcagaaauccacagcgacaauuauggcgguccuggggauaaaauuaccauauguaacggcucgacuguuguggaccagaggcugggauccgagcucggcugcuacaccaucaaucgggucaagucuuuuaaacugugcgagaacagcgcuacagggaagucaugugaaauugauaguacgccagugaaaugccgacaaggauucugucuuaagaucacccaggagggucgcggccaugucaagcuguccagagggucugaagugguuuuggacgccugcgauagcuccugugagaucaugauucccaaaggaacuggcgacauacucguggacugcucaggugggcagcagcacuuccugaaggauaauuuaaucgaccugggcuguccuaacauuccccuacucggaaaaauggcgaucuauauuugcaggaugagcaaucauccaaagacaaccaugggcuuucuguucugguuuaguuucggguacguagucacauguauccuuugcaaagugauauuuuauuugcugaucguugugggaacucucgguaagaaguucaaacaauaccgggagcugaagccucagaccuguacgauuugcgaaacaacccccgucaacgccaucgaugcagagaugcacgacuuaaauugcucuuauaacauuuguccauacugcgcuucccgccugacuagcgauggccuugccagacaugugaugcaguguccgaaaaggaaggagaaaaucgaagaaaccgaguuguaccucaaucuggagcguauaccuuggguagugcggaagcuacugcagguuucggaaucaacaggggucgcucucaaacgaucuaguuggcugguggugcuuuugguccuguuaacuguuucccucagccccgugcaaucugccccaauuggacacggcaagaccguggagacauaucagacgagagaagguuacaccagcaucugccuguuuguacuuggguccauucuguucaucgucucauguuugaugaagggccucguggacaguguuggaaacagcuuuuuccccggccugucuauaugcaaaacuuguuccaucgggucagugaacggauuugagauugaaagucacaagugcuauuguagccuauucugcuguccuuacugcaggcauugcuccgcagaucgcgagauccaccggcugcaucucucuauuuguaaaaagagaaaaacauggucgaaugucaugcuggccgugugcaagaggauguguuuucgcgcuaccguugaggugagcaacaaggcgcuuuugauccgaaauauaauuaacacuacauucguacugugcaucuuaauccucgcagucuguguggugucaaccuccgccgucgaaauggagagucugccagcuggcacgugggaacgggaggaagaccuuacuaauuucugccaccaggagugucaaguuaccgagacagaaugccugugucccuaugaggcccuagugcuccguaaaccucuguuuucugauagcauuguaaaggguaugaaaaacuugcugaauagcaccucauuagaaacuucucucagcaucgaggcaccguggggagccauuaacgugcagaguacauucaagccaaccauguccgcugccaauauagcacugagcuggucuucagucgagcacagagggaacaaaauccuuguguccggcaggagugaaagcauuaugaagcuggaggaacgcacagguaucucguggaauuugggcguugaggacgcgucugaauccaagcuccugacugugagcgucauggaucuaucacagauguacagucccguguuugaguaucugucuggggaccggcagguugaggaauggccuaaagcuaccugcacgggagauuguccagagagaugcggcugcacauccagcaccugucuucauaaggaauggccccacucaaggaacuggcgaugcaauccuacuugguguuggggaguggggaccggcugcacauguugcggucucgacgucaaagaccuguucacugauuacauguuuauuaaguggaaaguagaguacaucaagaccgaagccauaguguguguugaguugacgagucaagagcgccagugcacacugaucgaagcagggacccgguucaacuuaggaccggugacuauuacacucagcgagcccagaaauauccagcagaagcugccaccugaaauugucacccuucaucccaggaucgaggaaggcuuuuucgaccugaugcacgugcaaaaaguauuguccgccucuacuguguguaagcuccagagcugcacacauggugucccaggcgaucugcagguuuaucacauagggaaccuacugaaaggagacaaggugaacggccaccuuauucauaaaaucgagccucacuuuaauaccuccuggaugucaugggaugggugugaccucgauuacuauugcaacaugggagacuggcccucuugcacguacacuggcgugacccagcauaaucacgcugccuucgucaacaugcugaauaucgagacagauuauaccaagaacuuucauuuccacaguaaacgugugacagcacacggugacacuccacaauuggauuuaaaggcucgcccgaccuacggggccggagaaauuacgguucugguagagguggcggacauggaacuccauacaaagaaaauagagaucucgggccugaaguuugccagccuuacuuguaccgguugcuaugcuuguuccucuggcauuucaugcaaaguccggauccacguggaugagccugacgaacugacaguucauguuaagagcgaggaccccgauuuggucgcagccuccaguucucuaauggcuagaaaacuggaguucgggaccgacagcacuuucaaggccuuuucagcaaugccaaagaccucccucuguuucuacauuguggaaagggaauacugcaaaaguuguagcaaggaggauacacagaaaugcguaaauacgaagcuggagcagccccaaucuauccuuauagaacacaaaggaacuaucauuggcaagcagaacaauaccuguacagcgaaggccuccugcugguuagagucagucaaauccuuuuucuaugggcugaagaacaugcucucgggaaucuuuggcaauguguucauugguguguuucuuuucuuugcuccuuucauccugcucauacuguuuuucauguucggguggcgaauuuuguuuuguuucaaaugcugccggcgcaccagaggacuguuuaaguacaggcacuugaaagacgaugaagagacuggcuaucggaagaucaucgaacgacuaaacaauaagaaaggcaagaacaaacugcucgacggggagagauuagccgaucgcaagauugcagagcuguucucuacaaaaacccauaucggauga

SEQ ID NO: 10386 - RNA, 5055 nt, Artificial Sequence
  derived and/or modified CDS sequence (opt3) from CCHFV(strain BA88166)__AF338470.1__GP
auguacacuccccugcucugcgccgugcuuugucugcaguuguggagcuuagagggcucccacgggcugucuaacaagacacaacauucaaauaccaguacgaccaaagcuccugaagucagccaggagcuaggacucccaguuuccacagugucuacuaucaccucggacccgcccucaauuacaagcgcaguaaguguguccgguucugaaggcagcggggauaccaacacuuccccuucagucacaacccagggaccaacgcugcccgagacuacccuugaaccucugacaacuaccgacacagaugccaguagcaccgugguuguggacgucucuacgcagacugugaaggauacaccaauauccaccacuuauacaucauugcccagcaccccuagugagccaacgaccccgcaaggcacacaccauacugcgagaggucuccugucuguaaccuccacaaaacccgaggaagcuagcacucaggccaauccugggaagaucucgauggagaccaacucuccaaggcuggcaauuuccgaaacacccucauucaguccuaccacucaggccccaacggagaauagcaaccccaucacauccaaacagcucauguuaucugcucaaccgguuaccccuaaucccaugacuagcccagugcagccugcacugucacagagugacaccuccacagccauucaggauauccaccccagcccaaccggacggucuaagcgcaaccuugagauggaaauaaucuugacucugucacaaggccuaaagaaauacuauggcaagauucucaaacugcuugaccugacauuggaggaagauacggaggggcuccuggaauggugcaagcgaaauuuaggacuggucugugacgauaacuuuuuccagaaacguaucgaggaguuuuuccucaccgguaagggccauuuuaaugaagugcuucaguucaagacucccaguacacugagcccuaccgggccagcuagaacaggauccccgacuguggagcccuuuaaaucuuacuucgccaagggcuuuuugucgauggacagcgguuauuucuccgcgaaaugcuacccuagggcaucaaacagugggcuacaacugauuaaugucacccagcacucuacgcggaucaccgauacaccaggacccaagauaacuaaccucaaaaccauuaauuguaucaaccugaaggccagcguuuuuaaagaacaccgcgagauugaaaucaacgugcuucugccucagguagcugugaauuuguccucaugccauguccucaucaagagccacgugugugacuauucucuggacauugauggcccaguuagauuacccaggauacaucacgagggcacauucaucccggggacuuacaagauugugaucgacaaaaagaacaaacagaaugaucggugcacccuggucacgaacugugugauaaagggacgcgagauucgaaaaggucaauccguacuaagacaguacaggacagaaaucaagaucggcaaggccaguagcgggucucggcgucuccuguccgaggaaucaggagacgauugcauuagucgcacccagcuuuugagaacugagacagcagaaauccacagcgacaauuauggcgguccuggggauaaaauuaccauauguaacggcucgacuguuguggaccagaggcugggauccgagcucggcugcuacaccaucaaucgggucaagucuuuuaaacugugcgagaacagcgcuacagggaagucaugugaaauugauaguacgccagugaaaugccgacaaggauucugucuuaagaucacccaggagggucgcggccaugucaagcuguccagagggucugaagugguuuuggacgccugcgauagcuccugugagaucaugauucccaaaggaacuggcgacauacucguggacugcucaggugggcagcagcacuuccugaaggauaauuuaaucgaccugggcuguccuaacauuccccuacucggaaaaauggcgaucuauauuugcaggaugagcaaucauccaaagacaaccaugggcuuucuguucugguuuaguuucggguacguagucacauguauccuuugcaaaggaauauuuuauuugcugaucgugguugguacucucggcaagaaguucaaacaauaccgggagcugaagccucagaccuguacgauuugcgaaacaacccccgugaacgccaucgaugcagagaugcacgacuuaaauugcucuuauaacauuuguccauacugcgcuucccgccugacuagcgaugggcuugccagacaugucaugcaguguccgaaaaggaaggaaaagaucgaggaaaccgaguuguaccucaaucuggagcguauaccuugggugguacggaagcuacuccaggugucggaaucaacaggaguugcucugaaacgaucuaguuggcuggucgugcuuuuggugcuguuaacugucucccucagccccguucaaucugccccaauuggccacgguaagaccguggagacauaucagacgagagaaggguacaccagcaucugccuguuugugcuuggcuccauucuguucaucguaucauguuugaugaagggacucgucgacagugugggcaacagcuuuuuccccgggcugucuauaugcaaaacuuguuccaucggaucaguuaacggcuuugagauugaaagucacaagugcuauuguagccuauucugcuguccuuacugcaggcauugcuccgcagaucgcgagauccaccggcugcaucucucuauuuguaaaaagagaaaaacauggucgaaugugaugcuggccgucugcaagaggauguguuuucgcgcuaccguggagguuagcaacaaggcgcuuuugauccgaaauauaauuaacacuacauucgugcugugcaucuuaauccucgcaguaugugucgugucaaccuccgccguggaaauggagagucugccagcugguacgugggaacgggaggaagaccuuacuaauuucugccaccaggagugucaagucaccgagacagaaugccugugucccuaugaggcccuaguucuccguaaaccucuguacuuggauucuauugugaaggggaugaaaaaccuguuaaauagcaccucccucgaaacuucacugucuaucgaggcaccguggggagccauuaacguacagagcacauuuaagccaaccaugagugcugccaauauagcacuuuccuggagcucuguggagcacagaggcaacaaaauccuggucucagguagguccgaaaguauuaugaaguuggaggaacgcacaggcaucagcuggaaucucgggguggaggacgcgucggaaucuaagcugcuaacuguuuccgugauggaucugagccagauguauucacccgucuucgaguaccuuaguggagacagacagguggaggaauggccuaaagcuaccugcacgggcgauuguccagagcggugcgggugcacaucuuccaccugucuccauaaggaauggccccacagcaggaacuggcgaugcaauccuacuugguguuggggaguuggcaccgguugcacauguugcgggcuggacgugaaagacuuguuuacugauuacauguucauuaaguggaaagucgaguauaucaagaccgaagccauaguauguguggagcugacgucacaagagcgccagugcacauuaaucgaagcaggaacccgguuuaaccucggcccgguuauuaucacucugagugagcccagaaauauucagcagaaacuuccaccugaaaucgugacacugcaucccaggauagaggaagguuucuuugacuugaugcacguccaaaaagugcucagcgccuccaccguauguaagcugcagucuugcacucauggcgugccaggggaucuacaggucuaccacauuggaaaccugcuuaaaggcgacaagguuaacgggcaccucauccauaaaaucgagccucacuucaauacaagcuggauguccugggauggaugugaccuggauuauuacugcaacaugggcgacuggcccucaugcaccuauacgggugugacucagcauaaucacgcugccuuugugaacauguugaauauugagaccgauuacacaaagaacuuccauuuucacucuaaacgugucaccgcacacggggacacaccacaauuagaucugaaggcucgcccgacuuauggagccggcgaaauaaccgugcucguugagguagcggacauggaacugcauacgaagaaaaucgagauuaguggucuuaaguucgccucgcugacauguacuggcugcuacgcuuguagcuccgggaucucuugcaaagugcggauucacgucgaugagccugacgaauugaccgugcauguuaagucagaggaccccgauaucguggcagccagcuccagucuaauggcuagaaaacuggaauuuggaacagacucuaccuucaaggccuucagcgcaaugccaaagacuucacucuguuuuuacauagucgagagggaauauugcaaauccuguaguaaggaggauacccagaaaugcgugaauacaaagcuggagcagccccaaagcauccuuauugaacacaaaggcacgaucauugggaagcagaacaauacuuguaccgcgaaggccucuugcugguuagaguccguaaaaucauucuuuuacggacugaagaacaugcucagcggcaucuucgguaaugucuuuauagggguguucuuguuuuucgcuccuuuuauucugcucauccuguucuuuauguucggauggcgaauccuuuucuguuuuaaaugcugccggcgcacaagaggccuguucaaguauaggcacuugaaagacgaugaagagaccggcuaccggaagauuaucgaacgacuaaacaauaagaaagggaagaacaaacugcucgacggagagagauuagccgaucgcaagauagcagagcuguuuucgacuaaaacacauauugguuga

SEQ ID NO: 10387 - RNA, 5055 nt, Artificial Sequence
  derived and/or modified CDS sequence (opt3) from CCHFV(SPU 130/89)__KJ682807.1__GP
auguacacuccccugcucugcgccauccuuugucugcaguuguggagcuuagagggcauuuaugggcuguccaacaagacacaacacaaugacaacucuacuacgaaagcuccugaagagucacauaagaccagucuaccagcaaauacagccagcccgauaacuuccgaucccccuucuaccacaucgaccacuucagcgagcggaccagaagguaguggcgacacauccaccucucccccugugacgacucaggggccagcuagccccgagaccacaccugaaccacacacuaccaucgauauugacaaauccucaacagccaucgcagauauuaguacccagacggucaaggacaucccgacucccacaacccauacuagccucccuucuacacuguccgccccaaccauaccccaggaggcucaccauacggcaagaggacuucugucaguuaccaggcacaaaccuggcgaggccagcaagccaacaagucccggugaggcuucuacugaagccuccagcucgcaaccgaccaucucugaaacaccuucucccccaccuacuacccaggcgcccacagagauuaacaauccaaacaccucacggcagcccaugccuaguacucagccagcagccccgagcuccgugacgcaccccgcucaaccuacaccaucucagagcgauguacccaccgccgcacaggacauccauccuucaccaacuaaucgcaguaagcgaaacuuggagauggaaauuauccucacccugucccaggggcugaaaaaguacuauggaaaagugcucaaguuacuggaucuuacauuggaggaagacaccgagggccugcuagaauggugcaaacguaaucucggccugacuugugaugacaacuucuuucaaaagagaauagaggaguucuuucuuacaggggaaggacacuucaaugagguccugcaguuuaagacgcccagcaccuugucuccgacugaaccugcuaggguggagucaccaacaguugaacccuucaaaaguuacuuugccaaggguuuccucagcauggauuccggcuauuuuucugcgaaaugcuacccuaagucgagcaacuccgggcugcaguuaauuaaugugacccaacaucugauccggauuacagacacucccggaccaaaaaucaccaaccucaagacgaucaauuguauuaaccuuaaagcccuggucuucaaggagcaccgcgagauagaaaucaacguguugcuaccucagguagcaguuaaucugucaaacugccacgugcucauuaagagucaugucugugacuauucucuggauaucgacggccccgugagacuuccaagcauacaccaugaggguaccuuuauuccggggacauacaaaaucgugaucgauaagaaaaauaagcagaacgacaggugcacucuggucaccaauuguguuauuaaaggacgggaaauccgcaagggccaguccguguugcgacaauacagaacagagauuaagauaggcaaggcuucaagcgggucuaggcggcuccuguccgaggaaccuaacuaugauugcuuaagucguacucagcugcuacgcaccgagaaugccgaaauccacagcgacaacuacggaggucccggcgauaagauuacgaucuguaaugggucuacaaucguagaccagagacucggauccgagcugggcugcuauaccauuaacagggugaaaucauucaaacuuugcgaaaauagugcuacugguaaaagcugugagauagauucgacaccaguccggugccgacagggguuuuguuugaagaucacccaagagggccgcggacaugugaagcuguccagaggcucugaaguugugcucgacgccugcgauagcucaugugagauuaugauccccaaagggacuggagacauucuggucgacugcagugguggccagcagcacuuccuuaaggauaaccugguggacuugggguguccuaauaucccacuccugggaaaaauggcaauauacaucugcaggauguccaaccaccccaagaccacaauggccuucuuauuuugguucucuuuuggcuauguaauuacguguauccugugcaaaguuauuuucuaccuacucaucguggucgguacccuggggaagaaguuuaaacaguaucgggaacuuaagccucaaacuuguacaauaugcgagaccaauccggugaacgcuauugaugcggaaaugcaugacuugaacugcagcuacaauaucuguccauacugcgcaucccgccugacaucagauggccucgccagacacgucaugcagugucccaaaaggaaggagaaaauugaggaaacugagcuguauuuaaaccuggaacguaucccuugggugguucggaaacuucuccaggugagcgagaguaccggaguagcuuugaaacgaucuuccuggcuggucgugcuacugguucuccugacggugagccuuucgccaguccagucagcccccauaucucauggcgaaacaguggagguauaccaaaccagagagggguauaccaguaucugcuuguucgugcugggauccauuuuauuucucguuagcugucugaugaagggucuugucgacucugugggcaauagcuucuuuccugggcuguccaucugcaagaccuguucaauuggaaguaucaacggcuucgaaauagagagccacaaaugcuacuguucuuuguuuugcuguccguauugcaggcacugcuccgcagauauugaaauccauaagcuccaccugucaaucuguaaaaagcgcaaaacagguaguaaugugaugcuagccgucugcaagcggauguguuucagagcuacuguugaggugagcaacaaggcccugcucauuaggaauaucauuaacaccacauuugugguaugcauacugauccuugcagucugugugguuuccacgucugcgguggaaauggagaauuugcccgcugggaccugggagaaagaagaggaccugacuaacuucugccaucaggaaugucaggucacagagaccgagugcuuauguccauacgaagcccucgugcugcgcaagccucuuucgcuggauagcauuguuaaaggcaugaagaaucuacucaacucaacuucccuggagacaaguuugucuaucgaagcacccuggggagccauuaaugugcaaagcaccuucaaaccaacgguauccgcugccaacaucgcacugucauggucuagcgucgagcaccgaggcaauaagauauuagugagugggcgguccgaaagcaucaugaagcucgaggagcguacuggaauuucuugggaccugggcguggaagaugcuucagaguccaaacuucugaccgucaguguuauggacuugagccagauguauucgccuguguuugaauaccucucuggugauagacagguagaggaauggcccaaggccacaugcaccggggacuguccagagaggugcggaugcacuuccagcacaugucugcauaaagaguggccgcacucacgcaacuggcggugcaacccuaccugguguuggggcguggguacaggcugcacuuguugcgggcuagacgucaaggaucuguucaccgacuacauguuugugaaauggaagguugauuauaucaagacggaagcgauugugugugucgagcuuacaagucaggaaagacaaugcucucucaucgaggccggaaccagguucaaucugggccccgugacuauaaccuuguccgaaccacgaaacauucagcagaaacugcccccugagaucguuacauuacacccacgcaucgaggaaggguuuuucgaccucaugcauauucagaaggugcugagcgcuucaacugucuguaaacuucaaaguugcacccacggaguacccggcgaucugcagauauaccauaucgguaauuugcucaagggggacaaagugaacggacaccugauucauaagaucgagccucacuuuaauacgagcuggauguccugggauggcugugaccuagauuauuacugcaacaugggugacuggccgucuugcagcuauacaggcguuacccagcacaaucaugcagccuucgugaacaugcugaauauugaaacugauuacacaaagaacuuucacuuccauuccaagcgggucaccgcucacggggacacuccacagcuugaucucaaggccagacccacauauggagcaggcgagaucaccgugcugguagagguggcggacauggaauugcacacgaaaaaggucgagauaucaggguuaaaauuugccucucugacuuguaccggaugcuacgcuuguaguucgggcaucagcugcaagguuaggauucauguggacgaaccugaugagcucacagugcacgucaaauccgaagaccccgauaucguggccgcaucuucaagccugauggcucguaaacuugaguucgguaccgacuccacauuuaaggccuucagugcaaugccaaagacuucucuguguuucuacauuguugagcgcgaacauugcaagagcuguucaaaagaggauacccaacggugcguaaauacgaaguuggaacagccucaguccauccuaauagagcacaaagggacaauuaucggaaagcaaaacgacacuuguaccgccaaggcuaguugcuggcuggaaagcaucaaauccuuuuucuauggccucaagaauaugcuguccgguauuuuuggcaacguguucaucggggucuuucuuuucuuagcgcccuuuauaauucugauccucuucuuuauguucggauggagaauuuuguuuuguuucaaaugcugcaggcgaacacggggccugcucaaguaccgccaucugaaagaugacgaggagaucggguauagaaagauaauugaaaggcuuaauaacaagaaaggaaagaacaaacuguuggauggcgagcggcuagccgaccgaaagaucgcagaacuguucucaaccaaaacucacaucgguuga

SEQ ID NO: 10388 - RNA, 5052 nt, Artificial Sequence
  derived and/or modified CDS sequence (opt3) from CCHFV(4701-ST-2009)__KR814872.1__GP
augcacacccugcucgugugcuucauccuuuaccugcaguugagcggcuuagggggagcccauggucaauccaacgcuacagagcacaauggcacuaacacgaccacagcacccgggacuucucagucaccuaagccaccggccaguaccacacugccccauaccccugaaagcuccacugucaaacuaacaaccccaacgucugagacugaaggaucgggcgagaccacacccccuccaaauacuacccagggucucccccugacagggaccacgccugaaagaucagcgacuacagcuaccagcaccaguuccacagacaacaugaacucuaccacgcagguuaccgauaauacaccaacuagcaccguguccauuucaccgaguucuagcuccucaaugcccagcacaccucaaggaacucaccauccaguaaggagucuucugucuguguccagccccaagaccgucacaaccccuacuccaaugucgcccggcgagaugucuccggagacguccucacagcacagugccaugagccgggugccuacauuguauaccgcaacucagguuuccaccgaaaauacagaccgcucuacuccccgacagagcgagucaagugugcaaccagccacucaguccccuauaacaagccccgcucagacgauccuccugaugucugcagccccaaaagcuauucaggauaugcaccccucaccuaccaaccguaguaagagaaaucuggaagucgagaucauucucacuuuaagccaaggccugaaaaaguacuaugggaagauccuuaaauugcugcaucuaacacucgaggaagacaccgagggacugcuugaaugguguaagaggaaccuggguuccaauugcgaugacgacuuuuuccagaaacggauagaggaauuuuucaucacaggcgagggguacuuuaacgagguguugcaguucaagacucucucuacccugucgccaacggaaccgagccacguacgcuuacccaccgccgagccuuuuaaauccuauuucgcgaagggauuucugucaauugauaguggcuacuucucugcaaaguguuauccaagaagcuccacaucaggucuccaacuuaucaauguuacucagcaucccgccaggauugcugaaaccccugggccaaaaacaacuagccugaagaccaucaacugcauaaauuugcgggccucuguguuuaaagagcaccgcgaagucgagauuaacgugcuacugccccagaucgcagugaaccucuccaauugucacgucguuauuaacagucaugugugcgauuacagccuggacacggauggaccgguacgacuuccuagaauccaccaugagggcacauucaucccaggcaccuacaagauugugauagacaggaaaaauaagcugaacgaucgguguucuuuggucacuaauugcgugaucaaagggcgugaaguucgcaagggacaguccgugcucagacaauauaagacagagauuaaaaucgguaaggcuucaaccggcaguaggaaacuguuaagcgaggaacccggggacgacuguauaucgcggacucagcugcuaaagaccgaaacagccgagauucacgaugacaacuacggaggcccuggugauaaaaucacgaucugcaauggguccaccgucguggaccagcgacucggcucugagcugggauguuauacuauuaaccgcguaaagagcuuuaaacuuugcgaaaauucagcgacaggcaaaaccugcgagaucgauaguacacccguuaaguguagacagggguucugcuugaaaauuacucaagaaggaaggggucaugugaagcugucccggggcucugaggucgugcucgacgccugugauagcuccugcgagauaaugaucccaaaagggaccggagacauucuggucgauuguucaggcggucagcagcacuuccuuaaggacaaccugaucgauuuggggugcccucacaucccccuccugggcaagauggcaauuuacauaugucgcaugagcaaucauccaagaacgacaauggcuuuucuuuucugguuuaguuucggauaugugauuaccugcaucuuuuguaaagcccuguucuacucucuaaucauuaucggcacucucgggaagaaaauaaagcaguauagggaacugaaaccgcaaaccugcacaaucugugagacugcuccuguuaacgccauugacgcagaaaugcacgaccuuaauugcuccuacaacaucugccccuacugugccagccguuugaccucggauggacuggcucggcaugugacacagugcccaaagcgaaaggagaaaguagaagagacggagcucuaucugaauuuagaaaggauucccuggaucgucagaaagcugcuucaggugucagagucuaccgguguugcguugaaacgcaguuccuggcucauagugcugcuaguccugcucacugugagccugucuccuguacagagcgcaccagugggccacgggaagacaauugaaaccuaccaaacucgggagggauuuacauccaucugucuuuucauguugggcucaauucuguuuaucguuaguugcuuagucaaaggucucguggacagcgugucugauuccuucuuucccgggcugucagucuguaagaccugcaguauaggcagcaucaacggauucgaaauugagucccacaaauguuauugcucuuuauuuuguugcccuuacuguagacauugcucggccgacagggagauccaccagcugcauuugagcauuugcaagaagcgcaaaacgggcucaaacguuaugcucgcuguguguaagcgaaugugcuucaaagccacuaucgaagcaucccggcgugcccugcuaauaagaaguauuaucaauaccacauucgugauguguauccugacccucgcuauuugcguagucucuacuagcgccguggagauggaagaucugccggcagggacaugggagagggaagaggaccuuaccaacuuuugucaccaggagugccaaguuacagaaacugaguguuugugcccauaugaagcgcugguguuacgcaagccccucuuccuggauuccaucgucaaaggaaugaagaaucuucugaacucaaccucucuagagacgagccucaguauugaggcuccuuggggcgccauaaaugugcaguccacauuuaagccaaccguuagcacugcaaacaucgcccugucuuggucauccguggaacaucgggguaauaaaauuuugguaaccgggagaagugagagcaucaugaagcuggaagagaggacaggagucucgugggacuuaggcguggaagaugcuucugaguccaaacuccugacugugagcauuauggaccuuucacagauguacagucccgucuucgaguaucugucuggugaucgacagguugaagaguggccuaaggccaccuguacgggcgacugcccggaacgcugugggugcacauccucaaccugcuugcacaaagaguggccccacagccggaacuggagauguaauccaacuuggugcuggggagugggcacaggguguaccugcuguggaguagaugugaaggaccucuuuacugaccauauguucaucaaguggaaagucgaauacauaaagacagaggcaaucgugugcguugagcugaccagucaagaaaggcaguguagccuaauugaggcuggcacgcguuuuaaccuggguccugugacuaucacccuuuccgaaccccgcaauauucagcagaaacucccaccugagaucauaacacugcaccccaagauugaagagggguucuuugauuugaugcauguccaaaaagugcugucugccagcaccguuugcaaguuacaguccuguacacacggaaucccaggcgaccuccagaucuaccauauugguaaccugcuuaagggcgaucgggugaaugggcaccugauacacaaaaucgagccgcauuucaacacuucauggaugucuugggacggaugcgauuuggacuauuacuguaauaugggcgauuggccuaguugcaccuauacgggggucacacagcacaaccaugcggccuuuguaaaccuccugaauauugaaacugacuacaccaagacauuccacuuucacucgaaaagagugaccgcucauggagauacuccccaacuagaccugaaggcaaggccaaccuauggcgccggugagaucacaguucuuguggaagucgcugauauggagcuccacacgaaaaagguggagauuagcgggcugaaauucgccuccuugacuugcaccggauguuacgcauguucuucaggcaucagcugcaagguacgaauacauguggacgaacccgaugaguuaacaguccacguuaaguccagugacccugacgugguggcggccucuaccagccugauggcucggaaacucgaguucgguacugauucaacauuuaaggccuucuccgcaaugccaaaaaccagucugugcuuuuauaucgucgaacgcgaauacuguaagagcugcucugaggacgauacgaaaaaguguguggacacuaaacuugagcagccccaguccauucugaucgaacauaagggcacaauuaucgggaagcaaaacgauaccugcaccgcuaaagccucauguugguuggagagcguuaagucguucuuuuacggacuaaagaauaugcugggcucuguauucgggggauuuuucgugggcauacuccuguuucuugcaccuuucgucuuacuggugcucuuuuucauguucgguuggaagauuuuguuuugcuucaaguguugcagaaggacucgggggcuguuuaaauaucgacaccucaaggacgaugaagagacaggauacagacgcaucaucgaaaggcugaacaguaaaaagggcaaaaaucgucuucuggacggcgagcgguuggccgauagaaagauugcugagcuauucuccaccaagacacacaucggguga

SEQ ID NO: 10389 - RNA, 5052 nt, Artificial Sequence
  derived and/or modified CDS sequence (opt3) from CCHFV(36-ST-2014)__KR814857.1__GP
augcacacccugcucgugugcuucauccuuuaccugcaguugagcggcuuagggggagcccauggucaauccaacgcuacagagcacaauggcacuaacacgaccacaguccccgggacuucucagucaccuaagccaccggcaaguaccacacugccccauaccccugaaagcuccacuguuaaacuaacaaccccaacgucugagacugaaggaucgggcgagaccacacccccuccaaauacuacccaggguuuacccccuccagggacaaccccggaaagacccgccacgacugcgacaucaaugagcaguaccgacaacaugaauaguacuacacaggugaccgauaacacgccuaccucuacaguaagcauuuccccaucaaguagccccucuaugccuuccacuucacaaggaauacacuauccagugaggagccugcuuagugucucuucccccaagaccgugacaacuccgaccccuaugagccccggcgagaugucgccagagacaucuucccagcauucagcuaugagucggaucccuacccuguacacugccacgcagguuagcacagaaaauaccaaccgcuccacuccccgacagucugagagcucagcacaaccagccacccagagucccacaaccuccccuacucagacaauuuugcucaugagcgcugcaccaaaagccauccaggacaugcacccgucucccacgaaucguucaaagagaaaccuggaaguggagauuauccugacccucagucaaggccucaaaaaguauuacgggaagauacugaaacuuuugcaccugacucuagaggaagauacagagggacuccuggaaugguguaagaggaaucuugguagcaacugcgacgaugacuuuuuccagaaacggaucgaggaauuuuucauuaccggcgagggguauuuuaaugagguccugcaguucaagacauuguccacucucucuccuaccgaaccaucgcaugugcgccugcccacggcugagccuuuuaaaagcuacuucgccaagggauuuuuauccaucgauucaggcuauuucagugcgaaguguuacccaagaucuagcaccuccggucugcaacucauuaacguaacacagcaccccgcaaggaucgccgaaacuccggggccuaaaaccacaucacuuaagacuauaaauugcauuaaccugcgggcuagcguuuuuaaagagcaucgcgaaguggagaucaacgucuugcuaccacagauugccgugaaucugucuaacugucacguggucaucaauucccacguuugcgacuacagucucgauaccgacggacccgugcgacugccuagaauccaucacgagggcacguucauucccggcacauauaagauaguaaucgauaaaaagaacaaacuuaaugacagguguagccuggugaccaacugcgucauuaaggggcgggaagugcguaagggacagucuguuuugcgccaauacaaaacugagaucaagauagguaaagcauccacaggcucaagaaagcuccugagugaggaaccaggggaugacuguauuagcaggacccaguuacugaaaacugaaaccgcugagauccaugacgauaauuauggaggcccuggugacaagaucacaauuugcaacgggucgacgaucguggaucagcggcuaggcuccgagcucggauguuacaccauuaaucgagucaagucuuuuaaacugugcgaaaacagcgccacuggcaagacaugcgagauagacucaacccccgugaaaugucgccagggguucugccuuaagaucacacaagaaggaagaggucacguaaaauugaguaggggcuccgagguugugcuggaugcgugugacucuagcugcgagauuaugaucccaaaggggacuggagauauccucgucgacuguuccggcggucagcagcauuuccugaaggauaaucuuauugaccuggggugcccgcacauaccuuugcucggcaaaauggccaucuauauuugucggaugucaaaccacccccgcaccacgauggcauuucuguucugguuuagcuucggauacgugaucacaugcaucuuuuguaaggcuuuauucuauagucugauuauaaucggcacccuagggaaaaagauuaaacaguacagagaacucaagccacaaacuugcaccaucugugagacagcccccgucaaugcuauugaugccgaaaugcaugaccugaacugcucuuacaauaucugcccuuauugugcauccaggcuuacuagcgacggauuggcccgucacgugacccagugcccaaagcggaaagagaagguugaagagacagagcuguaccucaaccuggaacgaauacccuggauugugagaaaauuacugcagguaucggagucaacgggugucgcucuuaagaggucuaguugguugaucgugcuccugguucuacugaccgugucccucagcccuguccagucugcgccggugggccaugggaaaacuauugaaacauaucaaacccgcgagggauuuacuaacaucugucuguucaugcuuggcagcauauuguuuaucguauccugccuggugaaggguuuaguugauucagucagugacagcuucuuuccagggcucucuguguguaaaacaugcuccauuggcucaaucaauggauucgaaauugagagucacaaguguuacugcagccuguuuuguugccccuauugucggcacugcuccgcagauagagagauccaucagcuucaccugggcauaugcaagaaaaggaagaccgggucuaacgugauguuggccgucuguaaacgcaugugcuucaaggcuacgauugaagccucgcgacgggcacuccugauccguagcaucauuaauacuaccuucguuaucuguauucuaacacuggccauaugcguggugucaaccuccgcuguagagauggaaaaccucccugccggaacuugggagagagaagaggaccugacaaauuuuugucaucaggagugccaagucagugaaaccgagugucuuugcccauacgaagcauuggugcugaggaaacccuuauuccucgauucuaucguuaagggcaugaagaaccugcuuaauagcacaucccuggagacuucacuaucuauugaggcgccuuggggugcuaucaacgugcagagcaccuuuaaaccgacggucaguacagccaauauugcacucuccuggagcucuguggaacaccgcgggaacaagauccugguuaccggacggucagaguccauaaugaaauuggaagagagaacuggcgugaguugggaccuggguguagaagaugccagcgagucgaaguuacucaccgucucuaucauggaccugucccagauguauagccccguguucgaguaccuuucaggcgaucgacagguggaagaguggccaaaagcuacauguacuggggacugcccugaaagguguggaugcaccaguucuacgugccugcauaaggaguggccccacucccgcaauuggcgguguaacccaacauggugcuggggcgucgggaccggauguacuugcuguggcguugaugugaaggacuuguuuacagaucacauguucauuaaauggaagguagaauacaucaaaaccgaggccauugugugcgucgagcucacuagccaagaaagacaguguucacugaucgaggcagguacaagguuuaaucuagggccugugaccauaacgcugagugaaccccguaacauucagcagaaacuuccaccggagaucaucacucuccauccuaagauugaagagggauucuuugaccugaugcacguucaaaagguguugagcgcuuccaccgucugcaagcugcagucuuguacacauggcauacccggugacuuacagaucuaucacauuggcaaucuccugaaaggggaucgccuuaacggacaucugauccacaagauugagccacacuucaacaccagcuggauguccugggacggcugcgauuuggacuacuauuguaauaugggggauuggcccucaugcacauacacuggagugacccagcauaaccacgccgcguuuguuaaucuccugaacaucgaaacggacuauacaaaaacuuuccauuuucacucuaagcgggugaccgcccacggcgauacaccucaacuagaccugaaagcuagaccaaccuacggugcaggggagauaacuguccuuguagaaguggccgauauggagcuccauaccaagaaaguugagaucaguggacugaaguucgcuucguuggccugcacaggcuguuaugcaugcagcuccgguauuucuuguaaggugaggauccacgucgacgaacccgaugaguuaacggugcauguaaaaucaagcgacccugauguggucgcggccuccacuucccugauggcucgaaagcucgaauuuggcaccgacucuacauuuaaagccuucagcgcaaugccgaagaccucacugugcuuuuacauuguugagcgggaauacuguaaauccugcagugaggacgauacuaagaaguguguggacacaaaacuugaucagccacagagcauccugauagagcacaaggggaccauuaucggaaaacaaaaugacacgugcacugcuaaggccucuuguugguuggaauccgugaaaucauucuuuuauggccuaaagaacaugcuggggagcgucuucggaaauuucuucgugggcauccuccuguuucuugcacccuucguuuuacugguacucuuuuucaugugcgguuggaaguucuuguuuuguuucaaaugcugccgcagaacaagggggcuguuuaaguaccggcaucucaaagaugacgaggaaaccggauaucgaagaauuaucgagcgccugaacucgaagaaaggcaagaauaggcuucuggauggcgaacguuuggccgaccggaagauagcugagcuauucucuaccaaaagucacauuggguga

SEQ ID NO: 10390 - RNA, 5055 nt, Artificial Sequence
  derived and/or modified CDS sequence (opt3) from CCHFV(Matin)__AF467769.2__GP
auguacacccugcuccuuugcgccauccuguguagccaguugugguccucugagggcauucacggguuaucaaacgaaacacaacauggaaaugcuaguacuauaaaggcacccgaggugagccagggucugggccuaccugucuccacggccccaccgaucaccucugacccaccuucgauuacaucagcggcuagcguuagugggccagaaggauccggcgauacuaacaccucucccccugugacaacccagggucucacucugccagagacaacccuugaacuguugacgacuaccaauacaggggccagcuccacuguaaucguggacgucucaacccagacagugaaagauacccccguuaguacggcacacacuagcccuccaggaacaccgucugcccccaccacuccucaaggcacacaucacaccgcuagaggccuccuguccgugacgucaaccaagagcgaggaggcaaguacacagacuaaccccaaaaagaccucuauggaaacaaauucccccgggccugccacuagcgagaccccaucgcccucuccgacaacccaggcuccuacugaaaacaauaaccccaauacgccaaggcagccuacacccccaacccaacccgccacuccuuccccagucaccucaccggcgcugcucgcaaguagccagggagacacauccaccgccgugcaggauguacaucccucuccuacuaaccggagcaaacgcaauuuagagauggagauuauccugacacuuucacaggguuugaagaaguauuacggcaaaauacugaagcuacucgaccugacgcuugaagaggauaccgaagggcuguuggaguggugcaaacgaaaccucggacugguuugugacgauaguuucuuucaaaagcguaucgaagaguucuuuuuaacuggcgagggucacuucaaugaagugcugcaguuuaaaacaccauccacccucagccccacagagccugcuagagccgggucuccaacugucgaacccuucaagucauauuuugcaaggggacuucugaguauggacagcggcuacuucuccgcuaagugcuauccgcgggccucuaacucgggcuugcagcuaauuaauaucacccaacacagcgcgcgcauuacggauaccccugggccaaaaaucacaaaccugaagacuauaaacuguauuaaucucaaagccuccaccuuuaaggagcauagagaaaucgagauuaacgugcugcuuccccagguggcagucaaucugucaaguugccacguuuugaucaaaucucaugugugugacuacagccucgauaucgacggaccuguaaggcugccccggauucaccacgaggguacauucauaccaggcacuuauaagaucgugauugacaaaaagaacaagcagaaugaucgcugcaccaucgucacgaacugugugauaaaagggcgagaaauuagaaagggacaguccguuuuaaggcaauacaaaacagagaucaagaucggcaaagcuaguagcgguucucggcgucugcuauccgaagagaguggggacgauugcauuagccgcacccagcuccugagaacugaaacagccgagauccauucugacuccuacggcggaccuggcgauaagauuaccauauguaaugggucaacuguggucgaccagaggcuuggaagugaguuggguugcuauaccaucaaccggguaaagagcuuuaaacugugcgaaaauucggcuacaggcaaguccugugagauugauucuacgcccgugaaaugccgacagggguucugucucaagaucacccaagaaggacgcggccacguuaaacugagcagagguucagaggugguccuugacgccugcgauaguuccugugagaucaugauuccaaaggggacuggcgacauacugguggauugcucuggaggccagcagcacuuuuugaaggacaaccucaucgaccugggguguccgaauauuccuuuacugggaaaaauggcaaucuacauuugcaggaugagcaaccaucccaagacaaccauggucuuccuauucugguuuuccuucgguuaugugaucacauguauacucugcaaaguuaucuuuuaccugcuuauugugguaggcacuuuggggaagaaauucaagcaguaucgggaacugaagccacaaaccuguacgaucugcgagacaacccccgucaaugccauugaugcugaaaugcaugaccucaacugcucauacaauaucuguccuuauugcgcgagccgccugacuucagauggauuagcaagacacgugaugcaguguccaaaaaggaaggagaaaauagaagagaccgagcuguaccuuaacuuggaacguauucccuggguugugcggaagcuccugcaggucucugaguccacaggcguggcccuaaaacgaagcucguggcugguagugcuccugguucuuuugacugucucacugucuccugugcagagugcuccgaucggucacgggaagaccguggaaacauaccaaauuagagagggcuauacguccgucugcuuauuuguucucggaagcauccuguucauagugucuugucuuaugaaaggccugguggacagcgaugggaacuccuuuuucccaggauugucaaucugcaagaccuguaguauuggcagcaucaaugguuuugaaauugagucucauaagugcuacuguucccucuucugcugucccuauugcaggcacugcucaacugaccgcgagauccauaaacugcaccuaaguauauguaagaaacggaagacagggagcaacguaaugcuggccgucugcaaaagaauguguuuuagggcaaccguggaaguuuccaauaaggcccuccugauucgcucuaucaucaacacuacauucguggucugcauucuuaucuuggcuguguguguugugucgaccagcgccguagagauggaaucacugccugcaggaacgugggagcgagaagaggauuuaauuaauuuuugccaccaggagugucaggucacugaaaccgagugccucuguccauacgaagcgcuggugcuucggaagccccuguuccuagacuccauaaucaaaggcaugaagaaccuccugaauaguacaucuuuggagaccagccuguccauugaggcuccuuggggugccaucaacgugcaaucaacuuucaaaccgacaaugucugcagccaauauugcuuuaagcuggaguuccgucgaacaucguggcaacaagauccucguuagcgggagaucugagucaauaaugaaacuggaagagaggaccggaaucuccugggaucuuggcguggaagacgccagugagagcaagcuguugacaguaucggugauggaucucucucagauguauucccccgucuuugaguaccugagcggggaccgccagguggaagaguggccaaaggcaacuugcaccggagauuguccugaacggugcggcugcacgucaaguacaugucuacacaaagaguggccccauucuagaaauuggaggugcaacccaaccugguguugggguguugggacuggaugcaccuguugcggccuggacgugaaggaccuuuucacagauuauauguuugucaaauggaagguggaauacauuaaaacugagguuaucgugugugucgagcucaccucccaggaacgacaaugcagccugauugaggcugguacgcgcuucaauuugggcccuguaacaaucacccugucagaaccccggaacauacagcagaaguuaccaccggagauugugacucuccacccuagaaucgaagagggguuuuucgaccugaugcauguucagaaggugcuuagugccagcacagucuguaaacugcaauccugcacccacggagugcccggcgauuugcagguauaccacaucgggaaucuccugaagggagacaaagugaacggccaucuaauucacaagauagagccacauuuuaacacuucuuggaugagcugggaugguugugaccuggauuauuacugcaauaugggggacuggcccuccugcucauauacaggagucacccagcacaaccaugcggccuucguuaauaugcuuucuaucgaaacggauuacacuaaaaacuuucacuuccacaguaagagggugaccgcucauggcgacacaccucagcucgaucugaaagcacguccaaccuauggugccggcgagauuacaguguuggucgaaguggcugacauggaguuacacacuaagaagaucgagauuucggggcugaaauuugccagccucaccuguacgggaugcuacgcauguuccucuggcaucucaugcaagguucgcauacauguagaugaacccgacgagcugacagugcacgucaaaagcgaagacccugauaucguggcggccuccaguucucuuauggcucggaagcuggaguucgggacugacagcaccuuuaaagccuucucagcaaugccgaagacauccuuguguuucuauauuguugaaagagaguacugcaagaguuguagcaaagaggauacccaaaagugcgugaauacuaaacuagaacagccacagucuauccugauugagcacaagggaaccaucauaggcaaacaaaacgacacauguacggcuaaggccuccugcuggcucgaaucagucaagagcuuuuucuacggucugaaaaauaugcuuucggggauuuuuggaaacguguucaucggcaucuuuuuauuccuggcacccuuugcccucuugauucuguucuuuauguucggcuggaggauccucuuuuguuucaagugcugccgacggacucgcgggcuguucaaauauagacaucuuaaggaugacgaggaaaccggauacaggaaaauaauugagcggcugaauaacaagaaggguaaaaauaaguugcuagauggcgagcgacuggcugacagaaaaaucgcggaacucuuuucuacaaagacccacguaggguga

SEQ ID NO: 10391 - RNA, 5052 nt, Artificial Sequence
  derived and/or modified CDS sequence (opt3) from CCHFV(UCCR4405)__KY484029.1__GP
augcacgcccugcucgugugcuucauccuuuaccugcaguugagcggcuuagggggagcucauagacaauccaacgcaaccgagcacaaugguacaaacacuacgaccgcccccggcacaucucagucaccuaagccaccggucaguacuacccugccccauacaccugaagcgagcaccauuaaacuaacuacaccaaccuccgagacggaagggucuggagagacuacacccccuccaaauacaacucagggccucccccugccugguaccacaccagaaaggucggcuaccacggccacuucaacaagcaguaccgacgauaugaacuccacuacacagaugaccgacaauacgccgaccucuacaguuagcauagggcuuuccucaagucccagcaugccuucuacuucccaaggaauccacuauccagugcggucacuguugagcguaaguucucccaagaccgcaacaacuccuaccccaaugucccccggcgaggugagcccggagacaucgucucagcauuccgccaugucacgcauuccuacccucuacacugcuacgcaggucaguacagaaaacaccaaucgaagcaucccccgucaguccgagucuagcgugcaaccagcaacucagucaccuauuaccagucccgcccagacaauccugcugauguccgcugccccaaccgcgauacaggauaugcaccccagcccuaaaaacagaucuaagaggaaucucgaaguugagaucauuuuaacucugucacaaggccuuaaaaaguauuacgggaagaucuugaaacugcuacaccucacacuggaggaagacacggagggacuucuggaaugguguaagcggaacuuggguaguaauugcgaugacgacuuuuuccagaaacgcauugaggaauuuuucaucaccggcgagggguauuuuaacgaggugcuccaguucaagacuccaagcacacuguccccgaccgaacccucucaugucagauuaccuacagcagagccauuuaaaucguacuucgccaagggauuucugagcauagauuccggcuauuucucagcuaaguguuaccccaggaguucuacuagcggucuccaacuuauuaaugugacccagcacccugcccggaucgcagaaacgccagggcccaaaaccacaucccugaagacuauuaacugcaucaauuugcgcgcuucaguauuuaaagagcaucgagaaguugagaucaacgugcuacugccgcagauugccgucaaccucagcaauugucacguggugauaaacucucacgucugcgauuacucccuggacaccgauggaccuguuagacuuccaaggauccaucacgagggcgcguucauucccggcacauauaagaucgugauagacaaaaagaauaaacugaacgaucgguguaguuugguaacuaauugcgugauuaaggggcgugaaguccgcaagggacagagcgugcucagacaauacaaaaccgagaucaagaucgguaaagccucuacgggcuccaggaagcuguuaucagaggaaccuggggacgacuguauuagucggacacagcugcuaaaaaccgaaacugcagagauccaugaugacaacuauggaggccccggugauaagauuacaauaugcaaugggagcaccaucguugaccagcgacucggcucggagcugggauguuacacuauuaaccgcgugaaguccuuuaaacuuugcgaaaauucugcuaccggcaagacaugcgagaucgauagcacgccagucaaauguagacagggguucugcuugaagaucacccaagaaggaaggggucacgugaaacugucacggggcagugagguaguucucgacgccugugauuccucuugcgaggugaugauuccuaaggggacuggagacauacuggucgauuguagcggcggucagcagcauuuccuuaaggacaaccugaucgauuuggggugcccccacauuccacuccugggcaaaauggcuaucuauauuugucgcauguccaaucacccgagaacaaccauggccuuuuuauucugguuuucauucggauacgugaucacaugcauauuuuguaaggcacuguucuauagccuaaucauuaucggcacucucgggaaaaagauuaaacaguacagggaacugaagccucaaaccugcacgaucugugagacagcccccgucaacgcuauagacgcggaaaugcaugaccuuaagugcaguuacaauauuugcccauauugugcaucucguuugaccuccgauggacuggcccggcacgugacucagugccccaaacgaaaggagaaaguugaagagaccgagcucuaccugaacuuagaaagaaucccuuggauugugaggaagcugcuucagguaagcgagucgacaggugucgcuuugaaacgcucaucuuggcucaucgugcugcuaguucugcucacugugagucuguccccaguccagagcgcccccgugggccaugggaagaccauagaaacauaucaaacgcgggagggauuuaccucuaucugucuuuucauguugggcagcauucuguuuaucguauccugcuuagugaaaggucucguugacucagucagugauagcuucuuuccugggcugucuguguguaagacuugcuccauuggcucaaucaauggauucgaaauagagagucacaaguguuacugcagccuguuuuguugcccguauuguagacacuacuccgcagacagggagauucaucagcuucacuugucuaucugcaaaaagcgcaaaacaggcucgaacgugaugcucgccgucugcaagcgaauguguuucaaagcuaccaucgaagccagccggcgugcacugcuaauuagaucaaucauuaacacuacauucguuauaugcauccugauucucgcgaucugugugguguccaccagugcuguagagauggaaaaucugccagccgggacgugggagagggaagaggaucuuacuaacuuuugccaucaggagugucaagucaccgaaacagagugcuugugucccuaugaagcacugguguuacgcaagccucucuuccuggacucuaccguuaagggaaugaaaaaucuucugaacagcacuucccuagagacaucacucucuauugaggccccauggggcgcuaucaaugugcagagcaccuuuaagcccacagucaguacugccaacauagcacuguccuggagcucuguggaacaccgggguaauaaaaucuugguuaccgggagaucagaguccauuaugaagcuggaagagaggacgggagugaguugggauuuaggcguagaagacgcuagcgagucgaaacuccugacagucucuaucauggaucuuucccagauguacagcccuguguucgaguaccugucaggugaccgacagguggaagaguggccgaaggcaaccugcacuggcgauugucccgaacgcugcggguguaccaguucuacaugcuugcauaaggaguggccacacucccggaacuggagaugcaauccuacuugguguuggggagucggcaccgggugcacguguugcggaguugacgugaaagaucucuuuacagaccacauguucguaaaguggaaaguggaauauauuaagaccgaggcgaucgucuguguggagcugacuagccaagaaaggcagugcucacuaauagaggccggcacacguuuuaaccugggucccguuaccauuacucuuagugaaccacgcaauauccagcagaaacucccucccgagaucauuacacugcauccaaagauagaagagggguucuuugacuugaugcacgugcaaaagguccugagcgcuuccaccguguguaaauuacagucuugcacgcauggaaucccgggcgaucuccagauuuaccacaucgguaaccugcuuaagggcgaccggguuaaugggcaucugauucacaaaaucgagccucacuucaacacuagcuggauguccugggauggaugugacuuggauuauuacugcaauaugggcaacuggcccucauguaccuauacaggggugacccagcauaaccacgcagccuuugucaaucuccugaacauagaaacagacuacacuaagaccuuccauuuucacucuaaaagaguaacggcucacggagauacaccacaacuagaccugaaggccaggcccacuuauggcgccggugagaucaccgugcuuguugaaguggcggauauggagcuccauaccaaaaaggucgagauuagugggcugaaguucgccucguuggugugcaccggaugcuacgcuuguagcuccggcaucucuugcaaaguacggauucacguggacgaaccugaugaguuaacuguccauguuaagucaagcgacccagaugugguggccgcauccaccagucugauggcucgaaaacucgaguucgguacagacucuaucuuuaaggccuucagcgcaaugcccaaaacgucacuguguuuuuacauagucgaacgcgaauauugcaaguccuguagugaggacgauacuaagaaaugcguggacaccaaacuugagcagccucagagcauucugaucgaacacaaaggcacaaucauugggaagcaaaaugauaccuguacugccaaggcuucuugcugguuggaguccguuaagucauucuuuuacggacuaaagaacaugcugggcagcguauucgggaauuucuuugugggaauccuccuguuucuugcgccguucgucuuacuggugcucuuuuucauguucggcuggaaaauauuguuuuguuucaagugcuguagaaggacacggggucuguuuaaauaucgacaucucaaggacgaugaagagaccggguacagacgcauuaucgaaaggcugaacucgaaaaagggaaagaaucgucuucuggacggcgagcgguuggccgauagaaaaauugcagagcuauucucuacgaagacucacaucggcuga

SEQ ID NO: 10392 - RNA, 5052 nt, Artificial Sequence
  derived and/or modified CDS sequence (opt3) from CCHFV(Drosdov)__DQ211630.1__GP
augcacgcccugcucgugugcuucauccuuuaccugcaguugagcggcuuagggggagcucauagacaauccaacgcaaccgagcacaaugguacaaacacuacgaccgcccccggcacaucucagucaccuaagccaccggucaguacuacccugccccauacaccugaagcgagcaccauuaaacuaacuacaccaaccuccgagacggaagggucuggagagacuacacccccuccaaauacaacucagggccucccccugccugguaccacaccagaaaggucggcuaccacggccacuucaacaagcaguaccgacgauaugaacuccacuacacagaugaccgacaauacgccgaccucuacaguuagcauagggcuuuccucaagucccagcaugccuucuacuucccaaggaauccacuauccagugcggucacuguugagcguaaguucucccaagaccgcaacaacuccuaccccaaugucccccggcgaggugagcccggagacaucgucucagcauuccgccaugucacgcauuccuacccucuacacugcuacgcaggucaguacagaaaacaccaaucgaagcaucccccgucaguccgagucuagcgugcaaccagcaacucagucaccuauuaccagucccgcccagacaauccugcugauguccgcugccccaaccgcgauacaggauaugcaccccagcccuaaaaacagaucuaagaggaaucucgaaguugagaucauuuuaacucugucacaaggccuuaaaaaguauuacgggaagaucuugaaacugcuacaccucacacuggaggaagacacggagggacuucuggaaugguguaagcggaacuuggguaguaauugcgaugacgacuuuuuccagaaacgcauugaggaauuuuucaucaccggcgagggguauuuuaacgaggugcuccaguucaagacuccaagcacacuguccccgaccgaacccucucaugucagauuaccuacagcagagccauuuaaaucguacuucgccaagggauuucugagcauagauuccggcuauuucucagcuaaguguuaccccaggaguucuacuagcggucuccaacuuauuaaugugacccagcacccugcccggaucgcagaaacgccagggcccaaaaccacaucccugaagacuauuaacugcaucaauuugcgcgcuucaguauuuaaagagcaucgagaaguugagaucaacgugcuacugccgcagauugccgucaaccucagcaauugucacguggugauaaacucucacgucugcgauuacucccuggacaccgauggaccuguuagacuuccaaggauccaucacgagggcgcguucauucccggcacauauaagaucgugauagacaaaaagaauaaacugaacgaucgguguaguuugguaacuaauugcgugauuaaggggcgugaaguccgcaagggacagagcgugcucagacaauacaaaaccgagaucaagaucgguaaagccucuacgggcuccaggaagcuguuaucagaggaaccuggggacgacuguauuagucggacacagcugcuaaaaaccgaaacugcagagauccaugaugacaacuauggaggccccggugauaagauuacaauaugcaaugggagcaccaucguugaccagcgacucggcucggagcugggauguuacacuauuaaccgcgugaaguccuuuaaacuuugcgaaaauucugcuaccggcaagacaugcgagaucgauagcacgccagucaaauguagacagggguucugcuugaagaucacccaagaaggaaggggucacgugaaacugucacggggcagugagguaguucucgacgccugugauuccucuugcgaggugaugauuccuaaggggacuggagacauacuggucgauuguagcggcggucagcagcauuuccuuaaggacaaccugaucgauuuggggugcccccacauuccacuccugggcaaaauggcuaucuauauuugucgcauguccaaucacccgagaacaaccauggccuuuuuauucugguuuucauucggauacgugaucacaugcauauuuuguaaggcacuguucuauagccuaaucauuaucggcacucucgggaaaaagauuaaacaguacagggaacugaagccucaaaccugcacgaucugugagacagcccccgucaacgcuauagacgcggaaaugcaugaccuuaagugcaguuacaauauuugcccauauugugcaucucguuugaccuccgauggacuggcccggcacgugacucagugccccaaacgaaaggagaaaguugaagagaccgagcucuaccugaacuuagaaagaaucccuuggauugugaggaagcugcuucagguaagcgagucgacaggugucgcuuugaaacgcucaucuuggcucaucgugcugcuaguucugcucacugugagucuguccccaguccagagcgcccccgugggccaugggaagaccauagaaacauaucaaacgcgggagggauuuaccucuaucugucuuuucauguugggcagcauucuguuuaucguauccugcuuagugaaaggucucguugacucagucagugauagcuucuuuccugggcugucuguguguaagacuugcuccauuggcucaaucaauggauucgaaauagagagucacaaguguuacugcagccuguuuuguugcccguauuguagacacuacuccgcagacagggagauucaucagcuucacuugucuaucugcaaaaagcgcaaaacaggcucgaacgugaugcucgccgucugcaagcgaauguguuucaaagcuaccaucgaagccagccggcgugcacugcuaauuagaucaaucauuaacacuacauucguuauaugcauccugauucucgcgaucugugugguguccaccagugcuguagagauggaaaaucugccagccgggacgugggagagggaagaggaucuuacuaacuuuugccaucaggagugucaagucaccgaaacagagugcuugugucccuaugaagcacugguguuacgcaagccucucuuccuggacucuaccguuaagggaaugaaaaaucuucugaacagcacuucccuagagacaucacucucuauugaggccccauggggcgcuaucaaugugcagagcaccuuuaagcccacagucaguacugccaacauagcacuguccuggagcucuguggaacaccgggguaauaaaaucuugguuaccgggagaucagaguccauuaugaagcuggaagagaggacgggagugaguugggauuuaggcguagaagacgcuagcgagucgaaacuccugacagucucuaucauggaucuuucccagauguacagcccuguguucgaguaccugucaggugaccgacagguggaagaguggccgaaggcaaccugcacuggcgauugucccgaacgcugcggguguaccaguucuacaugcuugcauaaggaguggccacacucccggaacuggagaugcaauccuacuugguguuggggagucggcaccgggugcacguguugcggaguugacgugaaagaucucuuuacagaccacauguucguaaaguggaaaguggaauauaugaagaccgaggcgauugucuguguggagcugacuagccaagaaaggcagugcucacuaaucgaggccggcacacguuuuaaccugggucccguuaccauaacucuuagugaaccacgcaauauucagcagaaacucccucccgagaucaucacacugcauccaaagauugaagagggguucuuugacuugaugcacgugcaaaagguccugagcgcuuccaccguguguaaauuacagucuugcacgcauggaauaccgggcgaucuccagaucuaccacauugguaaccugcuuaagggcgaccggguuaaugggcaucugauccacaaaauugagccucacuucaacacuagcuggauguccugggauggaugugacuuggauuauuacugcaauaugggcaacuggcccucauguaccuauacaggggugacccagcauaaccacgcagccuuugucaaucuccugaacaucgaaacagacuacacuaagaccuuccauuuucacucuaaaagaguaacggcucacggagauacaccacaacuagaccugaaggccaggcccacuuauggcgccggugagauaaccgugcuuguugaaguggcggauauggagcuccauaccaaaaaggucgagaucagugggcugaaguucgccucguuggugugcaccggaugcuacgcuuguagcuccggcauuucuugcaaaguacgaauccacguggacgaaccugaugaguuaacuguccauguuaagucaagcgacccagaugugguggccgcauccaccagucugauggcucggaaacucgaauuugguacagacucuauuuuuaaggccuucagcgcaaugcccaaaacgucacuguguuuuuacaucgucgagcgcgaauauugcaaguccuguagugaggacgauacuaagaaaugcguggacaccaaacuugagcagccucagagcauacugauugaacacaaaggcacaaucaucgggaagcaaaaugauaccuguacugccaaggcuucuugcugguuggaguccguuaagucauucuuuuacggacuaaagaacaugcugggcagcguauucgggaauuucuucgugggcauucuccuguuucuugcgccguucgucuuacuggugcucuuuuucauguucggauggaaaaucuuguuuuguuucaagugcuguagaaggacacggggucuguuuaaauaucgacaucucaaggacgaugaagagaccggguacagacgcauaauugaaaggcugaacucgaaaaagggaaagaaucgucuucuggacggcgagcgguuggccgauagaaaaaucgcagagcuauucucuacgaagacucacauuggcuga

SEQ ID NO: 10393 - RNA, 5052 nt, Artificial Sequence
  derived and/or modified CDS sequence (opt3) from CCHFV(44-ST-2010)__KR814859.1__GP
augcacacccugcucgugugcuucauccuuuaccugcaguugagcggcuuagggggagcccauggucaauccaacgcuacagagcacaauggcacuaacacgaccacaguccccgggacuucucagucaccuaagccaccggcaaguaccacacugccccauaccccugaaagcuccacuguuaaacuaacaaccccaacgucugagacugaaggaucgggcgagaccacacccccuccaaauacuacccagggucuucccccuccagggacaaccccggaaagacccgccacgacugcgacaucaaugagcaguaccgacaacaugaauaguacuacacaggugaccgauaacacgccuaccucuacaguaagcauuuccccaucaaguagccccucuaugccuuccacuucacaaggaauacacuauccagugaggagccugcuuagugucucuucccccaagaccgugacaacuccgaccccuaugagccccggcgagaugucgccagagacaucuucccagcauucagcuaugagucggaucccuacccuguacacugccacgcagguuagcacagaaaauaccaaccgcuccacuccccgacagucugagagcucagcacaaccagccacccagagucccacaaccuccccuacucagacaauuuugcucaugagcgcugcaccaaaagccauccaggacaugcacccgucucccacgaaucguucaaagagaaaccuggaaguggagauuauccugacccucagucaaggccuuaaaaaguauuacgggaagauacugaaacuuuugcaccugacucuagaggaagauacagagggacuccuggaaugguguaagaggaaucuugguagcaacugcgacgaugacuuuuuccagaaacggaucgaggaauuuuucauuaccggcgagggguauuuuaaugagguccugcaguucaagacauuguccacucucucuccuaccgaaccaucgcaugugcgccugcccacggcugagccuuuuaaaagcuacuucgccaagggauuuuuauccaucgauucaggcuauuucagugcgaaguguuacccaagaucuagcaccuccggucugcaacucauuaacguaacacagcaccccgcaaggaucgccgaaacuccggggccuaaaaccacaucacuuaagacuauaaauugcauuaaccugcgggcuagcguuuuuaaagagcaucgcgaaguggagaucaacgucuugcuaccacagauugccgugaaucugucuaacugucacguggucaucaauucccacguuugcgacuacagucucgauaccgacggacccgugcgacugccuagaauccaucacgagggcacguucauucccggcacauauaagauaguaaucgauaaaaagaacaaacuuaaugacagguguagccuggugaccaacugcgucauuaaggggcgggaagugcguaagggacagucuguuuugcgccaauacaaaacugagaucaagauagguaaagcauccacaggcucaagaaagcuccugagugaggaaccaggggaugacuguauuagcaggacccaguuacugaaaacugaaaccgcugagauccaugacgauaauuauggaggcccuggugacaagaucacaauuugcaacgggucgacgaucguggaucagcggcuaggcuccgagcucggauguuacaccauuaaucgagucaagucuuuuaaacugugcgaaaacagcgccacuggcaagacaugcgagauagacucaacccccgugaaaugucgccagggguucugccuuaagaucacacaagaaggaagaggucacguaaaauugaguaggggcuccgagguugugcuggaugcgugugacucuagcugcgagauuaugaucccaaaggggacuggagauauccucgucgacuguuccggcggucagcagcauuuccugaaggauaaucuuauugaccuggggugcccgcacauaccuuugcucggcaaaauggccaucuauauuugucggaugucaaaccacccccgcaccacgauggcauuucuguuaugguucagcuuuggauacgugaucacaugcauuuucuguaaggcucuguuuuauagucuaaucauaaucggcacccucgggaaaaagauuaaacaguacagagaacugaagccacaaacuugcaccaucugugagacagcccccgucaaugcuauugaugccgaaaugcaugaccuuaacugcucuuacaauaucugcccuuauugugcauccagguugacuagcgacggacuggcccgucacgugacccagugcccaaagcggaaagagaagguugaagagacagagcucuaccugaacuuagaacgaauacccuggauugugagaaaacugcuucagguaucggagucaacgggugucgcuuugaagaggucuaguuggcucaucgugcugcuaguucugcucaccgugucccugagcccuguccagucugcgccggugggccaugggaaaacuauugaaacauaucaaacccgcgagggauucacuaacaucugucuuuuuauguugggcagcauacuguucaucguauccugcuuagugaagggucucguugauucagucagugacagcuuuuucccagggcugucuguguguaaaacaugcuccuuuggcucaauuaauggauucgaaaucgagagucacaaguguuacugcagccucuuuuguugccccuauugucggcacugcuccgcagauagagagauucaucagcugcacuugggcaucugcaagaaaaggaagaccgggucuaacgugaugcucgccgucuguaaacgcaugugcuucaaggcuacgauagaagccucgcgacgggcacugcuaauucguagcaucaucaauacuaccuucguuauuuguauccugacacucgccauuugcguggugucaaccuccgcuguagagauggaaaaccugccugccggaacuugggagagagaagaggaccuuacaaauuuuugucaucaggagugccaagucagugaaaccgaguguuugugcccauacgaagcacugguguuaaggaaaccccucuuccuggauucuauaguuaagggcaugaagaaccuucugaauagcacaucccuagagacuucacucucuaucgaggcgccuuggggugcuauuaacgugcagagcaccuuuaaaccgacggucaguacagccaauaucgcacuguccuggagcucuguggaacaccgcgggaacaagauuuugguuaccggacggucagaguccaucaugaaacuggaagagagaacuggcgugaguugggacuuagguguagaagaugccagcgagucgaagcuccugaccgucucuauaauggaccuuucccagauguauagccccguguucgaguaccugucaggcgaucgacagguggaagaguggccaaaagcuacauguacuggggacugcccugaaagguguggaugcaccaguucuacgugcuugcauaaggaguggccccacucccgcaauuggcgguguaacccaacauggugcuggggcgucgggaccggauguacuugcuguggcguugaugugaaggaccucuuuacagaucacauguucaucaaauggaagguagaauacauuaaaaccgaggccaucgugugcgucgagcugacuagccaagaaagacaguguucacuaauugaggcagguacaagguuuaaucuggggccugugaccaucacgcuuagugaaccccguaacauacagcagaagcucccaccggagauuaucacucugcauccuaaaaucgaagagggauucuuugacuugaugcacguucaaaaggugcugagcgcuuccaccgucugcaaguuacagucuuguacacauggcauucccggugaccuccagauauaucacaucggcaaucugcuuaaaggggaucgccugaacggacauuugauucacaagaucgagccacacuucaacaccagcuggauguccugggacggcugcgaucucgacuacuauuguaauaugggggauuggcccucaugcacauacacuggagugacccagcauaaccacgccgcguuuguuaaucugcuaaacauugaaacggacuauacaaaaacuuuccauuuucacucuaagcgggugaccgcccacggcgauacaccucaacuggaccuuaaagcuagaccaaccuacggugcaggggagaucacuguccucguagaaguggccgauauggagcugcauaccaagaaaguugagauaaguggauugaaguucgcuucguuagccugcacaggcuguuaugcaugcagcuccgguaucucuuguaaggugaggauucacgucgacgaacccgaugagcugacggugcauguaaaaucaagcgacccugauguggucgcggccuccacuucccucauggcucgaaagcuggaguucggcaccgacucuacauuuaaagccuucagcgcaaugccgaagaccucacuuugcuuuuacaucguugaacgggaauacuguaaauccugcagugaggacgauacuaagaaguguguggacacaaaacuggaucagccacagagcauuuugaucgagcacaaggggaccauaauuggaaaacaaaaugacacgugcacugcuaaggccucuuguuggcuagaauccgugaaaucauucuuuuauggccugaagaacaugcucgggagcgucuucggaaacuuuuucgugggcauccuguuauuuuuagcacccuucguucugcucguauuguuuuucaugugcgguuggaagauccuguucuguuuuaaaugcugccgcagaacaaggggacucuucaaguaccggcaucugaaagaugacgaggaaaccggguaucgaagaauuaucgagcgccuuaauucgaagaaaggcaagaauaggcuguuggauggcgaacgucuagccgaccggaagauagcugagcuguuuucuaccaaaagucacauuggguga

SEQ ID NO: 10394 - RNA, 5052 nt, Artificial Sequence
  derived and/or modified CDS sequence (opt3) from CCHFV(3756-ST-2007)__KR814866.1__GP
augcacacccugcucgugugcuucauccuuuaccugcaguugagcggcuuagggggagcccauggucaauccaacgcuacagagcacaauagaacuaacacgaccacaguccccggcacuucucagucaccuaagccaccggcaaguaccacacugccccauaccccugaaagcuccacuguuaaacuaacaaccccaacgucugagacugaagggucgggagagaccacacccccuccaaauacuacccagggccucccccugccugguacaaccccagaaaggucagccacgacugcgacaagcaccaguuccacugacaacaugaauacaaccacacaggugaccgauaacacaccgacuucuaccguaagcauuucccccucaaguagcccuucuaugccauccacaucacaagggauacacuaucccgugcggagccuucugagugucucuuccccuaagacugugaccacaccaacccccaugagcccgggagagaugucgccugagacuucuucccagcauucagcuaugagucgcauccccacguuguacacagccacccagguuagcacugaaaauauuaaccgauccaccccacgucagucugagagcucagugcaaccugcaacacagagucccaucaccuccccagcccagacuauucuccugaugagcgcugcacccaaagccauccaggacaugcacccuucuccaacaaauagaucaaagaggaaccuggaagucgagauaauccucacguuaagucaaggccugaaaaaguauuacggcaagauucuuaaauugcugcaccuaacccucgaggaagauacugaggggcugcuugaaugguguaagcggaaucugggaagcaacugcgacgaugacuuuuuccagaaacgcaucgaggaauuuuucauuacaggugagggcuauuuuaaugagguguugcaguucaagacccucuccacacugucuccgacugaacccucgcauguaagauuaccuaccgcugagccauuuaaaagcuacuucgccaagggguuucuguccaucgauucaggauauuucagugcgaaguguuaccccaggucuagcacguccggccuccaacuuauaaacguuacccagcacccugcacggauugccgaaacaccaggucccaaaacuaccucacugaagacaaucaauugcauuaacuugcgcgcuagcguguuuaaagagcaucgagaagucgagaucaacgugcuacugccgcagaucgccgugaaucucucuaacugucacgucguuauuaauucccacgugugcgacuacagucuggauacugacgggccuguaagacuuccaaggauacaucacgagggaaccuucauccccggcacguauaagauugugaucgaucggaaaaacaagcugaaugaccguuguagcuuggucacaaacugcgugauaaaaggccgcgaaguuagaaaggggcagucugugcucaggcaauacaagaccgagauuaaaaucggaaaggcauccacugguucacggaaacuguuaagugaggaaccuggcgaugacuguaucagccgaacacagcugcuaaagaccgaaacugcugagauucaugacgauaauuaugggggacccggcgacaaaaucaccauuugcaacgguucgacaauagucgaucagcgccucggguccgagcugggcuguuacacgaucaauagagugaagucuuuuaaacuuugcgaaaacagcgccaccggaaaaacuugcgagauugacucaacaccaguaaaguguaggcagggcuucugcuugaaaaucacccaagaagggcggggacacguuaagcugagucgcgguuccgaggugguccucgaugcgugugacucuagcugcgagaucaugauuccuaaaggcacaggggauauacugguggacuguuccggaggccagcagcauuuccuuaaggauaaucugaucgacuuggguugcccccacauuccacuccuggggaagauggccaucuauauuuguagaaugucaaaccacccgaggacuaccauggcauuuuuauucugguuuagcuucggcuacgucaucacgugcauauuuuguaaagcucuguucuauagucuaaucauuaucggaacacucggcaagaaaauuaagcaguaccgugaacugaaaccucaaaccugcacuaucugugagaccgcccccgugaaugcuauagaugccgaaaugcaugaccuuaacugcucuuacaauauuugcccauauugugcaucccgguugacaagcgacgggcuggcccgacacguuacucagugccccaagagaaaggagaaaguggaagagaccgagcucuaccugaacuuagaaaggaucccuuggauuguacgcaagcugcuucaggucucggagucaacaggaguggcuuugaaacggucuaguuggcucaucguucugcuagugcugcucacggucucccugagcccagugcagucugcgcccguaggucauggcaagaccauagaaacuuaucaaacaagagagggguuuaccagcaucugucuuuucauguugggauccauucuguuuaucgugucaugcuuaguuaaaggccucgucgauagugugagcgacucuuucuuuccuggucuguccguguguaagacuugcucaauugggaguaucaacggcuucgaaauagagagccacaaauguuacugcucccuguuuuguugcccguauuguaggcacugcucugcagaucgcgagauucaucagcugcacuugucgaucugcaagaagcgaaaaacaggaagcaaugucaugcucgccguuuguaagcggaugugcuucaaagcuaccaucgaagccucacguagagcacugcuaauuagguccaucauuaacacgacuuucgugauauguauccugacccucgccauuugcgugguaaguacaucugcugucgagauggaagaccugccagccggcaccugggagcgcgaagaggaucuuacuaauuuuugucaucaggagugccaagugacagaaaccgaguguuugugccccuacgaagcacugguuuuacggaagccucucuuccuggacagcaucgugaaagggaugaagaaccuucuuaauuccacaucacuagagacuucucucagcauugaggcgccauggggagcuaucaacguccagaguaccuuuaagcccacgguguccacagccaauauagcacugagcuggucuucaguugaacacagaggcaacaaaaucuuggugaccgguagguccgagaguauuaugaagcuggaggaacgaacugggguaagcugggauuuaggagucgaagacgccucggagucuaaacuccugaccguguccaucauggaucuuagccagauguauucaccuguguucgaguaccugaguggcgaccgccaggucgaagaguggccgaaggcuacauguacuggugauugccccgaacgguguggcugcaccucuuccacgugcuugcauaaagaguggccacacagcagaaauuggagguguaacccuacauggugcuggggaguugggaccggcuguacuugcugugggguggacguaaaggaucucuuuacagaccacauguucauuaaguggaaaguggaauacaucaagaccgaggccauagucugcguggagcugacuucacaagaacgucaguguagucuaauugaggcaggaacacgcuuuaaucugggccccguuaccaucacgcuuagcgaaccacggaacauccagcagaaacucccucccgagauuauaacucugcauccaaagaucgaagaggguuucuuugacuugaugcacgugcaaaaaguccuguccgcuucuaccgugugcaaguuacagagcuguacacaugggauuccgggagaucuccagaucuaucacauuggcaaucugcuuaagggugacagaguuaacggccaucugauccacaaaauagagccucacuucaauaccuccuggaugucaugggaugggugcgacuuggauuacuauuguaacaugggagacuggcccucuugcacauacacuggcgugacccagcauaaccacgccgcguuugucaaucuccugaacaucgaaacggauuauacaaagacuuuccauuuucacaguaaaaggguaaccgcccacggggacacaccacaacuagaucugaaggcucgacccaccuacggagcaggcgagauuacugugcuuguugaaguggccgacauggagcuccauaccaaaaaggucgagaucucgggucugaaauucgcuagcuugacaugcacgggguguuaugccugcuccucuggaauuucauguaaggugcggauccacguagaugaaccugacgaguuaacugugcaugucaagagcuccgauccagacguuguggcagcgaguaccucucugauggcccgcaaacucgaauuuggcacagacagcaccuuuaaggcuuucucagccaugcccaaaacuucccugugcuuuuacauaguggagagagaauacuguaagaguugcagcgaggaugacacgaaaaagugugucgauaccaaacuugagcagccucagucuauucugaucgaacacaaagguacgaucauuggcaagcaaaaugacacuugcacagcaaaggcuuccuguugguuggagucaguuaagagcuucuuuuaugggcuaaagaacaugcugggaucgguguucggcucuuucuucguagggauccuccuguuucuuaccccguucguguuacugguccucuuuuucauguucggauggaagauauuguuuugcuucaaguguugcaggcggacccgaggccuguuuaaauacagacaucucaaggaugacgaagagacugguuaucgcaggauuaucgaacgucugaauaguaaaaaggggaaaaaccggcuucuggauggagagagauuggccgacaggaagauugcagagcuauucuccacaaagacccacaucggcuga

SEQ ID NO: 10395 - RNA, 5052 nt, Artificial Sequence
  derived and/or modified CDS sequence (opt3) from CCHFV(47-ST-2013)__KR814861.1__GP
augcacacccugcucgccugcuucauccuuuaccugcaguugagcggcuuagggggagcucauggucaauccaacgcaacagagcacaauggcacuaacacgaccacagugcccgggacuucucagucaccuaagccaccggccaguaccacacugccccauaccccugaaagcuccacugucaaacuaacaaccccaacgucugagacugaaggaucgggcgagaccacacccccuccaaauacuacccagggucuucccccuccagggacaaccccggaaagaucagcgacgacugcuacaagcaccaguuccacugacaacaugaacucuacaacccagaugacgggaaauacccccacaccuacuguuaauaugagcccauccucaagucccagcaugccuucuaccucccaaggcauucacuauccagugaggucacugcuuagcguacccaguccgaagacagccacuaccccuacacccgugucuccaggcgagauguccccugagaccagcucgcagcauucugcaacuucccggauacccacgcuguacacagccacccaggucucaacugaaaacaccaaucgcaguacaccacgacagagcaaauccucugugcaacccgcuacccagagcccuaucacuccaccggcacagacaauuuugcucaugucagccgcucccaaggccauccaggauaugcacccuaguccaacgaaccguuccaaaagaaaucuggagguugaaauuauccugacccucagccaaggguuaaagaaguauuacggaaaaauacugaagcucuugcaccugacucuagaggaggacacagaaggucuccuggagugguguaaaaggaaccuuggcucuaauugcgaugacgacuuuuuccagaagcggaucgaagaguuuuucauuaccggggaaggauauuuuaacgaggugcugcaguucaaaacauugucaacucucagucccaccgagccuagccauguccgccugccaacggcggaacccuuuaaguccuacuaugcaaagggcuucuuaucucuggauucggguuacuuuagcgccaaauguuacccgagauccucaaccagugggcuccaacuuaucaaugugacacagcacccugcuaggauugccgagacuccaggacccaagaccacaucucugaaaacuaucaacugcauaaacuugcgggcaagcguauucaaggaacaucgcgagguugaaauuaaugugcuacugccucagaucgcugucaaccucuccaauugucacguggugauuaacucacacgucugcgauuauccccuggacaccgauggcccaguucgacuuccuagaauccaucacgagggcacguuuauccccgggacauacaaaauugugauagacaagaaaaauaagcugaacgauagguguagcuugguaaccaauugcgugaucaagggacgggagguccguaaaggucagucugugcuccgccaauauaagacugaaauuaaaaucggcaaggccuccacagggaguagaaaacuguuaagcgaggaaccaggagacgauuguauaucuaggacccagcugcuaaagacugagaccgcggaaauucaugacgacaacuacggcgguccgggggauaagaucacaaucugcaauggcuccacgauuguugaccagcggcucggaucagagcugggcuguuauaccaucaaccgagugaaaaguuucaaacuuugcaaaaauagcgccacugggaagacaugcgagauugauucgaccccugucaaaugucgccagggauuuugcuugaagauaacacaagaagguagaggccacgugaagcuguccagggggucugagguaguucucgacgcaugugauagcucaugcgaaaucaugauucccaaaggaacuggcgacauccugguggauuguaguggugggcagcagcauuuccuuaaggacaaccugaucgauuugggcugcccacacauuccccuccugggaaaaauggcuauauacaucugucggauguccaaucacccucgcaccacgauggccuucuuauuuugguucucuuuuggcuaugucauuacaugcaucuucuguaaggcucuguuuuacagccuaauuaucauagggacccucggaaagaagaucaagcaguacagagagcugaaaccacaaacuugcaccauuugugagacagcccccgugaacgcaaucgacgccgaaaugcaugaucuuaauugcuccuauaacauuugcccuuacugugcuucaagguugacuagcgacggucuggcgcgucacgucacccagugcccgaagcggaaagagaagguggaagagacagaacucuaucugaacuuagagcgaaucccauggauaguuagaaaacugcuucaggugagugagucuacgggcguagcauugaagagguccagcuggcucauuguccugcuagugcugcucaccguuucgcugucacccgugcagucugccccugucgggcauggaaaaacuaucgaaacauaccaaacccgcgagggcuucacuagcauuugucuuuuuauguuggguuccauccuguucauagugagcugcuuaguaaaggggcucguggacucuguuagcgauuccuuuuucccaggccugucagucugucggacaugcaguaucggaagcauuaauggcuuugaaaucgagucucacaaguguuauugcucccuuuucuguugccccuacuguagacacugcucagcugacagggaaauucaucagcugcacuugaguaucugcaaaaagcgcaaaaccgggagcaacgugaugcucgccguguguaagcgaaugugcuuuaaagcaacgauagaggccucccggcgugcucuguucauuagaucuaucaucaauacuaccuucgucacauguauucuaacccuggccaucugcguugugucgacuagcgcaguggagauggaagaucucccugcgggaacaugggagagggaagaggaccugaccaacuuuugucaucaggaaugccaaguaacagagacugagugucuuugcccguaugaggcuuugguccugcgcaagcccuuauuccucgauucaauugugaagggcaugaaaaaucugcuuaacuccaccagucuggaaacgucucuaagcauagaagccccauggggugcaaucaauguucaguccacauuuaagccuaccgugucaacugccaacauugcucucucuuggagcagugucgagcaccgggggaauaaaauccuggugaccggaagauccgagagcauuaugaaguuggaagagaggacaggcguuucuugggaccuggguguggaagaugccucagaguccaaauuacucacuguaaguaucauggaccugagccagauguacucgcccgucuucgaauaccuuucuggcgaucgacagguggaggaguggccaaaggcaaccuguacgggggaaugcccugagcgcuguggaugcacauccaguaccugccugcauaaggaauggccccacucacggaacuggagauguaauccaacuuggugcuggggcguggggacaggauguaccugcuguggcgucgacguuaaagauuuguuuacugaccacauguucauaaaguggaaaguggaguauaucaagacagaagcuauuguaugcguggagcucaccagucaagagaggcaguguucucugaucgaagccgguacgcguuuuaaccuagggccggucacuauuacccuguccgagccucgcaauauccagcagaaacuucccccagaaauaauuacacuccaucccaagaucgaggaaggauucuuugaucugaugcacgugcaaaagguuuugagcgcgucaaccgugugcaaacugcagaguuguacacauggcaucccuggugacuuacagauuuaccacauaggcaaccuccugaagggggaccgggucaauggacaucuuauccacaaaauugagccacacuucaacacuagcuggauguccugggauggcugcgaccuggauuauuacuguaacaugggggacuggcccucuugcaccuauacgggagugacacagcauaaucacgccgcuuuuguuaacuugcucaauaucgagacugauuacaccaagacauuccauuuucacagcaaaagagugaccgcacacggcgacacuccucaacuggaucuaaaggccaggccgaccuauggugcuggggaaauuacaguccugguagagguggccgacauggaacuucauacgaaaaagguugagguguccggacucaaguucgcaucacuggcgugcacuggcuguuacgccugcucuagugguaucucguguaaaguccgaauacacguggaugagccagacgaauugaccguacaugucaagagcuccgaucccgacgugguugcugccucuacaucauuaauggcacggaaacuggaguucggcaccgauagcacuuuuaaggcuuucuccgccaugccuaaaacaagucucugcuuuuacaucguggaacgcgaguauuguaagucuugcagcgaagacgacaccaagaaauguguggauacgaagcuggagcagccccagucaauucuuaucgagcacaaagggacuauuaucggaaagcaaaacgacacaugcaccgcaaaagccuccuguuggcuggaaagugucaagagcuucuuuuacggcuugaagaauaugcuagggucuguguucggaaacuuuuucguuggcauacugcucuuucuggcuccauucguacuuuuagugcuguuuuucauguucgguuggaaaauucucuuuugcuucaaguguugcagaaggacccggggguuguuuaaauaucgacaucugaaggaugacgaggaaacuggauacagacgcaucaucgagaggcucaauuccaaaaagggcaagaaccgucugcuugauggcgaacggcuggcggacagaaaaauugccgaguuguucucaacaaagacccacaucggguga

SEQ ID NO: 10396 - RNA, 5052 nt, Artificial Sequence
  derived and/or modified CDS sequence (opt3) from CCHFV(1-CR/HU-2015)__KU161584.1__GP
augcacacccugcucgugugcuucauccuuuaccugcaguuguuaggccuagggggagcccaugagcaaagcaacgcuacagaccacaauagaacuaacacgauuaccgcacccuccacaucucagaauccuaagccaccggccucaacuacacccccucauaccccagaaaguagcaccauaaaacugaucacuuccacaggugaggcggaaggcucuggggagaccacgcccccucucaacacuacccagggaccauuucccccugaaacaacuucggagcacccagcuucaaccgccacaaauaccagcaguacgaacuccaugaacucuacuacacagaugaccgauaauacucugacaagcaccgucuccacgucacuuaguauuagcccgucuacccccuccacaucacaaggcauccauuauccuguuaggagccuguugagugugucuuccccaaagacugcagccacccccacaccuaugagcacucgggagaugucgucugaaaccuccucacagcacagugcuaugagccgcacaccaaccuuccacacugcaacgcagguauccacagagaaugccaaccgaucuacuccccgucagagcgaaucaagugcucaaccggccacccaguccccuaugaccagccccgcgcagucuauuuuucucgugucagcagccccaacaaccauccagaauauacauccuagucccacuaacagaagcaaaaggaaucuggagauggagaucauucugacacucccacaagguuuaaagaaauacuaugggaagauccugaaacuuuugcaccugacgcuagaagaggacaccgaaggacuccuggagugguguaaacggaaccuuggcuccaauugcgaugacgaguucuuucagaagcgcauugaagaguucuuuaucacuggcgaaggguacuucaacgagguccugcaguuuaaaacauugucuacccucucgcccacagaaccuagccaugcuagaccaccgacugccgagcccuucaaguccuauuuugcaaaaggauuccugucaauagauagugguuacuuuucugcuaaguguuauccuaggagcuccaccucaggcuuacaacugauuaacaucacgcagcacccagcccggauugcggaaacccccgggccuaagacaacuagccucaaaaccaucaauugcaucaaccuucgcgccucuguguucaaggagcaccgagagguugaaauuaaugugcuguugccacagauagcagucaaccuauccaauugucaugugguaaucaacagucacguuugcgacuacagccuggauacagacggacccgugagacucccgaggauuuaccaugagggcacuuucaucccugguaccuauaaaauagucauugauaagaaaaauaagcugaacgaccgguguacgcuugugacaaauugcgugaucaaagggcgugaaguccgcaagggacagucuguucugagacaauacaagaccgagaucaaaauuggcaaggcuuccacuggcucaaggaaauugcucagugaggaaccaggggaugacuguaucagccggacacagcuguuacgaaccgagacugccgaaauucacgaugacaacuauggaggucccggcgacaagauaaccaucugcaaugggucgacaauuguggaucagcgccugggauccgagcuaggcuguuacacgaucaacagaguaaaaucuuuuaagcucugcgaaaauagcgcuaccgguaagacuugcgagaucgacucaacaccugugaaauguaggcagggguucugccugaagauuacccaagagggccggggacaugucaaacuuagucgcggcuccgaagugguuuuggaugccugugacucuagcugcgaggugaugauacccaaggggacaggagauauccuggucgacuguuccgguggccagcagcacuuucucaaagauaaccugauugaccuugggugcccacacaucccucuguugggaaagauggcaauuuauaucuguagaaugucaaaucaucccaggacuaccauggccuuccucuuuugguucagcuuuggcuacgugauaacgugcaucuucuguaaggcucuguuuuauaguuuaauuaucauugguacacuggggaaaaagaucaaacaguaccgugaacuaaagccacaaaccugcacuauaugugagaccgcgccgguaaacgcaauugaugccgaaaugcacgaccucaacugcucuuacaauaucugcccuuauugugcuucccggcugacaagcgauggccuugcccgacauguuacucagugccccaaaagaaaggagaagguggaggaaaccgaguuguaccugaaccucgaaaggauuccauggaucguccgcaaacuguuacaggugucggagucaacaggagucgcacugaagcggucuaguuggcuuauaguguugcucguucugcuaacggugucccugagccccguacagucugccccugucggccacgggaaaaccaucgaaacuuaucaaacaagagagggauucaccagcauuugucucuuuaugcuggguuccauccuuuucauugugucaugcuugguuaagggccugguggacagugucagcgacuccuuuuucccaggguuaucuguguguaggacuugcucaaucggaaguauaaauggcuucgagauugaaagccacaaauguuacugcucccucuuuuguugccccuauugucgccauugcucugcugaucgagagauccaccagcugcaucuuucgaucugcaagaaacggaagacagguagcaacguaaugcuggccguguguaagcguaugugcuucagagcaaccauggaagcgucaaggcgcgcuuugcucauucgguccaucauuaauacgacuuuuguuauauguauccugacccuaacaauuugcgucgugaguaccucugccguggagauggaaaaccugccugcagggacuugggagagagaggaagaccucacaaauuucugucaccaggagugccaagucaccgaaacagagugucugugcccguacgaggcccuuguuuugaggaaaccacuguuuuuagauagcaucgugaagggcaugaaaaaccuccuuaauuccacuucacuggaaaccucucugagcauugaggcucccuggggagccaucaacgugcagaguacguucaagccuacaguauccaccgcaaauauagcucuaagcuggucuucagucgaacaucgaggcaacaaaauccucgugacugggcgcuccgagaguauuaugaagcuggaggaacggaccggaguuagcugggacuugggcguggaggaugccucggaaucuaagcuguuaacagucuccaucauggaccucagccagauguauucaccaguguuugaguaccugaguggugauagacagguugaagaguggcccaaagcgacuuguaccggggacugcccugaaagguguggaugcacgucuuccacaugccuucacaaggaguggccgcacagccguaauuggcgcuguaaccccaccuggugcuggggcguggguacuggcuguacaugcugugggguagaugucaaagaccuguucaccgaucauauguuugugaaguggaaaguggaguacauuaagacugaagccaucgucugcguugaguugacaucacaagaacggcaguguagucucauagaggcuggaaccagauucaaucugggcccagugacgauuacucuaagcgaaccuaggaacauccagcagaagcugcccccagagaucauuacccuucacccuaaaauagaggaaggguuuuucgaccucaugcauguacaaaaggugcuguccgcaucuacagucugcaaauugcagagcuguacccacggaauccccggcgauuuacagguguaucauauugguaaccugcucaagggggaccgaguuaauggacaccugauccacaaaauugagccacauuuuaacacauccuggaugucaugggacggcugcgaucuugacuacuauuguaauaugggugauuggccgucuugcacuuacaccggcgugacgcagcacaaccaugccgcuuucgucaaucuguugaacaucgaaacagacuauacuaagaccuuccacuuucacaguaagcgggugacagcccauggggauaccccucaacucgaccugaaagcacgccccacuuacggagcgggcgagauaaccguucuaguggaggucgccgauauggaacugcacacaaagaaaguagagaucucggggcuuaaguucgcuagccucgccugcacgggauguuaugcaugcuccucuggcauuucauguaaagugagaauccauguugacgaaccagaugagcugacugugcacgucaagagcuccgaccccgaugugguagcugccaguaccucuuugauggcaaggaaauuagaauuugguacagacagcaccuucaaggccuuuucagcuaugccuaagacuucccugugcuucuacauuguggagcgggaguacuguaaaaguugcagcgaagaugacacaaagaaaugugucgacaccaagcucgagcagccacagucuauccugauagaacauaaagggacgauuaucggaaagcaaaaugauacuugcacagcgaaggccuccuguuggcuugagucaguuaagagcuuuuucuauggccugaagaacauguuggguucgguguuuggcaauuucuuuaucgggauucuacuguuccucgcacccuucgugcugcuugucuuauuuuucauguuuggauggaaaauccuguucugcuuuaaguguugccgaagaacccgcggccucuucaaauacaggcacuugaaggacgaugaagagaccggguaucgucggauaauugagagacugaacaauaagaaaggaaagaacaggcuccuggacggcgaacgccuugcugaucgaaaaaucgccgagcuguuuucuacuaagacacacauugguuga

SEQ ID NO: 10397 - RNA, 5049 nt, Artificial Sequence
  derived and/or modified CDS sequence (opt3) from CCHFV(3820-ST-2007)__KR814868.1__GP
augcacacccugcucgugugcuucauccuuuaccugcaguugagcggcuuagggggagcccauggucaauccaacgcuacagagcacaauggcacuaacacgaccacaguccccgggacuucucagucaccuaagccaccggcaaguaccacacugccccauaccccugaaagcuccacuguuaaacuaacaaccccaacgucugagacugaaggaucgggcgagaccacacccccuaauacuacccagggucucccacugcccgggacaaccccugaaagaucagccacgacugcgacaagcaccaguuccacugacaacaugaacucuacaacccaggugacggauaauaccccaacaagcacuguauccauuucaccgaguucaucuuccucaaugcccagcaccagucaaggaauacaccauccugugaggucucuucuguccgucagcucgccaaagacagugacuacccccacaccuaugucuccaggcgagaugucccccgagaccucaagucagcacagcgcuaugucccggguuccgacuuuguauacggccacacagaucucuaccgaaaauacugaccgcagcaccccucgacagucagagaguuccgugcaacccgcaacacagagcccaauuaccucuccugcccagacuauccuccugaugucagcugcacccaaagccauucaggauaugcacccaagucccacaaaccguagcaagagaaaucuggaagucgagaucauacucacguuaucccaaggccugaaaaaguacuaugggaagauccuuaaauugcugcaucuaacccucgaggaagacacugagggacugcuugaaugguguaagaggaaccuggguucuaauugcgaugacgacuuuuuccagaaacggauugaggaauuuuucaucacaggcgagggguacuuuaacgagguguugcaguucaagacccucucgacacugagcccuacugaaccaucccacguacgcuuaccgaccgcugagcccuuuaaaucauauuucgccaagggauuucugaguauugauucuggcuacuucagcgcgaaguguuauccuagauccucaacgagcggucuccaacuuaucaauguuacccagcauccagcaaggauagccgaaacacccgggccuaaaacuaccucucugaagacaauuaacugcaucaauuugcgggcuuccguguuuaaagagcaccgcgaagucgagauuaacgugcuacugccacagaucgccgugaaccucaguaauugucacgucguuaucaacagccaugugugcgauuacucucuggacacugauggacccguacgacuuccgagaauacaccaugagggcaccuucauuccuggcacguacaagaucgugauugacaggaaaaauaagcugaacgaucgguguuccuuggucacaaauugcgugaucaaagggcgugaaguucgcaagggacagucagugcucagacaauauaagaccgagauaaaaauugguaagacaaguacaggcagcaggaaacuguuaucggaggaaccaggggacgacuguaucucccggacccagcugcuaaagacugaaaccgcagagauccacgaugacaacuacggaucucccggcgauaaaauuacaaucugcaaugguagcacgauugucgaccagcgacucgggucagagcugggcuguuauaccauaaaccgcgugaagaguuuuaaacuuugcgaaaauuccgcuacuggaaaaacaugcgagaucgauucuaccccuguaaaguguagacagggcuucugcuugaaaauuacacaagaagggaggggacauguuaagcugagccgggguuccgaggugguccucgacgccugugauucaagcugcgagaucaugauccccaaaggcacuggggacauucugguggauuguaguggaggccagcagcacuuccuuaaggacaaccugauagauuuggguugcccacacaucccucuccuggggaagauggcgauuuacaucugucgcaugucuaaucaucccagaaccacgauggccuuuuuauucugguuuuccuucggcuaugucauuacaugcaucuuuuguaaagcacuguucuacagccuaauaaucauuggaacccucggcaagaaaaucaagcaguauagggaacugaaaccacaaacuugcaccauuugugagacagcuccggugaacgccaucgacgcugaaaugcacgaccuuaauugcucguacaacauaugcccuuacugugccucacguuugacuucugaugggcuggcacggcauguuacccagugccccaagcgaaaggagaaaguggaagagacagagcucuaucugaauuuagaaaggauuccauggaucguaagaaagcugcuucaggucagugaguccacgggaguggccuugaaacgcagcucuuggcucauuguucugcuagugcugcucgcugucagccugucccccgugcagucagcgccuguaggucacggcaagaccaucgaaacuuaccaaacacgggagggguuuaccaguauaugucuuuucauguugggaagcauccuguuuauugugucuugcuuaguuaaaggccucgucgacuccgugucagauaguuucuuuccaggucugagcguguguaagacuugcuccaucgggucuauuaacggcuucgaaaucgagucgcacaaauguuauugcagccucuuuuguugccccuacuguagacauugcucagcagacagggagauacaccagcugcauuuguccauuugcaagaagcgcaaaacaggaaguaacgucaugcucgccguuuguaagcgaaugugcuucaaagcuaccaucgaagccucucggcgugcacugcuaaucagaagcauuaucaauacgacuuucgugauguguauucugacccucgccauaugcgugguauccacaucagcugucgagauggaagaucugccugccggcaccugggagagggaagaggaccuuacuaacuuuugucaccaggagugccaagugacagaaaccgaguguuugugcccguaugaagcacugguuuuacgcaagccacucuuccuggauucuaucgugaaagggaugaagaaucuucugaacagcacaagucuagagacuucccucagcauugaggcgcccuggggagcuaucaauguccagucuaccuuuaagccuacggugucaacagccaacauugcacuguccuggaguagcguugaacaucggggcaauaaaaucuuggugaccgguagaucggagucuauaaugaagcuggaagagaggacugggguauccugggacuuaggagucgaagaugccagcgagucaaaacuccugaccgugaguaucauggaccuuucucagauguacuccccaguguucgaguaucugagcggcgaucgacaggucgaagaguggcccaaggcuacauguacuggugacugcccugaacgcuguggcugcaccucaaguacgugcuugcacaaagaguggccgcacagccggaacuggagauguaaucccacauggugcuggggaguugggaccggcuguacuugcugugggguggauguaaaggaccucuuuacagaccauauguucauuaaguggaaaguggaauacaucaagaccgaggccauugucugcguggagcugacuucccaagaaaggcaguguucucuaaucgaggcaggaacacguuuuaaccugggcccaguuaccauaacgcuuagcgaaccucgcaauauucagcagaaacuucccccagagaucaucacucugcacccuaagauugaagaggguuucuuugauuugaugcaugugcaaaaaguccuguccgcuucaaccgugugcaaguuacagucuuguacacacgggauacccggagaccuccagaucuaccauauuggcaaccugcuuaagggugaucggguuaauggccaccugauccacaaaauugagccacauuucaacaccaguuggaugucgugggacgggugcgauuuggacuauuacuguaauaugggagauuggccgagcugcacauauacuggcgugacccagcacaaccaugccgcguuugucaaccuccugaauaucgaaacggacuacacaaagacuuuccacuuucacuccaaaagaguaaccgcccauggggauacaccucaacuagaccugaaggcuaggcccaccuauggagcaggcgagauaacugugcuuguugaaguggccgauauggagcuccacaccaaaaaggucgagaucucuggucugaaauucgcuucauugacaugcacgggguguuacgccugcagcuccggaauuaguuguaaggugcgaauccauguagacgaaccagaugaguuaacugugcacgucaagucuagcgaccccgacguuguggcagcgucaaccucccugauggcccggaaacucgaguucggcacagauaguaccuuuaaggcuuucagcgccaugccuaaaacuucucugugcuuuuauauuguggaacgcgaauacuguaaguccugcucagaggacgauacuaaaaagugugucgacaccaaacuugagcagccacagagcauccugauagaacauaaagguacgauuaucggcaagcaaaacgauacuugcacagcaaaggcuucguguugguuggagucugugaagaguuucuuuuacgggcuaaagaauaugcugggauccguuuucggcagcuuuuucguagggauccuccuguuucuugcccccuucguguuacugguccucuuuuucauguucggauggaagauuuuguuuugcuucaaguguugcagaaggacccggggccuguuuaaauaucgacaccucaaggacgaugaagagaccgguuacagacgcaucauagaaaggcugaacagcaaaaaggggaaaaaucgucuucuggacggagagcgguuggcagauagaaagauugccgagcuauucuccacuaagacacacaucggcuga

SEQ ID NO: 10398 - RNA, 5052 nt, Artificial Sequence
  derived and/or modified CDS sequence (opt3) from CCHFV(Ast199)__KX056051.1__GP
augcacacccugcucgugugcuucauccuuuaccugcaguugagcggcuuagggggagcccauguccaauccaacgcuacagagcacaaugguacuaacacgaccacaguucccggcacuucucagucaccuaagccaccggcaaguaccacacugccccauaccccugaaagcuccacugugaaacuaacaaccccaacgucugagacugaagggucgggagagaccacacccccuccaaauacuacccagggccugcccccuccagguacaaccccggaaagacccgccacgacugcgacaaccacuucaagcacagacaacaugaauaguaccacgcagguaaccgauaacacaccuacuuccaccgugucuauuagcccauccucaaaucccaguaugccuagcacaucucaagggauacacuauccagucaggucccuccuuucagugagcagucccaagacuguuaccacaccgaccccuaugucucccggagagauguccccagagacuagcucgcagcauucugcuaugucccggaucccuacgcuguacacagccgcacaggugucaaccgaaaacacuaaucgcaguacuccccgacagagcgaguccucugcccaaccagcuacacagagccccaccacuuuuccugcacagacaauuccauugaugucagccgcuccgaaagccauccaggacaugcaccccaguccuacgaaccguuccaagagaaaucucgaagucgagauuauccugacccugagccaaggccucaaaaaguauuacggcaagauauuaaaacugcuucacuugacucuggaggaagauacagaggggcuacucgaaugguguaagaggaaccugggaucuaauugcgacgaugacuucuuucagaaacggaucgaggaguucuuuauuaccggugagggcuauuucaacgaggugcuucaguuuaagacaccaucaacucugagucccaccgaaccuagccauguacgcuugccaacggcggagcccuucaaauccuacuuugcaaagggguuccucucuaucgauucgggauauuuuagcgccaaguguuacccgagauccucaaccaguggccugcaauuaauuaauguuacacagcacccugcuaggaucgccgaaacuccaggucccaaaaccacaucucugaagacuauaaacugcauuaaccuccgggcaagcguguucaaagagcaucgcgaagucgagaucaaugugcuucugccucagauugcugugaacuuguccaauugucacgucguuaucaacucacacgugugcgacuacagccuagauaccgacgggcccguacgacugccaagaauccaucacgagggaacguuuauuccuggcacauauaagauagugaucgauaaaaagaauaaacucaacgacagguguucucuggucaccaauugcgugauuaagggccgggaaguucguaaggggcaguccgugcuucgccaauacaaaacugagaucaagauaggaaaagccaguacagguagcagaaagcuguugucugaagaacccggcgaugacuguauuuccaggacccagcuccugaaaacugaaaccgcggagauccaugacgauaacuaugggggaccaggcgacaagaucacaauuugcaaugguucaacgaucgucgaucagcgguuagggagugagcugggcuguuacaccauuaaccgaguaaagagcuucaaacuaugcgaaaauucggccacuggaaagacaugcgagauagacuccaccccgguaaaaugucgccagggcuucugccucaagaucacacaagaagggagaggacacguuaaacugucuagggguagcgaggugguccuugaugcaugugacucaaguugcgagauuaugaucccuaagggcacuggggauaucuugguggacuguuccggaggccagcagcauuuucugaaggauaaccucauugaccuggguugcccccacauaccacuucuggggaaaauggcuaucuauauuugucggaugucuaaucacccccgcaccacgauggccuucuuguuuugguucagcuuuggcuacgucaucacaugcauuuucuguaaggcucucuuuuauucccugaucauaaucggaaccuuaggcaaaaagauuaaacaguacagagaacugaagccucaaacuugcaccaucugugagacagccccagugaacgcaauugaugccgaaaugcaugaccuaaauugcucauacaacaucugccccuauugugcuagcaggcucaccagugacgggcuggcgcgucacguuacccagugcccuaagcggaaagagaagguggaagagacagagcuuuacuugaaccuggaacgaauaccguggauuguaagaaaacuccugcaggucucugaguccacgggaguggcauuaaagagguguagcuggcugaucguucuuuuggugcuccugaccgucucgcuaucaccagugcagucugcccccguaggucauggcaaaacuauugaaacauaucaaacccgcgagggguucacuaauaucugccuguuuaugcucggaaguauacuguucaucguguccugucuuguuaagggcuuggucgauagcgugucugacagcuuuuucccuggucuguccgugugcaaaacauguucaauugggaguaucaacggcuuugaaauugagagccacaagugcuacuguucuuuauucugcuguccauauugccggcacugcuccgcugauagagagauccaucagcuccaccugggaauauguaagaaaaggaagaccggcucaaaugucaugcuugccguuugcaaacgcauguguuucaaggcaacgauugaagccagucgacgggcucuguugauccguagcaucauuaacacuaccuuugugaucugcauucucacacuggccauaugugugguauccaccucugcagucgagauggaaaaucuacccgcggggacuugggagagagaagaggaccugacaaacuucugccaucaggagugucaagugaccgaaacagagugccucuguccuuacgaagcucugguucuuaggaaaccguuguuucuggauucgaucgugaagggaaugaagaauuuacucaacagcacuucacuggagaccucccuuaguauugaggcccccuggggcgcaaucaauguccagucuacguucaaaccaacagugagcaccgccaacauugcucuguccuggucaucuguugaacaccgcgguaauaagauccuagugacugggcggagcgagaguauaaugaaacucgaagagagaaccggaguauccugggaccugggcgucgaagaugccagcgagucuaaguugcugacagugucaaucauggacuuaucccagauguauaguccuguguuugaguaccucagcggugauaggcaggucgaagaguggcccaaagcaacuugcaccggcgacuguccagaacgaugcgggugcacgucgucuacaugucugcauaaggaguggccucacucccgcaacuggcggugcaaucccaccugguguuggggaguuggcacugggugcacauguugcggaguggauguaaaggaccuuuucaccgaucacauguuuauuaaauggaagguggaauacaucaaaacugaggcuauugucuguguggagcugacaagccaagaaagacagugcucauugaucgaggccggcaccagguucaaccucgguccaguuacgauaacucugagugaaccgcguaauauucagcagaagcuaccucccgagaucaucacccugcauccaaaaauugaagagggguuuuucgaccuuaugcacgugcaaaagguccucucugcguccacaguguguaagcugcagagcugcacccauggaauacccggcgacuugcagaucuaucacauugguaaccuguuaaaaggcgaucgccucaacgggcaucugauccacaagauugagccucacuuuaauacaucauggaugaguugggacggaugugaucuugacuacuauugcaacaugggcgauuggccaagcugcacuuacaccgggguuacgcagcauaaucacgccgcuuucgugaaccuguugaauaucgaaacagacuauacuaaaaccuuucauuuccacuccaagcgggucacagcacacggagauacuccccaacucgaccugaaagccagaccuaccuacggcgcuggugagauaaccgugcuaguggaaguugccgauauggagcugcauacaaagaaaguggaggucucugggcuuaaguucgcaagccucgcguguacgggaugcuaugccuguuccucaggcaucucuugcaaggugaggauucacguagacgaaccggaugagcugacugugcaugucaaaaguucggacccagauguuguggcugccagcaccuccuugauggcacgaaaguuagaauuugguacagacucuaccuucaaggcuuuuucagccaugcccaaaacuagccuguguuucuacaucguggagcgggaauacugcaaauccuguagugaggacgauacaaagaagugcgucgacaccaaacucgagcagccucagucuauucugaucgaacacaagggcacgauaauugggaaacaaaacgauacuuguacagcaaaggccagcugcuggcuugagucagugaaauccuuuuucuauggacugaagaauauguugggcaguguuuuugggaacuucuuuguaggaauccuacuguuccucgcucccuuugugcugcuugucuuauucuucaucuuuggcuggaagauucuguucuguuuuaaaugcugccgcagaaccaggggucucuucaaguaccggcauuugaaagacgaugaagagaccggguaucgaaagaucauagaaagacugaauagcaaaaagggaaagaaccgccuccuggacggcgagaggcuugcggaucguaaaauugccgagcuguuuucuacuaagacacacaucggcuga

SEQ ID NO: 10399 - RNA, 5052 nt, Artificial Sequence
  derived and/or modified CDS sequence (opt3) from CCHFV(Turkey200310849)__DQ211636.1__GP
augcacacccugcucgugugcuucauccuuuaccugcaguuguuaugucugggcggggcccauggacaacuaaacacaacugagcacaaugguacgaacaauaccacagcucccggcgcaagccaguccccuaagccaccgaugucuacuacucccccucaugccccagaaucaaguacaauuaaacccaccacuccuauaagcgaggcggaaggguccggagagacaaccucuacgccaaacacuacccagggccucucgucacccgaaacaacuagcgagagaccugcuaccacagccaucaguaccuccucuacggacagcacuaauccaacaacccagaugacugauaacacaccgacccugacggucuccaccucacccaguagcucuccuuccacaccaucaacuccccaagguauuuaucacccugcaaggagccuucugaguguuucuuccccaaagaccgugacaacucccaccccgacaagcccuggggagaugucgucugaaaccuccucacagcauagugccaugagccggauccccacuccacacacggcuacacgcguauccaccgagaauacuaaccacucuaccccucgacagagcgaaucaagugcacagcaaacaacccccuccccaaugacuagccccgcccagucuauuuugcucaugucagcugccccuacagcggugcaggacauccauccaaguccgacgaaucguagcaaaagaaaccuggagaccgagauaauccugacucucucccagggauuaaagaaauacuauggcaagauucugaagcuguugcaccugacacuagaagaggauaccgaaggccuccuggaguggugcaaaaggaaucuugggucuaacugugacgaugacuuuuuccaaaagcggaucgaagaguuuuucaugacaggagaggguuacuuuaaugaaguccugcaguucaaaacuuugucgacccucagccccacggagccuucccaugcacgccugccaaccgccgaacccuuuaagucauauuucgcuaaaggcuuuuuaaguauugauucuggguacuucagcgccaagugcuauccuagauccucagcaagcggacugcagcucaucaacgugacacaacacccagcuaggauagccgagacucccggcccgaagaccacaucucuuaaaacuauuaauuguaucaaccugcgggcguccguuuuuaaggaacaccgcgagauugagaucaacguguugcuaccucagaucgccgucaaucugaguaacugccaugugguaauuaauagccacguuugugacuacucucucgauaccgacgguccagugcgacugcccagaauauaccaugaagggacguucaucccuggaacauauaaaauugucaucgauaagaaaaacaaacuuaaugacaggugcacccuggugacuaacugugugauaaagggccgggagguccguaagggccaguccguuuugcgccaguacaagacagaaauuaaaaucgggaaggcaucaaccggauuuagaaaacuccugagugaggaacccggugaugacugcaucagcaggacucaauuacugcggaccgagacagcugagauucacgacgauaauuauggcgggccaggagacaagaucacgauuuguaacggcucgaccauaguggaucagcgacuagguuccgaacucgggugcuacacuaucaaucgcguaaaaucuuucaagcugugcgagaacagcgccacaggcaagaccugugaaguggacucaacaccugucaaaugcagacagggauucugucuuaagauuacucaggagggcagggggcaugugaaauugagucggggauccgagguugugcuggaugcuugcgacucuagcugugaagucaugauccccaaggguaccggcgauauccucguggacugcuccgggggacaacagcacuuucugaaagauaaucuuauugaccugggcuguccacacauaccguugcucgguaagauggccaucuauauuugccgcaugucaaaccauccuagaacgacaauggcauuccuguuuugguucagcuuuggguacguaaucaccuguauuaguugcaaggccuuauucuauucucugaucauaaucggcacucuagggaaaaagauuaaacaguacagggagcucaagccccagaccuguacaaucugcgaaacugcuccaguuaaugcgauugaugcagagaugcacgaccugaacugcuccuacaauaucugucccuauugcgccagccgucuuaccucggacggcuuggcucggcaugugacacaauguccuaaacgaaaggaaaaggucgaggagacggaacuguaccucaaccuggagagaauaccauggauugugaggaaauuacugcaggucucagaaucuaccgggguggcccuuaagcgcaguuccugguugaucguucuccuggugcuacugacuguaagccucucucccguccagagcgcaccugugggacacgguaaaacaauugagaucuaucagacccgggaaggcuuugccuccauaugccuguucaugcuugggucaaucuuguuuauuguuaguugucuggugaagggauuagucgauagcgugucugacuccuucuuuccgggccucucaguaugcaaaacuuguaguaucgguagcgugaacggguucgagauugagucccacaagugcuacuguucucuguuuugcuguccauauugcagacauugcucggcugauagggaaauccaccaacuucaucugagcauauguaaaaagcgcaagacaggcucaaauguuauguuggccgucugcaaacgaauguguuuccgggcaaccauugaggcgucccguagagcucuccugaucaggaguaucauuaacacgacuuucgugaucugcauucuaacccugacaauauguguggucucuaccagcgccguugaaauggagaaucuccccgcaggaacuugggaacgcgaggaggaccugacaaacuuuugccaccaggaaugucaggugaccgagacagaaugccuuuguccuuacgaggccuuggugcugcggaagccauuauuccucgauuccaucguaaaaggcaugaagaaucugcuuaacucaacuucucuggagaccagccuaaguauugaagcucccuggggagccaucaauguccaauccacguuuaaaccugcagugagcacagcuaacauugcccucucuuggucauccguugagcauagaggaaauaagauccuggugaccggcaggagugaaagcauaaugaaguuggaggaacgaacuggugucucgugggaccuggggguggaggaugcgucugaguccaaauuacucaccguuagcaucauggaccugucacagauguauaguccgguguucgaauaccuuucuggagaucgccagguagaggaauggcccaaggccacaugcacuggcgacuguccagagcggugcgguugcaccuccagcacgugucugcacaaagaauggccucacucaagaaacuggaggugcaaucccacaugguguuggggcgucgggaccggaugcacuuguugcggcguggaugugaaggacuuguuuacagaucauauguucgucaaauggaagguugaguacauuaagaccgaggcuaucguguguguagaacucaccagucaggagcgucaaugcagccugauugaagcagggacacgcuuuaaccuaggaccagugaccaucacgcuguccgagccucggaauauacagcagaaacuucccccagaaauuaucacucuccacccgaagaucgaggagggcuucuuugaccugaugcauguccagaaaguguugucugccagcaccguuuguaagcugcaauccugcacacacgguauuccuggggacuuacagguguaucauauaggaaaccuccugaaaggcgauagagucaauggucaccuuauccacaagauugaaucacauuucaacaccucuuggaugaguugggacggcugugaucuggacuacuauugcaacaugggggauuggcccucgugcacauacacuggagugacccagcacaaucaugcugccuuuguuaacuugcucaauaucgagacggacuauacaaagacuuuccacuuucacagcaaaagggugaccgcacauggcgauacaccacagcuggaccuaaaggcgcgacccaccuacggggccggagaaauuacuguccugguagagguggcugauauggagcuucacaccaaaaagguugaaaucuccggccucaaauucgccucucuggcauguacagguugcuaugcuuguucaagcgggauauccugcaaggugcggauccaugucgacgagccugaugaauugacggugcacguaaaaaguucugacccagauguggucgccgcaagcacuucauuaauggcccgcaagcuggaguucggaaccgacuccacauuuaaggcuuucagugcgaugcccaaaaccagccucuguuuuuacauuguugaaagagaguacugcaagucuuguuccgaggacgauacucaaaaaugcguggacacaaggcuggaacagccucagucaauccuuauugagcauaagggcaccaucauagguaaacaaaacgauacguguacugccaaggcaagcugcuggcuggaaucggugaagucuuucuuuuauggcuugaaaaauaugcuagggagugucuucggaaaccuguuuauuggcauccuccuguuccuugcuccguuuguguuacugguucucuucuuuauguucggguggaagaucuuguucuguuuuaaaugcugccggcgaacaagaggacuguucaaguaccgccaccucaaagacgaugaggaaaccggcuauaggcguauuaucgagcggcuuaauuccaagaaggguaaaaacagacuucuggacggggauagguuggccgaccgcaagauagccgagcuauuuagcaccaaaacucacauuggauga

SEQ ID NO: 10400 - RNA, 5052 nt, Artificial Sequence
  derived and/or modified CDS sequence (opt3) from CCHFV(5170-R-2011)__KR814873.1__GP
augcacacccugcucgugugcuucauccuuuaccugcaguugagcggcuuagggggagcccauggucaauccaacgagacagaacacaauggcacuaacacgaccacaguccccgggacuucucagucaccuaagccaccggcuaguaccacacugcagcauacccccgagagcuccacuguuaaacuaacaaccccuacgucugaaacugagggaucgggcgaaaccacaccacccccuaauacuacccagggucucccacccccugggacaaccccagagagaucagcaacgacugccacaagcaccaguuccacugacaacaugaauaguacaacccaagugacggauaacaccccgacaagcacuguauccauuucacccaguagcucuccuuccaugccaucaaccagccagggaauacacuaucccaucaggagucugcuuucuguguccagcccuaagacagucacuaccccaacacccauuucgccgggcgagaugucuccugaaaccuccucacagcauagugcgaugagccggauccccacucuguacacggcuacacagguguccaccgagaauacuaaccgcucuaccccacgacaaagcgaaucaaguguucagccugccacacagucccccauuaccagcccagcacagacuaucuugcucaugucugccgcucccaaagcaauacaagacaugcacccuucaccaacaaaucguaguaagagaaaccuggagguggagaucauucugacgcucagccagggccugaaaaaguauuacgggaagauccugaaacuuuugcaccugacccuagaagaggauacugaaggacuccuggagugguguaagaggaaucuugguuccaacugcgacgaugacuuuuuccagaaacggauugaagaguuuuucaucacaggcgagggguauuuuaaugaaguccugcaauucaagaccuugucuacacucucgccgacugagcugagccaugugcgcuuacccaccgccgaaccuuuuaaauccuacuucgcuaagggauuucugucaauagauaguggcuauuucucugccaaguguuacccaagaagcuccacgucaggucuccagcuuauuaacguaacccagcaccccgcgaggaucgcagagacaccugggccaaaaacuaccagccugaagacaauuaauugcaucaacuugcgggccucuguuuuuaaagaacaucgcgagguggagaucaacguccuacugccccagauugcugugaaucucuccaacugucacguggucauaaauagucacguuugcgacuacagccuggauacugacggaccggugcgacuuccuagaauccaucacgaaggcaccuucauuccaggcacguauaagaucguaauagauaaaaagaacaaacugaaugacagguguucuuuggugacaaacugcgucauuaaggggcgggaggugcguaagggacaauccguucuccgccaguacaaaaccgaaaucaagaucgguaaagccucaacuggcaguagaaagcuguuaagcgaggaacccggggaugacuguauuucgaggacacagcugcuaaaaaccgagacugcagagauccaugacgauaauuauggaggcccuggugacaagauuaccauaugcaacggguccacaaucguggaucagcggcucggcucugaacugggauguuacacgauuaaucgagucaagagcuuuaaacuuugcgagaacucagcuaccggcaagacuugcgaaaucgacaguacacccgugaaaugucgccaaggguucugcuugaagaucacccaggagggaagaggucacguaaaacuguccaggggcucugagguugugcucgaugucugugacagcuccugcgaaauuaugauaccaaaggggacaggagauauccugguggacuguucaggcggucagcagcauuuccuuaaggauaaucugauugacuuggggugcccucacaucccccuccugggcaaaauggccauuuauaucugucggaugagcaaccacccacgcacuaccauggcguuuuuauucugguuuaguuucggauacgucauaacgugcaucuuuuguaaggcccuguucuauucucuaauuaucauuggcacacucgggaaaaagaucaaacaauacagagagcugaagccgcagaccugcacuauaugugaaaccgcaccugugaaugcuauugaugccgagaugcaugaccuuaacugcuccuacaauaucugccccuauugugcuagcagguugacaucggaaggacuggcccgucacguuacucagugcccaaagcggaaagagaagguggaggaaaccgagcucuaccugaacuuagaacgaauccccuggauuguaagaaaacugcuucaggucucagagucuacagguguggcauugaagaggaguuccuggcucauaguucugcuagugcugcucacggucagccugucuccugugcaaagcgccccaguaggccaugggaaaaccaucgaaacuuaucagacacgcgagggauuuaccuccauuugucuuuucauguugggcucaauccuguuuauugugaguugcuuaguuaagggucucgucgacagcgugucugauuccuucuuucccgggcugucaguguguaaaacuugcaguaucggcagcauaaacggauucgagauugaaucccacaaguguuacugcucucuguuuuguugcccuuauugucggcacugcucggcugacagagagauccaucagcugcacuugagcaucugcaagaaaaggaagacaggcucaaaugucaugcucgcgguuuguaaacgcaugugcuucaaggcaaccauugaagccucccgacgggcucugcuaauccguaguauuauaaacacgacuuucgugaucuguauucugacccucgccaucugcgugguaucuacaagcgcagucgagauggaagaucugccggccgggaccugggagagagaggaagaccuuacuaauuuuugucaucaagagugccaggugacagaaaccgaguguuugugcccauacgaggcucugguuuuaaggaaaccccucuuccuggauuccauugugaagggaaugaagaaccuuuuaaauucaacaucucuagaaacuagccucaguaucgaggccccuuggggcgcaauaaacguccaguccaccuuuaaaccaacggugagcacagcgaauaucgcucugucuuggucauccguugaacaccgcgguaacaagauuuuggugaccgggcggagugagagcaucaugaaacuggaagagagaacuggaguaucgugggacuuaggcgucgaggaugccucugaauccaagcuccugaccgugagcauuauggaccuuucacagauguauagucccguguucgaguaccugucuggugauaggcaagucgaagaguggccuaaagcaacauguacuggcgacugcccggaacgaugugggugcaccuccagcacgugcuugcauaaggaguggccccacucacgcaauuggcgguguaacccaacauggugcuggggaguuggcaccggguguacuugcuguggaguggauguaaaggaccucuuuacagaucacauguucaucaaauggaagguggaguacauaaaaaccgaagccauugucugcguggagcugacuucucaggaaagacaguguagccuaaucgaggcuggcacaagguuuaaucuggguccuguuaccaucacgcuuuccgaaccccguaacauucagcaaaagcucccaccugagauaaucacucugcaucccaaaauugaggaaggguucuuugacuugaugcacgugcagaagguccugucugccagcaccgugugcaaguuacaguccuguacacauggaaucccaggcgaccuccagauuuaucacaucgguaaucugcuuaaaggcgaucgcguuaacgggcaucugauacacaagaucgagccgcacuucaauaccucauggaugucuugggacggaugcgauuuggacuacuauuguaacaugggcgauuggccuaguugcacauacacuggggugacccaacauaaccacgcagcuuuugucaaucuccugaacauugaaacggacuauacaaaaacuuuccauuuucacucgaagcggguaaccgcccacggagauacaccccagcuagaccugaaagcgagaccaaccuacggcgccggugagaucacugugcuuguugagguggcugauauggaacuccauaccaagaaagucgagauuagcgggcugaaguucgcauccuugacaugcacgggauguuaugccuguucuucaggcaucagcugcaaggugaggauacacguagacgaacccgaugaguuaacugugcaugucaaauccagugacccugauguuguggcugccucuaccagccugauggcacgaaagcucgaguucgguacagacucaaccuuuaaagcguucuccgccaugccaaagacaagucugugcuuuuacauuguggaacgggaguacuguaaaagcugcucugaagacgauacuaagaagugugucgacaccaaacuugagcagccccaauccauccugaucgaacacaagggcacgauuaucgggaaacagaaugauacuugcacagcuaaggccucauguugguuggagagcgugaaaucguucuuuuauggacuaaagaacaugcugggcucuguuuucggguccuuuuucguaggaauacuccuguuucuugcaccuuucguguuacugguccucuuuuucauguucggcuggaagauuuuguuuugcuucaaauguugccgcagaaccaggggucuguuuaaguaccggcaucucaaagacgaugaagagaccggguaucgaagaaucauugagcgccuuaauaguaagaaaggaaagaacaggcuucuggacggcgaacguuuggcugaucggaagaucgccgagcuauucagcacuaaaacacacauaggcuga

SEQ ID NO: 10401 - RNA, 5055 nt, Artificial Sequence
  derived and/or modified CDS sequence (opt3) from CCHFV(SCT ex Afghanistan)__KC344856.1__GP
auguacacccugcucgugugcgccauccuuuguccccagccuuggagccuggagggcacacacgucccauugaacgggacuaagcauaauggaacggguauuaccgcugcaccgggcgggucccaaggacccacaucuccugccucaacugcgguuaguuuaaccccagaccccuucacaaccgaaccuacugcuagcgccguggagcuggaauccucuggcgagggucacacaucgcuaucaguaaccacgcaggggcucacuagcccagaaaccacacccggacugccuacugugaccgauacaggcgucaguuccaccucuauauuuggcaucgggauuagaguggcaggagacacgccaacuagcacaacccauacuggucuuccguccucacccaguaugccuagcacagcccagggcccacaccaugcuguuagggggcuguugucuguguccucaacccggcccggagaggcaagcacgaucaccgucccuggcgaggccgguacagaagcuaacaguucuuccagcgccauuucgaaaaagccagcgcccucuccgacugcagaggccaucaccgaagcuaauaacuccucaaauccucgccagcccgagcucaguacacaaccagccauaccugggcuggugacuagcuccgcacagcccauccugcuccagucugcuaccagcacagccgcgcaggauauuuauccaucacccaccaaccgaaguaaacguaauuuagagauggaaaucauucugacucuuucccaaggauugaagaaauacuauggcaagauccugagaauacuagaccucacgcuggaggaagauacagagggccuucuggaauggugcaagaggaacuuggggcucaccuguaaugacaacuucuuucaggagcggauugaggaguucuuucugacuggagagggucacuucaaugaaguauuacaguuuaaaaccccuagcacacugucuccaaccgagccgacucacacacgcacgcccaccguuaagccuuucaaaucauacuuugccagaggcuuccucaguaucgauagcggguauuuuuccgcaaagugcuacucuaaaacuucgaacagcggacuucagcugauuaauaucacacaacauccagcuaggaucgccgacacccccggcccuaagauuacaaacuugaaggcuauaaauuguaucaaccuaaaagccuccguguucaaggaacaccgggagauugagaucaacguccugcucccacagguggcagugaaucugucaaacugccauguccuuauaaaaagucacguuugugauuauucucuggacauugauggugccgugcgcuugccccacguacaucacaaggggacuuuuaucccgggcaccuacaaaaucgugauugacaagcgaaauaaacagaacgauagaugcacgcucgucaccaauugugugaucaagggaaaggaaauuaggaaaggccaaagcgcucugcggcaguaccguacagagauacgcaucgggaaggcguccgcaggaucaagaagguuacugagcgaagagucuggugacgacugcauuucccggacucagcuacuccgaaccgaaacagccgagguucauaacgauaauuauggcgggccuggagacaaaaucacuaucuguaacggcaguaccauuguggaucagcgccuggguagcgagcuugggugcuacacgauaaauagagucaagucuuucaaauugugcgaaaacuccgcuacaggcaagucauguaagaucgacaguaccccagugaaaugcaggcaaggauucugucugaagauuacucaggagggccgggggcacguaaaacucagccgcggaucggaaguugugcuggaugccugcgacuccucuugugagaucaugauucccaaggguacaggcgauauccuugucgacugcagcgggggacagcagcauuuucugaaagauaauuugauagaccucggcuguccuaacaucccccuguuagguaagauggcaauuuauaucugcagaaugucaaaucacccaaagaccacuauggccuuccuguuuugguucaguuuuggguacgugauuaccuguaucuucugcaaagucauauuuuaucuacucauugugguuggcacacugggaaagaaauucaagcaauacagggagcuuaaaccucagacguguaccaucugcgaaacuacacccaccaacgcuauugaugccgagaugcacgacuugaauugcuccuauaacaucuguccauacugcgcaucucgucugacaagcgacggccucgcgcggcaugugacucaguguccgaagcgaaaggaaaaaguagaggaaaccgagcuguacuuaaaccuggagagaauaccuuggaucgucaggaagcugcuucagguguccgaaucaacggggguugcucucaaacgcagcaguuggcugauugugcuacugguccuccugacagugucucuuucccccguacaaagcgccccaaucggacacggcaagaccauugagacuuaucagacccgggaagguuacaucucggugugcuuguuuguucugggaggaauauuauucgucgugucaugucucauuaaaggccugguggauucugucgguaauagcuuuuuccccggccuuuccaucugcaagacauguagcaucgggucuguuaacggauuugagauugaaagccauaaaugcuauuguucccuguugugcuguccuuacugcagacacugcucaacugacagggagauccaccagcuccaucugaguauuuguaagaagcgccgaaccggcgggaaugugaugcuagcagugugcaaacggauguguuuccgugccacaauggagguaagcaacaagguccuguucauaagaaauaucauuaacacgaccuuugugaucugcauucucauccuggcuguuuguguggucucuacuuccgccguggaaauggagucacuuccagcaggaacaugggaaagggaggaagauuugaccaauuucugccaccaggagugucaaguuacugagacagaaugccugugucccuaugaggcuuuagugcuccgcaaaccucuguuucuuaacaguauaguaaagggcaugaaaaaucugcuaaacagcaccaaucucgaaacgucccugucuaucgaggccccguggggugcgauuaacguccagucgacuuucaagccaaccgugagcacagccaauaucgcuuugucaugguccaguguggagcaucgggggaacaagauucuggucucuggaagaagcgaauccaucaugaaauuagaggaaaggaccggcauaucaugggaccucgguguugaggaugcaucugaaagcaagagucugacuguguccguaauggaccuuagccagauguacucucccguguuugaguaucugucaggcgaucgacaagucgaggaauggccuaaagccacaugcaccggggacuguccagagcgcugcggaugcacauccaguacuuguuugcacaaggaauggccccauagccggaauuggagaugcaacccuaccugguguuggggcguggggacgggaugcacauguugcggccucgauguuaaagaccuguucaccgauuacauguuugugaaguggaaggucgaguacauuaaaacugaagcuaucguguguguugagcuaaccucgcaggagaggcagugcucucugaucgaagccgguacacguuucaaccuugggccggugacuauuacccucuccgagccccgcaauauacagcaaaagcugccaccugaaaucauuacguugcacccccggaucgaggaaggauuuuucgaccugaugcacguccagaaaguauuaagcgcaucaacaguguguaagcuccagaguugcacccauggcguuccaggugaucuucagguguaucacauuggcaaccuucugaaaggggacaaguugaauggacauaugauccacaagauagagccucauuuuaacacuucuuggauguccugggacggcugugaucucgacuacuauugcaauaugggggauuggcccagcugcacauacaccggagucacucaacacaaccacgcggccuucgugaaucugcuaaacaucgagacagacuauaccaaaaauuuucauuuccacucaaagagaguaacggcucauggcgauacuccacagcuggaccuuaaagccaggccgaccuacggugcaggggaaauuacagugcucgucgagguugcugauauggaacugcacaccaagaaaaucgacauuaguggauugaaguucgccagcuuaacaugugcaggcugcuaugccuguuccucuggcaucagcugcaaagugcgaauacacguggaugagccugacgagcugacuguccaugugaaguccgaagaucccgacauuguugcugcgucaaccucucucaucgcccggaagcuggagcuugggacggauaguacauuuaaagcauucucggcuaugccaaagacuagccuguguuuuuacaucguagaacgcgaguacugcaaauccuguucuaaggaagacacccagaaaugcgugaacacaaaguuggagcacccccaggggauucuaaucgagcauaaggguaccauaauuggcaaacaaaaugacacuuguaccgccaaggccgggugcuggcuggaaucagucaaaaguuucuuuuauggacucaagaacaugcuguccggcaucuucgguaauguguuuauugggaucuucuuguuuuuagcuccuuucguucugcucauauuguuuuucauguucggauggagacugcucuuuuguuucaaaugcugcaggcggacacgaggccuguuuaaguacagacaccuuaaggaggaugaagagaguggcuaucgcaggauuaucgaacgucugaacaauaaaaaggggaaaaacaaguugcuagacggagagcggcuggcagauagaaggaucgccgaacucuucucuacgaaaacucauauugguuga

SEQ ID NO: 10402 - RNA, 5055 nt, Artificial Sequence
  derived and/or modified CDS sequence (opt3) from CCHFV(SPU 44/08)__KJ682805.1__GP
auguacacaccccugcucugcgccauccuuugucugcaguuguggagcuuagagggcauuuaugggcuguccaacaauacccaacacaacgacacuucuacgauaaaggugccugaagagucacagaaaaccagucuaccagcuaauacagcaagcccgaucacuuccgaucccccuccaaccacacccaccgccucugcgucgggaccugaagguucaggcgacacuagcacaaguccacccgucaccacgcaggggccuacuccaccggagaccacacccgaaccucauacuaccauugauaucgacaaguccucuacagcuauugccgauaucagcacccagacgguuaaaaacauaccaacucccacagcacacaccucccucccuucaacucugagugccccaacaaugccccaagaggcucaucacaccgcaagaggacuucugagcgugacgucuaccaagccgggcgaggccuccacaccuacuucacccggugaagcuagcaccgaggccaguucuccacagccuacaaucagggaaacucccuccccacccccuaccacacagaccccaacugagauuaauaacccgaauacgagccggcagcccaugccuucgacacaaccagcggcacccucuuccguaacccauccugcccagccaacucccucacagagugacgugccgaccgcugcccaggauauccacccuagcccaacaaaccgcuccaaacgaaauuuggagauggaaauuauccucacccugucucaagggcugaagaaguacuauggaaaaguccucaaguuacuggaccuuacuuuggaggaagauacagagggccugcuagaauggugcaaacguaaccucggccugacgugugacgauaauuucuuucagaagagaauagaggaguucuuucuuaccggggaaggacacuucaacgaggugcugcaguuuaaaacucccagcacauugucaccuaccgaacccgcaaggguugagaguccaacaguggaaccuuucaaguccuacuuugcuaaggguuuccuccugauggacagcggcuauuuuucugccaaaugcuaccccaagucaaguaauagcggguuacaacugauuaacgucacucagcaucucauccggauuaccgauacgccaggaccgaaaaucaccaaucuuaagacaaucaacuguauuaaccugaaagcguugguguucaaggagcaccgcgagauagaaaucaauguacuacugccucagguugccgugaaccucuccaauugccauguccugauuaaaucucacgugugugacuauucgaucgacauagauggccccgugagacuuccaaggauucaccaugaggguacuuuuauccccgggaccuacaagaucgucauugacaagaaaaacaagcagaaugaucggugcacacugguuacuaacugugugaucaaaggacgcgaaauucgaaagggccaaagcguauugagacaguacaggaccgagauaaaaaucggcaaggcauccucagggagucggcgucuccugucugaagagagcaaugacgauugcuuaucccgcacgcagcugcuaagaacagagaacgcugaaauucacucagacaauuauggagguccuggcgauaagaucaccaucuguaacgggagcacuauuguggaccagaggcucggaucugagcugggcugcuacacaauaaaucgggucaaauccuucaaguuaugcgaaaacagugccaccgguaaaagcugugagaucgauucuacuccagugcgaugccgccaaggguuuuguuugaagauuacccaggagggcagaggacauguuaaacuguccaggggcucagaagugguccucgacgcuugcgauaguagcugugagaucaugauucccaaggggacaggagacauccugguggacugcucggguggccagcagcacuuccuuaaggauaaucugguagacuugggguguccuaacauaccgcuccugggaaaaauggccaucuauauuugccggauguccaaucauccaaagacgaccauggcauucuuauuuugguucucuuuuggcuacguuaucacuuguauucugugcaaagccaucuucuaucuacucauaguggucgguacacuggggaagaaauuuaagcaauaccgcgaacuuaagccccagaccuguacaauuugcgagacuaacccugugaacgcuaucgaugcggaaaugcacgacuugaauugcagcuauaacauuuguccauacugcgcaucaagacugaccagugauggccucgccaggcacgucaugcagugucccaaacguaaggagaaaaucgaggaaacggagcuguacuuaaaucuggaacggauaccuugggugguucgaaaguugcuucagguguccgagucuacaggaguagcucucaaaagaagcuccuggcuggucauccuacuggugcuccugaccguuucacuuagcccggugcaaagugcccccauuucucauggcgaaacugucgagguguaucagaccagggagggguacacauccaucugcuuguucguacugggaagcauuuuauuucucgugucgugucugaugcgcggucuuguugacucagucucuaacaguuucuuuccaggccuguccaucugcaagacuuguagcauagggucuauuaauggauucgaaaucgagagccacaaaugcuauuguuccuuguuuugcuguccuuacugccggcauugcucagcagauaucgaaauucacaagcuccaccugaguaucuguaagaaaagaaagaccggcagcaacgugaugcuagccgugugcaaaaggauguguuuccgcgcuacagucgagguuucuaauaaggcccugcucauucgaaacauaaucaauacgaccuuuguggugugcauucugauccuugcaguaugugucguguccacuucagcgguugaaauggagaacuugcccgcugguacaugggagaaagaagaggaccugaccaauuucugccaucaggaaugucaagugacugagacagagugcuuauguccauaugaagcccucguccugcggaagccucuuuuccuggauaguauugugaaggggaugaaaaaccuacucaauagcaccucccuggagacgucuuugucgaucgaagcacccuggggcgccauaaacguucagagcacuuuuaagccaaccgugucagcugccaauaucgcacuguccuggaguucuguagagcaccguggaaacaaaauuuuagucagcggcagauccgaaucaaucaugaagcucgaggagaggacagggauuucuugggaccugggaguggaagaugcuagcgagaguaaacuucugaccguguccgucauggacuugagccagauguacucuccgguuuucgaauaucucucaggcgaucgccagguggaggaauggccuaaggccacuugcacaggugacugucccgagcggugcgggugcaccuccaguacaugucugcauaaggaguggccacacagcagaaacuggaggugcaaucccacuugguguuggggaguaggcaccgguugcacguguugcggccuagacgugaaagaucuguuuacagacuacauguucgucaaguggaaaguggauuacaucaagaccgaagcgauaguuuguguggagcuuacuucgcaagaacgacagugcucucucauugaggccgggacccgcuuuaaccugggaccugucacaaucacuuuguccgaaccacggaauauccagcagaaacugcccccugagauugugaccuuacauccgagaauagaggaaggcuucuuugaccucaugcacauccaaaagguucugagcgcuucaacgguguguaaacuucagaguugcacacacggggucccaggagaucugcagauuuaucauaucggcaacuugcucaagggugacaagguaaaugggcaccugauucauaaaaucgagccccacuucaacaccucuuggauguccugggauggaugugaccuagauuacuauugcaauaugggcgacuggccuagcugcucauacacuggugugacacagcauaaccacgcagccuuuguuaauaugcugaacauagaaaccgauuauacuaagaauuuccacuuucauaguaaaagggugacagcucacggcgacacgccccaacuugaucucaaggcccguccaaccuacggggcaggagagaucacuguccugguggagguagcggacauggaauugcauaccaaaaagauugagaucagcggcuuaaaguucgccucccugacauguaccgggugcuaugcuuguucuagcggaauuuccugcaaagugcgcauccacgucgacgaaccugaugagcucacaguucacgugaagucagaagaccccgauauaguggccgcaucuaguucgcugauggcucggaaacuugaguuuggcacugacagcaccuucaaggccuucuccgcaaugccaaaaacgucucuguguuuuuacauugucgagagagaauacugcaagucauguagcaaggaggauacacagaaaugcgugaacacuaaguuggaacagccucaauccauccuaaucgagcauaaagguaccauuaucgggaagcagaaugacacauguaccgccaaagcuaguugcuggcuggaaucuauaaagagcuucuuuuauggacucaagaacaugcugucaggcauuuucgguaauguuuuuaucggcauuuuccuuuuucuugcgccguucaucaugcugauacucuuuuucauguuuggguggaggauuuuguucuguuucaaaugcugccgacggacucgcggacuguuuaaguacagacaccucaaagaugacgaggagaucggcuauaggaagaucauugaacggcugaacaacaaaaaggggaagaauaaacuucuggauggagagcgauuggccgacagaaagaucgcagaacuauucuccaccaaaacacauauuggcuga

SEQ ID NO: 10403 - RNA, 5052 nt, Artificial Sequence
  derived and/or modified CDS sequence (opt3) from CCHFV(K323_27)__KX013472.1__GP
augcacacccugcucgugugcuucauccuuuaccugcaguugagcggcuuagggggagcccauggucaauccaacgcuacagagcacaauggcacuaacacgaccacaguccccgggacuucucagucaccuaagccaccggcaaguaccacacugccccauaccccugaaagcuccacuguuaaacuaacaaccccaacgucugagacugaaggaucgggcgagaccacacccccuccaaauacuacccagggucucccccugccugggacaaccccagaaagaucagccacgacugcgacaagcaccaguuccacugacaacaugaacucuacaacccaggugacggauaauaccccgacaagcacuguauccauuucacccaguagcucuccuuccaugccaucaaccagccaaggaauacaccaucccgugaggagucuucugucugucuccagcccuaagacagugacuaccccaacacccaugucgccgggcgagaugucuccugagaccuccucacagcacagugcuaugagccggauccccacuuuguauacggccacacagguuuccaccgaaaauacugaccgcucuaccccacgacagagcgagucaagugugcaaccugcaacacagucccccauuaccagcccagcccagacuauccuccugaugucugcugcacccaaagccauucaggauaugcacccuucaccaacaaaccguaguaagagaaaucuggaagucgagaucauacucacguuaagccaaggccugaaaaaguacuaugggaagauccuuaaauugcugcaucuaacccucgaggaagacacugagggacugcuugaaugguguaagaggaaccuggguuccaauugcgaugacgacuuuuuccagaaacggauugaggaauuuuucaucacaggcgagggguacuuuaacgagguguugcaguucaagacccucucuacacugucgccgacugaaagcucccacguacgcuuacccaccgcugagccuuuuaaaucauauuucgccaagggauuucugaguauugauucuggcuacuucagcgcgaaguguuauccaagauccucaacgagcggucuccaacuuaucaauguuacccagcaucccgcaaggauagccgaaacaccugggccaaaaacuaccucucugaagacaauuaacugcaucaauuugcgggcuuccguguuuaaagagcaccgcgaagucgagauuaacgugcuacugccccagaucgccgugaaccucaguaauugucacgucguuaucagcucucaugugugcgauuacucccuggacacugauggaccgguacgacuuccuaggauucaccaugagggcaccuucauaccaggcacguacaagaucgugauugacagaaaagauaagcugaacgaccgguguucauuggucacaaauugcgugaucaaagggcgugaaguucgcaagggacagagugugcucagacaauauaagaccgagauaaaaauugguaaggcaagcacuggcucgaggaaacuguuauccgaggaacccggggacgauuguaucucucggacacagcugcuaaagaccgaaacugcugagauccacgacgauaacuacggaggcccuggugacaaaauuaccaucugcaaugggagcacaauugucgaucagcgacucggcucagagcugggauguuauacgauaaaccgcgugaagaguuuuaaguuaugcgaaaauuccgccaccggcaaaacuugcgagaucgacucuacacccguaaaguguagacagggguucugcuugaaaauuacccaagaaggaaggggucauguuaagcugagccggggcuccgaggugguccucgaugcgugugacucaagcugcgagaucaugaucccaaaagggacaggagauauucugguggacuguaguggcggucagcagcacuuccuuaaggauaaccugauagacuuggggugcccucacaucccccuccugggcaagauggccauuuacaucugucgcaugucuaaucauccaagaacuaccauggcauuuuuauucugguuuuccuucggauaugucauuacgugcaucuuuuguaaagcucuguucuaccuacucauaaucauuggcacacuggggaagaaaaucaagcaguauagggaacuuaaaccgcaaaccugcacuauuugugagaccgccccugugaacgcuaucgacgccgaaaugcacgauuugaauugcagcuacaacauaugccccuacugugcaucgcgucugacaucagacggacucgcccggcauguuacucagugcccaaagcgaaaggagaaaguggaagagaccgagcuguauuuaaaucuggaaaggauucccuggaucguaagaaaacuuuugcaggucucugagaguacagguguggcucucaagcgcuccagcuggcugacgguucuacuggugcuccugaccgucucucuuagcccugugcaguccgcgccaguaggccacgggaacacuauugaaacauaccaaacccgggagggauuuacuucaaucuguuuguucaugcugggcaguauauuauuuaucgugagcugccucguuaagggucuggucgauucuguguccgacucauucuuucccgggcuuaguguguguaaaacaugcagcauuggcuccaucaauggauucgaaauugagucucacaaguguuauugcucgcuguuuuguugcccucauuguagacacaggagcgcagaucgcgagauccaucaguugcaccucucaauaugcaaaaagcgaaagaccggcuccaacgucaugcuggccguuugcaaacggauguguccgaaggcuacgauugaagccagucguagagcacuaccaaucaggucuaucauuaacacuacccuggugaugugcauccucacacuggccauuugugugguaagcaccuccgcugucgagauggaagaccuucccgccgggacuugggagcgcgaagaggauuugacaaauuucugccaucaggagugucaagugaccgaaacagagugccuguguccuuacgaagcauuaguucuccggaaaccacuguuccuugacucaauagcgaagggaaugaaaaaccugcuaaauucuacuagccucgagaccagucuguccaucgaggcucccuggggcgccauuaacgugcagagcacguuuaagccuacagucucuaccgcaaauaucgccuugucaugguccaguguggaacacagagguaacaagauucugguuacugggaggagcgagucgaucaugaaauuagaggaacgaaccggagugucuugggaucucggcguagaagacgcuuccgagagcaagcugcuuacagucucaauaauggaucugagucagauguauucuccgguguucgaguacuuguccggugaccgccagguggaagaguggcccaaagccacuugcaccggcgauuguccagaacggugcggguguacgagcucaacaugccuccacaaggaguggccucauaguagaaauuggaggugcaaccccaccugguguuggggagucggcacugggugcacauguugcggaguugacgugaaagaccuguuuaccgaucacauguucaucaaguggaagguagaauauauuaaaacugaggcaaucgugugugucgagcuaacaggccaagaacgucagugcagccugauugaggcugguacccgcuuuaaucuugggccagugacgaucacucucuccgaaccucggaacauacagcagaagcugcccccagagauuaucaccuugcauccgaaaaucgaagagggauucuuugaccugaugcacguucaaaagguguuaucugccagcacagucuguaaacuccaguccugcacccauggcauuccuggugaucugcagauauaccacaucggcaaucuucugaagggggacagagugaacggacacuugauucauaagaucgagccccacuucaauacaucauggaugucuugggauggcugugaccucgauuacuauugcaacaugggggacuggccaaguuguacuuacaccggaguuacgcagcauaaucacgcggccuuugugaaccugcuaaacauugaaacagauuauacuaaaaccuuccacuuucauucgaagagggucacagcucacggcgacacuccccaacuggaucuuaaagcacgaccuaccuacggugccggggagaucaccguacucguggaaguugcugacauggagcugcauacaaagaaaguggagauaagcggauugaaguucgccuccuuaacgugcacuggcugcuaugcauguucuucagguaucagcugcaaaguccggauucacguggaugaaccagacgagcugaccguacaugugaaguccagugaccccgaugucguugcggccucuacaagccucauggcucgcaagcuggaauuuggcaccgacucaacuuucaaagccuucuccgcaaugccuaagacaagucuuuguuuuuacaucguggagagagaauauugcaaaagcuguucugaggaugacaccaagaaaugcguggauacgaagcuggagcagccgcaguccauuuugaucgaacacaaggggacuauaauuggaaaacaaaaugacacauguaccgcuaaggccucaugcuggcuagagagcgucaaaucguucuuuuacggccugaagaacaugcucgggucuguguucggauccuuuuucguuggcauccugcuuuuucuugcaccauucguacugcucguguuguuuuucauguuugguuggaaaauccuguucuguuucaagugcuguaggcggacccgagggcucuuuaaguacagacaccugaaugaugacgaagagacuggauaucgcaggauuaucgaacgucuuaacaguaaaaagggcaaaaaucggcuguuggauggcgagagacuagccgacaggaagauagcugagcuguucagcacaaaaacccauauuggguga

SEQ ID NO: 10404 - RNA, 5052 nt, Artificial Sequence
  derived and/or modified CDS sequence (opt3) from CCHFV(1231-CR/TI-2015)__KU161585.1__GP
augcacacccugcucgugugcuucauccuuuaccugcaguuguuaggccuugggggagcccaugagcaaagcaacgcuacagaccacaauagaacuaacacgauuaccgcacccuccacaucucagaauccuaagccaccggccucaacuacacccccucauaccccagaaaguagcaccauaaaacuaaucacuuccacaggugaggcggaaggcucuggggagaccacgcccccucucaacacuacccagggaccauuucccccugaaacaacuucggagcacccagcuucaaccgccacaaauaccagcaguacgaacuccaugaacucuacuacacagaugaccgauaagacucugacaagcaccgucuccacgucacuuaguauuagcccgucuacccccuccacaucacaaggcauccauuauccuauuaggagccuguugaguguuucuuccccacggacugcagccacccccacaccuaugagcacucgcgagaugucgucugaaaccaauucccagcacucagcugugagucgaacaccaaccuuccacacugcaacgcagguaagcacagagaaugacaaccguuccacccccagacagucugaaagcucagcccaaccggcuacucagaguccuaugaccucccccgcccagagcauccuccuggugucugcggcaccaacaaccauacagaauauccauccuucacccacuaacaggaguaaacggaaucuggagauggagauuauccucacauuaccacaaggucugaagaaauacuaugggaagauucuuaaguugcugcaccuaacgcucgaagaggauaccgaaggacugcuugagugguguaaacgcaaccugggcagcaauugcgacgaugaauuuuuccagaagagaaucgaggaguuuuucauaacuggcgaaggguacuuuaacgaggucuugcaguucaaaacacucuccacccugucucccauggaaccuucgcaugccaggccaccgacagcugagcccuuuaagagcuauuucgccaaaggauuuuuauccauugacucagguuacuucagugcaaaguguuauccucggucuagcuccucaggccugcaacucaucaacauuacucagcacccagcucgcaucgccgaaacccccgggccuaagacgaccagccuuaaaacaaucaauugcauuaaccugcgagcgucuguguuuaaggagcacagagagguugaaauaaauguguugcuaccacagaucgccgucaaccuguccaauugucaugugguaauuaacagucacguuugcgauuacagccucgacacugauggacccgugaggcugccgcggaucuaccaugagggcaccuucauaccugguacauauaaaauugucaucgacaagaaaaauaagcugaacgaucguuguacucuggugaccaauugcgugacgaaagggcgcgaagucagaaagggacagucuguuuugaggcaauacaagacagagaucaaaauuggcaaggcauccaccggcucacggaaacuccugagugaggaaccaggggacgauuguaucagccgaacucaguuacugcgcacagagaccgcugaaauucacgacgacaacuauggaggucccggcgauaagauaacuaucugcaaugggucgaccauuguggaccagagacuaggauccgagcucggcuguuacacaaucaacaggguaaaaucuuucaagcugugcgaaaauagcgccacggguaagaccugcgagaucgauucaacuccugugaaaugucggcagggguuuugccuuaagauuacacaagagggccgcggacaugucaaauugaguagaggcuccgaagugguucuggacgcuugugauucuagcugcgaggugaugauacccaaggggaccggagacauccucgucgauuguuccgguggccagcagcacuuccugaaagacaaccuuauugaucuggggugcccacacaucccuuugcucggaaagauggccauuuauaucuguaggaugucaaaucauccccguacaacuauggcauuucuguucugguuuagcuucggcuacgugauaaccugcaucuuuuguaaggccuuauucuauagucugauuaucauugguacgcuagggaaaaagaucaaacaguaccgggaacucaagccacaaacaugcaccauaugugagacugcuccgguaaacgcgauugacgcagaaaugcacgaucugaacugcucuuacaauaucugcccuuauugugccucccgacuuaccagcgacggcuuggcuagacauguuacacagugccccaaaaggaaggagaagguggaggaaacugagcuguaccucaaccuggaacgcauuccauggaucguccggaaauuacuucaggugucggagucaaccggagucgcccugaagagaucuaguugguugauagugcuccugguucuacugacagugucccucagccccguacagucugcaccugucggccacgggaaaacgaucgaaaccuaucaaacuagggagggauuuacaagcauuugucuguucaugcuugguuccaucuuguuuauugugucaugccugguuaagggcuuaguggagagugucagcgacucuuucuuuccagggcucuccgugugucgaaccugcucaaucggaaguauaaauggcuucgaaauugagagccacaaauguuacugcucccuguucuguugccccuauugucgccauugcucugccgaucgggaaauccaccagcuucaucugucgaucugcaagaaacguaagacugguagcaacguaauguuggcuguguguaagagaaugugcuuuagggccacaauggaggcaucacgccgggcgcuccugauuagauccaucauuaauaccacguucguuauauguauccuaacucugaccauuugcgucgugaguacaucugcuguggaaauggagaaccucccugccgggaccugggagagggaagaggaccugacuaauuuuugucaccaggaaugccaagucacagagaccgagugucuuugcccguacgaagcauugguucugcgaaaaccauuauuccucgauagcaucgugaagggcaugaaaaaccugcuuaauuccacaucacuggagacuucucuaagcauugaagcccccuggggagcuaucaacgugcagaguaccuuuaagccuacgguauccacagccaauauagcacucagcuggucuucagucgagcaucgcggcaacaaaauccuggugaccgggcgguccgaaaguauuaugaaguuggaggagagaacuggaguuagcugggaccugggcguggaagaugcuucggagucuaaguuacucaccgucuccaucauggaccugagccagauguauucaccaguguucgaauaccuuaguggugauaggcagguugaggaauggcccaaagccacauguacuggggacugcccugagcguuguggaugcaccucuuccacgugccugcacaaggaguggccgcacagccgcaauuggcgguguaaccccacauggugcuggggcguggguaccggcuguacuugcugugggguagaugucaaagacuuguuuacagaucauauguucgugaaguggaaaguggaauacauuaagaccgaggcgaucgucugcguugaacucacuucacaagagagacaguguagucugauagaagccggaacaagguuuaaucuaggcccagugaccauuacgcugagcgagccucgaaacauccagcagaaacuucccccagagaucauuacucuccacccuaaaauagaagagggguucuuugaccugaugcauguacaaaagguguuguccgcuucuaccgucugcaaacugcagagcuguacacacggaauccccggcgauuuacagguguaucauauugguaaccuccugaagggggaccggguuaauggacaccuuauccacaaaauugaaccacauuucaacaccuccuggaugucaugggacggcugcgaucuggacuacuauuguaauaugggugauuggccgucuugcacauacacuggcgugacccagcacaaccaugcagccuuugucaauuugcucaacaucgagacggacuauacaaagacuuuccacuuccacaguaagcgcgugaccgcucauggggauacaccucaacuggaccuaaaagccagacccaccuacggagcaggcgagauaacuguucugguggaagucgcggauauggagcuucacaccaagaaaguagaaaucucggggcucaaguuugccagccuggcuugcacaggauguuaugccugcuccucuggcauuucauguaaagugaggauccauguugacgagccagaugaauugacggugcacgucaagagcuccgaccccgaugugguagcagcuaguacuucuuuaauggcccggaaacuggaguucgguaccgacagcacauuuaaggcauucucagccaugccuaagaccucccucugcuuuuacauuguggagcgagaauacuguaaaaguugcagcgaggaugacacuaagaaaugugucgacacaaagcuggaacagccacagucuauccuuauagagcauaaagggaccauuaucggaaagcaaaaugauacgugcacugcuaaggcguccuguuggcuggaaucaguuaagagcuucuuuuauggcuugaagaacaugcuagguucgguguucggcaacuuuuucaucgggauucugcucuuucuggcccccuucgugcuuuuaguccuguucuuuauguucggauggaaaauccucuuuugcuucaaguguugcagacgcacaaggggcuuguuuaaauaccgucaccugaaggacgaugaggagaccggguaucggagaauaauugaaaggcucaauaauaagaaaggaaagaaccgccugcuugacggcgagcgacuggcagauagaaaaaucgcugaauuguucucuaccaagacucacauugguuga

SEQ ID NO: 10405 - RNA, 5052 nt, Artificial Sequence
  derived and/or modified CDS sequence (opt3) from CCHFV(K229_194)__KX013463.1__GP
augcacacccugcucgugugcuucauccuuuaccugcaguugagcggcuuagggggagcccauggucaauccaacgcuacagagcacaauggcacuaacacgaccacaguccccgggacuucucagucaccuaagccaccggcaaguaccacacugccccauaccccugaaagcuccacuguuaaacuaacaaccccaacgucugagacugaaggaucgggcgagaccacacccccuccaaauacuacccaggguuuacccccuccagggacaaccccggaaagacccgccacgacugcgacaucaaccagcaguacugacaacaugaacuccacaacccaggugacggauaauaccccuauuucuacaguaagcauauccccaucaaguagccccucuaugccuuccacuucacaaggaauccacuauccagugaggagccugcuuagugucucuucccccaagaccgugacaacuccgaccccuaugagccccggcgagaugucgccagagacaucuucccagcauucagcuaugagucggauuccuacccuguacacugccacgcagguuagcacagaaaauaccaaccgcuccacuccccgacagucugagagcucagcacaaccagccacccagagucccacaaccuccccuacucagacaaucuugcucaugagcgcugcaccaaaagccauucaggacaugcacccgucucccacgaaucguucaaagagaaaccuggaaguggagaucauacugacccucagucaaggccucaaaaaguauuacgggaagauccugaaacuuuugcaccugacucuagaggaagauacagagggacuccuggaaugguguaagaggaaucuugguagcaacugcgacgaugacuuuuuccagaaacggauugaggaauuuuucaucaccggcgagggguauuuuaaugagguccugcaguucaagacauugaacacucucuccccuaccgaaccaucucaugugcgccugcccacggcugagccuuuuaaaucguacuucgccaagggauuuuuaagcguagauuccggcuauuucucagcgaaguguuacccaagaaguucuaccagcggucugcaacucauuaauguuacacagcaccccgcaaggaucgccgaaacuccggggccuaaaaccacaucccuuaagacuauaaacugcauuaaccugcgggcuucaguguuuaaagagcaucgcgaagucgagaucaauguguugcuaccacagauugccgugaaccugagcaauugucacgucguuaucaacucucacgugugcgacuacucccucgauaccgacggacccguacgacugccuagaauccaucacgagggcacguucauucccggcacauauaagauagugaucgauaaaaagaauaaacuuaacgacagguguagucuggucaccaauugcgugauuaaggggcgggaaguucguaagggacagagcguguugcgccaauacaaaacugagaucaagauagguaaagcaucuacaggcuccagaaagcuccugucagaggaaccaggggaugacuguauuaguaggacccaguuacugaaaacugaaaccgcugagauccaugacgauaacuauggaggcccuggugacaagaucacaauuugcaaugggagcacgaucgucgaucagcggcuaggcucggagcucggauguuacaccauuaaccgagugaaguccuuuaaacugugcgaaaauucugccacuggcaagacaugcgagauagacagcacccccguaaaaugucgccagggguucugccuuaagaucacacaagaaggaagaggucacguuaaauugucaaggggcagugaggugguccuggaugcgugugacuccucuugcgagauuaugaucccaaaggggacuggagauauccucguggacuguagcggcggucagcagcauuuccugaaggggaaccuuauugaucugggcugcccgcacauaccuuugcucggaaaaauggccaucuauauuugucggauguccaaucacccccgcaccacgauggcauuucuguucugguuuucauucggcuacgucaucacaugcaucuuuuguaaggcuuuauucuauagccugauuauaaucgggacccuagggaaaaagauuaaacaguacagagaacucaagccacaaacuugcaccaucugugagacagcccccgugaacgcuauugacgccgaaaugcaugaucugaauugcaguuacaacaucugcccuuauugugcaucuaggcuuacuuccgacgguuuggcccgucacguuacccagugcccaaagcggaaagagaagguggaagagacagagcuguaccucaaccuggaacgaauacccuggauuguaagaaaauuacugcaggucagcgagucgacgggcguggcucuuaagaggucaucuugguugaucguucuccuggugcuacugaccgucagucucuccccugugcagagcgcgccgguagggcauggaaaaacuauugaaacauaucaaacccgcgagggcuuuacuaauaucugucuguucaugcuugguucuauauuguuuaucgugagcugccugguuaagggguuagucgacuccgugucagauaguuucuuuccaggccucagcguguguaaaacaugcucuauuggauccaucaacggcuucgaaauugagucacacaaguguuacugcagucuguuuuguugccccuauugucggcacugcagcgcagacagagagauccaucagcuucaccuggggauaugcaagaaaaggaagaccggauccaaugucauguuggccguuuguaaacgcaugugcuucaaggcuacgauugaagccucucgacgggcacuccugauccguucgaucauuaacacuaccuucgugaucuguauucuaacacuggccauaugcgugguaagcaccucagcugucgagauggaaaaucucccugccggcacuugggagagagaagaggaucugacauccuuuugucaucaggagugccaagugaccgaaacagagugucuuugcccauacgaagcauugguucugaggaaacccuuauuccucgacaguaucgugaaggguaagaaaaaccugcuuaauucuacuagccuggagaccucccuaucaauugaggcgccuuggggagcuaucaacguccagucuacguuuaagccgacagugagcaccgccaauauugcacucaguugguccagcguugaacaccgcggaaacaaaauccuggugacuggccggucugagucaauaaugaaguuggaagagagaaccgguguauccugggaucugggcgucgaagacgccagugagagcaaauuacucacagugucgaucauggaucugucucagauguauucccccguguucgaguaccuuagcggggacaggcaggucgaagaguggccaaaggcuacuuguaccggagauugcccugaacgauguggcugcacgucaaguacaugccugcauaaggaguggccccacucucgcaauuggcgguguaacccaaccuggugcuggggaguugggacuggcuguacaugcugugguguggacguaaaagauuuguuuaccgaccacauguucauuaaguggaaaguggaauacaucaagacugaggccauugucugcguggagcucacaucccaagaaagacaguguagccugaucgaggcagggaccagguuuaaucuaggaccuguuacgauaacucugucagaaccccguaacauucagcagaaacuuccaccggagaucaucacccuccauccuaagauugaagagggcuucuuugaucugaugcacgugcaaaaggucuugagugcuagcacagugugcaaacugcaguccuguacccaugguauacccggcgacuuacagaucuaucacauugggaaucuccugaagggagaccgccuuaacggccaucugauccacaaaauugagccacacuucaacacaucuuggaugagcugggaugggugcgacuuggauuacuauuguaauaugggagacuggcccuccugcacuuacaccggcguuacgcagcauaaccacgccgcguuugugaaucuccugaacaucgaaacagauuauacuaagaccuuccauuuucacucaaaacgggucacagcccacggugacaccccucaacuagaucugaaggcuagaccaacuuacggggcaggagagauaaccguacuuguggaaguugccgacauggagcuccauacgaaaaagguggagaucucuggccugaaguucgcuaguuuggccugcacagguuguuauucgugcagcuccggcauuucuuguaaagucaggauccacguggaugaacccgacgaguuaacuguacaugugaagucaagcgauccugacgucguugcagcguccaccagucugauggcccgaaaacucgaauuugggacagauucuaccuuuaaggcuuucagcgccaugccgaaaacuucacugugcuuuuacauuguggagcgggaauacuguaaguccugcagugaggacgacacaaagaaauguguggauaccaaacuugagcagccacagagcauccugauagaacacaaaggaacgauuaucggcaagcaaaaugacacuugcacagcaaaggcuucuuguugguuggaguccgucaagucauucuuuuaugggcuaaagaacaugcugggaagcguguucggcaauuucuucguugguauccuccuguuucuugcccccuucguauuacuggugcucuuuuucauguucggguggaaaauuuuguuuugcuucaaguguugccgcagaaccaggggacuguuuaaauaccggcaucucaaggaugacgaagagaccggcuaucgaaaaaucauagaaagacugaacucgaagaagggcaaaaaucgccuucuggauggggagagguuggcagaccguaagauugccgagcuauucucuacuaaaacacacaucggauga

SEQ ID NO: 10406 - RNA, 5052 nt, Artificial Sequence
  derived and/or modified CDS sequence (opt3) from CCHFV(K315_14)__KX013469.1__GP
augcacacccugcucgugugcuucauccuuuaccugcaguugagcggcuuagggggagcccauggucaauccaacgagacagaacacaauggcacuaacacgaccacaguccccgggacuucucagucaccuaagccaccggcuaguaccacacugcagcauacccccgagagcuccacuguuaaacuaacaaccccuacgucugaaacugagggaucgggcgaaaccacaccacccccuaauacuacccagggucucccacccccugggacaaccccagagagaucagcaacgacugccacaagcaccaguuccacugacaacaugaauaguacaacccaagugacggauaacaccccgacaagcacuguauccauuucacccaguagcucuccuuccaugccaucaaccagccagggaauacacuaucccaucaggagucugcuuucuguguccagcccuaagacagucacuaccccaacacccauuucgccgggcgagaugucuccugaaaccuccucacagcauagugcgaugagccggauccccacucuguacacggcuacacagguguccaccgagaauacuaaccgcucuaccccacgacaaagcgaaucaaguguucagccugccacacagucccccauuaccagcccagcacagacuaucuugcucaugucugccgcucccaaagcaauacaagacaugcacccuucaccaacaaaucguaguaagagaaaccuggagguggagaucauucugacgcucagccagggccugaaaaaguauuacgggaagauccugaaacuuuugcaccugacccuagaagaggauacugaaggacuccuggagugguguaagaggaaucuugguuccaacugcgacgaugacuuuuuccagaaacggauugaagaguuuuucaucacaggcgagggguauuuuaaugaaguccugcaauucaagaccuugucuacacucucgccgacugagcccagccaugugcgccugccuaccgccgaaccauuuaaauccuacuucgcuaagggauuuuuaucaauagauaguggcuauuucucugccaaguguuaccccagaagcuccacgucaggucugcagcucauuaacguaacccagcacccugcgaggaucgcagagacaccagggcccaaaacuaccagccuuaagacaauuaauugcaucaaccugcgggccucuguuuuuaaagaacaucgcgagguggagaucaacgucuugcuaccgcagauugcugugaaucuguccaacugucacguggucauaaauagucacguuugcgacuacagccucgauacugacggaccugugcgacugccaagaauccaucacgaaggcaccuucauucccggcacguauaagaucguaauagauaaaaagaacaaacuuaaugacagguguucucuggugacaaacugcgucauuaaggggcgggaggugcguaagggacaauccguuuugcgccaguacaaaaccgaaaucagaaucgguaaggccucaacuggcaguaggaaacuccugagcgaggaaccuggggaugacuguauuucgcggacacaguuacugaagaccgagacugcagagauccaugacgauaauuauggaggccccggugacaaaauuaccauaugcaacggguccacaguggucgaucagcgacuaggcucugaacucggauguuacacgaucaaucgcguaaagagcuuuaagcugugcaaaaacucagcuaccggcaagacuugcgagauugacaguacaccagugaaauguagacaaggguucugccuuaagaucacccaggaaggaaggggucacguuaaauugucccggggcucugaggugguccuggaugugugugacagcuccugcgagaucaugauuccuaaggggacaggagauauacucgucgacuguucaggcggucagcagcauuuccugaaggauaaucuuaucgaccuggggugcccccacauuccauugcucggcaaaauggccaucuauauuugucgcaugagcaaccacccgagaacuaccauggcguuucuguucugguuuaguuucggauacgugaucacgugcauauuuuguaaggccuuauucuauucucugaucauuaucggcacacuagggaaaaagauuaaacaauacagggaacucaagccucagaccugcacuaucugugagaccgcacccguuaaugcuauagaugccgaaaugcaugaccugaacugcuccuacaauauuugcccauauugugcuagccgucuuacaucggagggauuggcccggcacgugacucagugccccaagcgaaaagaaaagguagaggagaccgaacuguaccucaaccuggagagaaucccuuggauugucaggaaauuauuacaggugucagaaucuacagguguugcacuuaagcgcaguuccugguugaucgugcuccugguccuacugacggugagccucucuccaguacaaagcgcccccgugggccaugggaaaaccauagagacuuaucagacacgggaaggauuuaccuccaucugucuguucaugcuuggcucaauuuuguuuaucguuaguugccuggucaaggguuuaguguacagcgugucugacuccuucuuuccugggcucucagucuguaaaacuugcaguauuggcagcaucaacggauucgagauagagucccacaaguguuauugcucucuguuuuguugcccguacuguagacacugcucggcugauagggaaauucaucagcuucaccugagcaucugcaagaaacgcaagacaggcucaaauguuauguuggcgguguguaaacgaaugugcuucaaggcaaccaucgaggccucccggcgugcucuccugauuagaaguaucauuaacacgacuuucgugauauguauccuaacccuggccauuugcguagucucuacaagcgcaguggaaauggaggaccucccagccgggaccugggaaagggaggaggaucugacuaauuuuugucaucaagaaugccagguuacagagaccgaaugucuuugccccuaugaggcuuuggugcugcgcaaaccuuuauuccucgacuccaucgucaagggaaugaagaaacugcuuaacucaacaucucuggagacuagccuaaguauugaagccccauggggcgcaaucaaugugcaguccaccuuuaagcccacgguuagcacagcgaacauagcucucucuuggucauccguggagcaccgggguaauaaaauccugguaaccgggagaagugaaagcauuaugaaguuggaggaaaggacuggagucucgugggaucugggcguggaggacgccucugaguccaaauuacucaccgugagcaucauggaucugucacagauguacaguccugucuucgaauaccuuucuggugaccgacaaguugaggaauggccgaaggcaacauguacuggcgauugccccgagcgcugugggugcaccuccagcacgugccugcauaaggaauggccacacucacggaacuggagauguaauccuacauggugcuggggagugggcaccggguguacuugcuguggaguagacgugaaagauuuguuuacagaccacauguucauuaaguggaaagucgaguauaucaagaccgaggccauagugugcguugaacucacuucucaggagaggcaguguagccugauugaagcuggcacacguuuuaaccuaggucccgugaccaucacgcuguccgagccacgcaauauccagcaaaaacuuccucccgaaauuauaacucuccauccaaagaucgaggagggguucuuugaucugaugcacguccagaagguguugucugccagcaccguuugcaaacugcaguccuguacacauggcauuccgggagacuuacagaucuaccacauugguaaccuccugaagggcgaccgggugaaugggcaucuuauccacaaaauagaaccucacuucaacaccucauggaugucuugggauggaugcgaccuggauuauuacuguaauaugggcgacuggcccaguugcacauauacuggggucacccaacauaaccacgcagcuuuuguaaacuugcucaauaucgagacggauuacacaaagacuuuccauuuucacucgaaaagagugaccgcccacggagacacaccacagcuggaucuaaaggcgaggcccaccuauggcgccggugaaauuacuguucugguggaggucgcugacauggagcuucauaccaaaaagguggaaaucagcgggcucaaguucgcaucccugacaugcacgggauguuacgccugcaguucaggcauuagcuguaaaguacgaauccacguggaugagccugacgaauugacuguccauguuaaguccagugauccagacgugguggcugccucuaccagcuuaauggcacggaaacuggaguucgguacagauucaaccuuuaaggcguucuccgccaugcccaaaacuucucucugcuuuuacauagucgaacgcgaguauuguaagagcugcucugaggacgacacaaagaaauguguggauaccaagcuggaacagccucaauccauucuuaucgagcacaaaggcacgaucauugggaagcagaacgacacuugcacagcuaaagccucauguuggcuggaaagcguuaagucguucuuuuacggauugaagaauaugcuaggcucuguauucggguccuuuuucgugggaauccugcucuuucuggcaccguucguccuuuuagugcuguuuuucauguucggcuggaaaauacucuuuugcuucaaguguugcagaaggacccgggguuuguuuaaauaucgacaucugaaggaugacgaggaaaccggguacagacgcauuaucgagaggcucaacaguaaaaagggaaagaaucgucugcuugauggcgagcggcuggcugacagaaaaauugccgaauuguucagcacuaagacacacaucggcuga

SEQ ID NO: 10407 - RNA, 5055 nt, Artificial Sequence
  derived and/or modified CDS sequence (opt3) from CCHFV(BA8402)__AF350449.1__GP
auguacacaccccugcucugcgccgugcuuugucugcaguuguggagcuuagagggcucccacgggcugucuaacaagacacaacauucaaauacgaguacuaccaaagcuccugaagucagccaggagcuaggacucccaguuuccacagugucuacuaucaccucggaaccgcccucaauuacaagcgcaguaaguguguccgguucugagggcagcggggacaccaacacuuccccuucagucacaacccagggaccaacgcugcccgaaacuacccuugagccucugacaacuaccgauacagacgccaguagcaccgugguuguggaugucucuacgcagacugugaaggacacaccaauauccaccacuuauacaucauugcccagcaccccuagugagccaacgaccccgcaaggcacacaccauacugcgagaggucuccugucuguaaccuccacaaaacccgaagaggcuagcccucaggccaauccagggaagaucucgauggaaacuaacggacccaggcuggcaauuucugagaccccuuccuucucaccaacaacccaggcccccacugagaauaguaacccgaucacgagcaaacagcucauguuauccgcucaaccuguuacacccaauccaaugaccucuccugugcagcccgcacugagccagucagauaccaguacugccauucaggacguccacccaucccccacaggccggagcaagcgcaaccuugaaauggagaucauauugacccugucucaaggccuaaagaaauacuaugggaagauccucaaacugcuugaucugacuuuggaagaggacacagaaggacuccuggaguggugcaagcgaaauuuaggucuggugugugaugacaacuuuuuccagaaacguauugaggaauuuuuccucacgggcaaggggcauuuuaaugaggugcuucaguucaagaccccuucaacucugaguccaacaggaccggcuagaaccggcagccccacagucgaaccuuuuaaauccuacuucgccaagggguuuuugucuauggauucggguuauuucagcgcgaaaugcuacccaagggcauccaacucaggacuacaacugaucaauguuacucagcacaguacccggauuacggacacccccggcccuaagaucacaaaccucaaaacuauaaauuguauuaaccugaaggccucuguguuuaaagagcaccgcgaaaucgagauuaacguacuucugccacagguggcugucaauuugagcuccugccaugugcucaucaagucacacguuugugauuauagccuggacaucgacggccccgugagauuaccgaggauucaucacgaggggaccuucauaccuggaacauacaagaucgucauugauaaaaagaacaaacagaaugaccggugcacucuggugaccaacuguguaaucaagggucgcgaaauacgaaaaggccaaucuguucuaagacaguacaggacggagauuaagaucgggaaggccuccaguggaagccggcgucuccugucugaagaguccggcgaugacugcaucucacgcacacagcuuuugagaaccgaaacugcagagauucacaaugauaacuauggugggccaggcgacaaaaucacaauuuguaauggaaguaccguggucgaucagaggcugggcagcgagcucgggugcuacacuauaaaccgggucaauucguuuaaccugugcgaaaauaccgcuacaggaaaguccugugagaucgacucuacgcccgugaaaugccgacaagguuucugucuuaagauuacccaggaaggccgcgggcaugugaaacugagcagaggaucagagguuguguuggaugccugcgagaguuccugugaaaucaugaucccuaagggcacuggugacauucucguagauugcucugggggccagcagcacuuccugaaggacaacuuaauagaccugggaugucccaauaucccacuacucggcaaaauggcgauuuauaucugcaggaugagcaaccauccuaagacaaccauggccuuucuguucugguuuuccuucggguacgucgugacauguauucuuugcaaaguuaucuuuuauuugcugauaguggucggaacucucgguaagaaauucaagcaauaccgggagcugaagccccagaccuguacgaucugcgaaacaaccccagugaaugcaauugaugcugagaugcacgacuuaaacugcucauauaacaucuguccguacugcgccagccgcccuaccagugauggccuggcuagacauguaaugcagugucccaaaaggaaggaaaagauugaggagacugcccuuuacuugaaucucgaacguaucccaugggugguucggaagcugcuacaggucucugaguccacagggguggcacugaaacgaagcucguggcucgugguccugcuuguuuugcugacugugucauuaucucccgugcaaagugccccuauaggacacggcaagaccguagaaacauaucagacgagagaggguuacaccuccauuugccucuuuguccuggggagcauccuuuucauugugucuugucugaugaaaggcuugguugacagcgugggaaacuccuuuuucccaggccucucaaucugcaagacuuguaguauagggagcgucaauggauuugaaaucgagucucacaagugcuauuguucccuguucugcugucccuacugcaggcauugcucagcugaucgcgagauucaccggcuacaucugaguaucuguaaaaagagaaaaacaggcagcaacgugaugcucgcgguuugcaagaggauguguuuucgcgcaaccguggaaguauccaauaaagcccugcuuauucgaaacaucauaaauacuacauucgucuugugcauucugaucuuagcuguguguguggucucuaccucggccguugagauggaaagccucccugcagguacgugggagcgggaagaggaccugacuaacuucugccaccaggagugucaagugaccgaaacagagugccuuuguccguaugaagcccugguacuacguaagccacucuuuucagauuccaucgugaaggggaugaaaaaucuguugaacaguaccucucuggagacuagcuuauccauugaggcucccuggggagccaucaauguccagucaacauucaagccuaccgugucugcagcgaacauugcucucagcuggaguuccguugaacacagaggcaauaaaauacuggugagcgguaggucugagucaaucaugaaacuugaggagcgcacaggcauuuccugggaccugggggucgaagaugccagugagagcaaauugcucacugugucgguuauggaccugucucagauguacuccccaguguuugaguaucuaagcggagaucggcaggucgaagaguggcccaaggcaaccugcacgggcgacuguccugaaagaugcgggugcacaucaaguaccugucugcauaaggaguggccgcacucuaggaacuggcgaugcaaucccacuugguguuggggaguaggcaccgguugcacauguugcgggcuugaugugaaagaccucuucacugacuacauguuuaucaaguggaaaguugaauacauuaagaccgaggccaucgugugugucgagcugacgucccaagaacgccagugcacauugauagaggcuggaacccgguucaaccugggcccagugacuaucacauuaagcgaaccuagaaacauucagcagaaacugcccccagagaucguaacccuccauccuaggauugaagagggcuuuuucgaucuuaugcacgugcaaaagguccugucagccaguacuguuuguaaguugcagagcugcacacauggugugcccggggaccuccagguguaucacaucggaaaucugcuaaaaggcgauaaggucaacgggcaccugauacauaaaauugagccacacuuuaauaccuccuggaugucuugggacggaugugaucuucauuacuauugcaacaugggcgacuggccgagcugcacguacacuggugugacccagcacaaucaugcagcuuucguuaacaugcucaauaucgaaacagauuauaccaagaacuuucacuuccacuccaaacguguaacagcccauggggacacuccucaacuggauuugaaggcgcgccccaccuacggagccggcgagaucacgguguuagucgaaguggcugacauggagcugcacaccaaaaagauugagauaucaggucucaaguuugcaucucugacuuguaccggcugcuaugccuguaguucggggaucagcugcaaaguucggauucauguggaugaaccagacgagcuuacaguccacgugaaguccgaagaucccgacaucguagcugccucuucaagccugauggcaagaaaauuggaguucggaaccgacuccacuuucaaggcguuuagugccaugccuaaaaccucucuauguuucuacauugucgaaagggaguacugcgagagcuguucaaaggaagauacacagaagugcgugaauacgaaacuggagcagccacaauccauccucauagaacacaagggcacuaucauugggaaacagaguaacaccuguacagcuaaggccagcugcuggcuggagucuguuaaauccuuuuucuauggacuuaagaauauguuaucaggcaucuuugguaacguguucauuggggucuuucuguucuuugcacccuucauccucuugauacuguuuuucauguucggauggcggauucucuuuuguuucaagugcugccgacgcaccagaggccuguuuaaauacaggcaucuuaaggacgaugaagagacuggcuaucggaaaaucaucgagcgacugaauaacaagaaagggaagaauaaguugcuagacggagaaagacuggcugaucgcaaaauugccgaacucuucagcacaaagacccacaucgguuga

SEQ ID NO: 10408 - RNA, 5055 nt, Artificial Sequence
  derived and/or modified CDS sequence (opt3) from CCHFV(UCCR4459)__KY484032.1__GP
auguacacuccccugcucugcgccgugcuuugucugcaguuguggagcuuagagggcucccacgggcugucuaacaagacacaacauucaaauaccaguacgaccaaagcuccugaagucagccaggaguucggacuaccaguuuccacagugucuacuaucaccucggacccgcccucaauuacaagcgcaguaaguguguccgguucugaaggcagcggggauaccaacacuuccccuucagucacaacccagggacucacgcugccagagacuacccuugaacuguugacaacuaccgacacagaugccaguagcaccgugguuguggacgucucuacgcagacugugaaggauacacccauauccaccacucacacaucacucccuagcaccccaagugcgacgaccacaccccaaggcacucaucacaccgcuagaggucugcugucuguaacauccacuaaaccugagggggccagcacccaggcaaauccagagaagaucucgauggaaacaaacucuccgaggcucgccauuuccgagacccccucauuuaguccuacuacgcaggcuccaacagaaaauagcaaccccaucaccuccaaacaguuaauuuucucugcacaaccuguuacuccaaaucccgugaccccgccuguccagcccgcccugagccagucagacacaaguaccgcuauccaggauauacauccauccccuacuagccggucuaagcgcaaccuugagauggagaucauuuugacacugucacaaggacuaaagaaauauuacggcaagauccucaaacugcuugaccugacguuggaagaggauaccgaaggccuccuggaguggugcaagcgaaauuuagggcuggugugugacgaugacuuuuuccagaaacguauugaagaguuuuuccucacuggagagggucacuuuaacgaagugcuucaguucaagacacccaguacccugagcccaacaggccccgccagaacuggguccccuaccgucgagccauuuaagucuuauuucgcgaaaggauuuuugucgauggauagcggcuacuucuccgcaaagugcuauccgagggccucaaauaguggucuacaacugaucaacguuacgcagcacucuacccggauaacagacacucccgggccuaaagugaccaaucucaagacaauuaacuguaucaaucugaaagcuagcguauuuaaggaacaucgcgagauugaaaucaacgugcuucugccacaggucgccgugaacuuguccucaugccacguucucaucaaaagccaugugugugacuacucucuggauauugacggacccgucagauuaccuaggauacaccacgagggcacuuucaucccaggcaccuauaagcuggugauugauaagaaaaauaagcagaacgaccggugcacgcuaaucacaaauuguguaauaaaagggcgcgagauucgaaagggacaauccguucucagacaguacaggaccgaaaucaaaaucgguaaggcaaguagcggcucucggcgucugcuuuccgaggaaucaggggaugacugcauuagucgcacucaguugagcagaacagagaccgcugaaauccauucggauaacuacggaggccccggugacaagauuacuauauguaauggguccaccaucguggaucagaggcugggcucugagcucggaugcuauacaauuaaccgggucaaaaguuucaagcugugcgaaaauucagccacgggcaaaaguugugagaucgacuccaccccgaucaagugccgacaaggguuuugucuuaaaauuacucaggagggacgcggucacgugaagcugucuagaggcagcgaagucguguuggaugcgugcgacuccucaugugagauaaugaucccuaaggggacaggagacauucucguugauugcagcggcggucagcagcauuuccugaaagacaacuuaaucgaucugggguguccaaauauuccccuacucggcaagauggccaucuacauaugcaggaugaguaaccacccuaaaaccacaauggcauuucuguucugguuuucuuucggauaugugaucacuuguauucuuugcaagguaaucuuuuacuugcugauugucgugggcacccucgggaaaaaguucaagcaauaucgggagcugaaaccccagacguguacaaucugcgaaaccacuccaguuaaugcuauagacgccgagaugcaugauuuaaacugcuccuacaauauuuguccuuauugcgcuagccgccugaccucggacggacuugccagacacgugaugcagugucccaagaggaaagaaaaggucgaggaaacagaguuguaccucaaccuggagcguaucccaugggugguacggaaacuacuucaggugucagaaucuacugguguugcacucaagcgaaguuccuggcuggucgugcuuuuggugcuguuaaccgucagccucucuccgguucaaagcgccccuauuggccacgggaaaacaguggagacguaccagaccagagaaggauauacuuccaucugccuguuugugcuuggcucaauacuguucaucguaaguuguuugaugaagggucucgucgauagcguggggaauagcuuuuuccccggccuguccauuugcaagacauguucaaucggaaguauuaacggcuuugagaucgaaagccauaaaugcuacuguucccuauucugcuguccauauugcaggcacugcucugcugaccgcgagauacauaagcugcaccucucgauuuguaaaaagcggaaaaccgggagcaacguuaugcuggcggugugcaagagaauguguuucagggcaacugucgaggugucaaauaaggcccuuuugauccgcaacaucauuaauacaaccuuuguugugugcauccugauuuuagcuguaugugucguguccacgagugccguggaaauggagucucuccccgcaggaacuugggaacgagaggaagaucugaccaacuucugccaccaggagugucaagucacagagaccgaaugccuuuguccuuacgaggcccugguucuacggaaaccacucuuuagcgacuccauagugaagggcaugaaaaaucuguugaacucaacuucucuggaaacaucuuuaaguaucgaggcucccuggggugccauuaauguacaguccaccuucaagccuacagugagcgcagcgaacaucgcucucucuuggucauccgucgagcaucgugggaauaaaauucuggugaguggaagaagcgaaucgaucaugaagcuggaggaaaggacuggcauaucuugggaucuggguguugaggacgccuccgaaagcaaguugcucaccgugucaaucauggaucugagucagauguauucuccggucuuugaguaccuauccggcgaccgccagguggaggaauggccaaaagcaacgugcacaggggacugucccgagcggugcggaugcaccagcucaacuugucugcacaaggaauggccucauaguagaaacuggaggugcaauccaaccugguguuggggcguugggacaggaugcacuuguugcggccuugaugugaaagaccucuucaccgauuauauguuugucaaguggaaaguagaguacauuaagacggaagccaucguguguguugagcugacaagccaagagcgacagugcuccuugauugaagcugguacccgcuucaaccuggggcccgugacuaucacauuaucugagccucggaauauacagcagaagcucccgcccgaaauugucacccugcacccaagaaucgaggaaggauuuuucgaccuuaugcaugugaaaaagguacugagcgccuccacuguguguaaauugcaaucaugcacacacggcgucccuggugaucuccagguuuaccacaucggcaaccugcuaaagggggacaaagugaauggacaucugauucacaagauagagccccauuuuaacaccucuuggaugaguugggauggcugugaccuugauuauuacugcaacaugggggacuggccaucgugcagcuauacgggagugacucagcacaaucaugcagcuuucgucaacaugcucaauaucgagaccgauuacacaaaaauuuuucacuuccacuccaagagggugaccgcccauggcgacacaccucagcuggauuugaaggcgcgucccacuuauggugccggggaaaucaccguuuuaguagagguggcugacauggaacugcacacgaaaaagauugagaucucuggacucaaauucgcaucacugacauguacuggcugcuacgccuguagcuccgguauaaguugcaagguccgcauccauguggacgagccagaugaacuuaccguucacgugaaaucugaggacccggauauugucgcugccagcucaucccugauggcacggaaguuggaauuuggcacagacaguaccuucaaggcguuuagcgccaugccuaaaacuucucuauguuucuauaucguggagagagaauacugcaaguccuguucaaaagaggauacccaaaagugcguaaacacaaaacuggagcagccccagagcauucucaucgaacacaaggggacgauaauuggaaagcaaaaugacacuuguaccucgaaagcuggcugcuggcuggagucugucaagagcuuuuucuacgggcuuaaaaacauguuauccggaaucuuuggcaauguguucaucgguauuuuucuguuccucgccccauuuaucuugcugauacucuucuucauguuuggguggaggauucuguucuguuuuaagugcugccgacggacacgcggacuuuucaaauauagacaucugaaggaugacgaagagaccggcuacaggaagaucauugaacgguugaacaauaaaaagggcaaaaacaagcuacuggauggggagcgacucgcagacagaaaaaucgcugaguuauuuagcacuaagacacacauaggauga

SEQ ID NO: 10409 - RNA, 5052 nt, Artificial Sequence
  derived and/or modified CDS sequence (opt3) from CCHFV(Ast149)__KX056054.1__GP
augcacacccugcucgugugcuucauccuuuaccugcaguugagcggcuuagggggagcccauggucaauccaacgcuacagagcacaauggcacuaacacgaccacagcacccgggacuucucagucaccuaagccaccggccaguaccacacccccucauaccccagaaagcuccacugucaaacugacaacccccacgucugagacugaaggaucgggcgagaccacaccuccacccaauacuacccagggucuaccuccaccggggacaacccccgaaagaccugcgacgacugcuacaucaaccagcaguacugacaacaugaacuccacaacccagguuacggauaauaccccaacaucuacugugagcaccucccccucaaguagcccuucuaugccauccacaucacaagggauucacuaucccguaaggagccuccugagugugucuuccccgaagacugucaccacaccuacccccaugagcccaggcgagaugucgccugagacuucuucccagcauucagccaugagucggauacccacgcuuuacacagcagcccaggugagcaccgaaaaugcuaaccgcuccacuccacgacagucugagagcucagcacaacccgccacccagaguccuacaaccuuuccagcucagacuauccuguugauguccgccgcgccgaaagcaauucaggacaugcaccccagcccuacaaaucguucuaagagaaaccucgaaguugagaucauucugacgcugucacaaggccucaaaaaguauuacgggaagaucuuaaaacugcuucacuugacccuggaggaagauacugagggacuacucgaaugguguaagaggaaucuggguaguaacugcgacgaugacuucuuucagaaacggauagaggaguucuuuaucacaggcgaaggguauuucaaugaggugcuucaguuuaagacccugagcacauuguccccaacugaacccucucauguccgccucccuaccgccgagccauucaaaucguacuuugcuaagggauuccugagcauugauuccggcuauuuuucagccaaguguuaccccagaaguucuacgagcgguuuacaacugaucaacgugacccagcacccggcaaggauugcugaaacaccugggccaaaaacuaccucccucaagacaaucaauugcauaaaccuucgggccucaguauucaaagagcaucgcgaaguugagauuaacgugcuguugccccagaucgcggucaaucuaagcaacugucacguggugauuuacucucacgucugcgacuauucccuggauacugacggaccuguucgacuccccagaauccaucacgagggcaccuuuaucccaggcacguacaagauugugauagauaaaaagaauaaacugaacgacagguguagucuuguaacaaauugcgugaucaaggggcgggaaguccguaagggacagagcgugcugcgccaauauaaaaccgagauuaagaucgguaaagccucuacuggcuccagaaaguugcucucagaggaaccuggggaugacuguauaaguaggacacagcuguuaaaaaccgaaacugcagagauucaugacgauaacuacggaggccccggugacaagaucaccaucugcaaugggagcacaauuguugaucagcggcugggcucggagcuaggauguuauacgaucaaccgagugaaguccuucaaacucugcgaaaauucugcuaccggcaagacuugcgagauugacagcacaccagucaaaugucgccagggguucugccugaagauaacccaagaaggaagaggucacgugaaacuuucaaggggcagugagguaguuuuggaugccugugacuccucuugcgagaucaugauuccgaaggggacaggagauauccugguggacuguagcggcggucagcagcauuuucucaaggauaaccugaucgaccuugggugcccucacauuccccuguugggcaaaauggcuauauacaucugucggauguccaaucacccacgcacuaccauggccuuccucuuuugguucucauuuggauaugucauuacgugcaucuucuguaaggcacuguuuuacagcuuaauuaucauaggcacacuggggaaaaagaucaaacaguacagagaacuaaagccccaaaccugcacuauuugugagaccgccccugugaacgcuaucgaugcggaaaugcaugaccucaauugcaguuauaacauuugcccauacugugcaucuaggcugacauccgacggacuugcccgucacgucacucagugccccaagcggaaagagaagguggaagagaccgaguuguaucugaaucucgaacgaaucccuuggauaguuagaaaacuguuacaggugagcgagucgacagguguagcucugaagaggucaucuuggcuuauugucuugcucgugcugcuaacgguuagucuguccccggugcagagcgccccagucggccaugggaaaaccaucgaaacuuaccaaacacgcgagggauucaccaacauuugucucuuuaugcugggcucuauccuuuucauagugagcugcuugguaaagggucugguggauuccguuucagacucauuuuuccccggguuaagcgucuguaaaacuugcucuaucggcuccauuaacggauuugaaaucgagucacacaaguguuauugcagucucuucuguugcccuuacugucggcacugcagcgcagauagagagauucaucagcugcaccuuggcaucugcaagaaaaggaagacaggguccaaugugaugcuggccguguguaaacgcaugugcuucaaggcuaccauagaagccucucgacgggcauugccaauucguucgaucaucaacacgacuuuugucauuuguauccucacccuggcgauuugcguugugagcacaucagcuguggagauggaaaaucuacccgccggaaccugggagagagaagaggaccugacuaacuucugucaucaggagugccaaguaacagaaaccgagugucucugcccuuaugaagcacugguccuuaggaaaccguuguuucuggauuccauagugaagggcaugaagaauuuacucaacaguacaucucuggagacuagccuuuccaucgaggcccccuggggugcuauuaauguucagucaaccuucaaaccaacggugucuacagccaacaucgcacugagcuggaguuccgucgaacaccgcgggaauaagauucuagugaccggacggagcgagucuaucaugaaacucgaagagagaacuggcguuucaugggaccuggguguggaagaugcuuccgagaguaaguugcugaccguaagcauaauggacuuaucgcagauguacucuccugucuuugaguaccucuccggcgaucgacagguggaagaguggcccaaagccacauguacuggggacugcccagaaagguguggaugcaccagcucaacgugccugcauaaggaguggccucacagucgcaacuggcgguguaaucccacauggugcuggggcguggggaccggauguacuugcuguggcgucgauguuaaggaccuuuucacagaucacauguuuaucaaauggaagguggaauauauuaaaaccgaggcgaucguaugcguggagcugacuucucaagaaagacaguguuccuugauugaggccgguacaagguucaaccucgggccagucaccaucacgcugagcgaaccgcguaauauacagcagaagcuaccucccgagauuaucacucugcauccaaaaaucgaagagggauuuuucgaccuuaugcacgugcaaaagguucucucagcuaguaccgugugcaagcugcagagcuguacacauggcauucccggugacuugcagauauaccacaucggcaaccuguuaaaaggggaucgccucaauggacaucugauucacaagaucgagccucacuuuaacaccuccuggaugucuugggacggcugcgaucuugacuauuacuguaacaugggggauuggccaagcugcacauauacuggagucacccagcauaaucacgcagccuucgugaaccuguugaauauugaaacggacuacacaaaaacuuuucauuuccacuccaagcggguuaccgcucacggcgauacaccccaacucgaccugaaagccagaccuaccuauggugcaggggagaucacugugcuagucgaaguagcggauauggagcugcauaccaagaaaguggagguuucaggacuuaaguucgccucucucgcuugcacaggcuguuacgccugcaguucggguauaagcuguaaggugaggauccacgucgacgaaccggaugagcugacggugcauguaaaauccucugacccagauguggucgcagcuucaacuagcuugauggcccgaaaguuagaauuuggcaccgacuccacauucaaagcauuuagugccaugcccaagaccucucugugcuucuacauuguugagcgggaauauuguaaaagcugcucagaggacgauacuaagaaguguguggacacaaaacucgagcagccucaguccauccugauugaacacaaggggaccaucauaggaaaacaaaacgauacgugcacugcuaaggcgaguuguuggcuugagagcgugaaauccuuuuucuacggccugaagaauauguuggggucugucuuuggaaacuucuuugugggcauucuacuguuccucgcccccuuuguucugcuugcauuauucuucaucuuugguuggaagauccuguucugcuuuaaauguugccgcagaacaaggggacucuucaaguaucggcauuugaaagacgaugaagagaccggauaccgaaagauuaucgaaagacugaauaguaaaaagggcaagaaccgccuccuggacggcgagaggcuugcugaucguaaaauagccgagcuguuuagcaccaagacucacauuggguga

SEQ ID NO: 10410 - RNA, 5052 nt, Artificial Sequence
  derived and/or modified CDS sequence (opt3) from CCHFV(Ast137)__KX056057.1__GP
augcacacccugcucgugugcuucauccuuuaccugcaguugagcggcuuagggggagcccauggucaauccaacgcuacagagcacaauggcacuaacacgaccacagugcccgggacuucucagucaccuaagccaccggcaaguaccacacugccccauaccccugaaagcuccacuguuaaacuaacaaccccaacgucugagacugaaggaucgggcgagaccacacccccuccaaauacuacccaggguuuacccccuccagggacaaccccggaaagacccgccacgacugcgacaucaaccagcaguacugacaacaugaacuccacaacccaggugacggauaauaccccuacaucuacuguaagcauuuccccaucaaguagccccucuaugccuuccaccucacaaggaauacacuauccagugaggagccugcuuagugucucuucccccaagacagugacuaccccgacaccuaugagccccggcgagaugucgccagagaccucuucccagcauucagcuaugagucggaucccuacucuguacacggccgcacagguuagcacagaaaauaccaaccgcuccacuccccgacagucugagagcucagcccaaccagcuacccagagucccacaaccuuuccugcacagacuauuuugcucauguccgccgcuccaaaagccauccaggacaugcacccgagccccacaaaucguucuaagagaaaccuggaaguggagauuauccugacgcucucacaaggccucaaaaaguauuacgggaagauacugaaacuuuugcaccugacccuagaggaagauacugagggacuccuggaaugguguaagaggaaucuugguaguaacugcgacgaugacuucuuucagaaacggaucgaggaguucuuuauuacaggcgaaggguauuucaaugagguccugcaguuuaagaccuugagcacacucuccccuacugaaccaucucaugugcgccugcccaccgcggagccuuucaaaucguacuuugcaaagggauucuuaagcaucgauuccggcuauuuuucagccaaguguuacccaagaaguucuacgagcggucugcaacucauuaacguaacccagcaccccgcuaggaucgccgaaacaccggggccuaaaacuaccucccuuaagacaauaaauugcauuaaccugcgggcaucaguuuucaaagagcaucgcgaaguggagaucaacgucuugcuaccacagauugcugugaaucugagcaacugucacguggucaucaauucucacguuugcgacuacucccucgauacugacggacccgugcgacugccuagaauccaucacgagggcaccuuuauucccggcacguauaagauaguaaucgauaaaaagaacaaacuuaaugacagguguagucuggugacaaacugcgucauuaaggggcgggaagugcguaagggacagagcguuuugcgccaauacaaaaccgagaucaagauagguaaagccucuacuggcuccagaaagcuccugucagaggaaccaggggaugacuguauuaguaggacacaguuacugaaaaccgaaacugcggagauccaugacgauaauuauggaggcccuggugacaagaucaccauuugcaacgggagcacaaucguggaucagcggcuaggcucggagcucggauguuacacgauuaaucgagucaaguccuucaaacugugcgaaaacucugccaccggcaagacuugcgagauagacagcacacccgugaaaugucgccagggguucugccuuaagaucacccaagaaggaagaggucacguaaaauugucaaggggcagugagguugugcuggaugcaugugacuccucuugcgagauuaugaucccaaaggggacaggagauauccucgucgacuguagcggcggucagcagcauuuucugaaggauaaucuuauugaccuggggugcccgcacauaccuuugcucggcaaaauggcuauccacauuugucggauguccaaccauccccgcacuaccauggccuuccuguuuugguucucauuuggauaugugaucacgugcauuuucuguaaggcuuuauuuuacagccugaucauaaucggcacacuagggaaaaagauuaaacaguauagagaacucaagccacaaaccugcacuaucugugagaccgcccccgucaaugcaauugaugccgaaaugcacgaccugaacugcaguuacaauaucugcccuuacugugcuucuaggcuuacauccgacggauuggcgcgucaugugacucagugcccaaagcggaaagagaagguugaagagaccgagcuguaucucaaccuggaacgaauacccuggauugugagaaaauuacugcagguaagcgagucgacaggugucgcacuuaagaggucaucuugguugaucgugcuccugguucuacugacggugagucucuccccuguccagagcgccccggugggccacgggaaaaccauugaaacuuaccaaacacgcgagggauucaccaacaucugucuguuuaugcuuggcucuauauuguucaucguaagcuaucuggugaaggguuuaguugauuccgucucagacucauuuuucccagggcucagcgugugcaaaacuuguucuauuggcuccaucaauggauuugaaauugagucacacaagugcuacuguagucuguucugcugucccuauugccggcauuguagcgcugauagagagauccaccagcuucaucugggcauaugcaagaaaaggaagacaggguccaacgugauguuggccgucugcaaacgcauguguuucaaggcaaccauugaagccucucgacgggcucuccugauccguucgaucauuaauacgacuuuuguuaucugcauucuaacccuggccauauguguggugagcacaucagcaguagagauggaaaaccucccugcgggaaccugggagagagaagaggaccugacuaauuucugccaccaggagugucaagucacagaaaccgagugccuuuguccauacgaggcuuuggugcugaggaaacccuuauuucucgauuccaucguuaagggcacaaagaaccugcuuaauaguacuucucuggaaaccagccuauccauugaggccccuuggggugcaaucaacgugcagucaacguucaaaccgacagucucuaccgccaauauugcucucagcuggaguuccguggaacaucgcgggaacaagauccugguuacuggacggagcgagucuauaaugaaauuggaagagagaaccggcgugucaugggaccuggguguagaagaugccuccgagaguaaguuacucacagucagcaucauggaccugucgcagauguauucucccguguuugaguaccuuuccggcgaucgacagguggaagaguggccaaaagcaacuugcaccggggacuguccugaaaggugcggauguacgagcucaacaugccugcacaaggaguggccccacagucgcaauuggcggugcaacccaaccugguguuggggcgucgggacuggaugcacauguugcggcguugaugugaaggacuuguucaccgaucauauguuuauuaaauggaagguagaauacaucaaaacugaggcuauugugugugucgagcucacaucucaagaaagacagugcucccugaucgaggccgguaccagguucaaucuagggccugugacgauaacucugagcgaaccccguaacauucagcagaaacuuccaccggagaucaucacccuccacccuaaaauugaagagggauuuuucgaccugaugcauguucaaaagguguugucagcgaguacagucuguaagcugcagagcugcacccacggcauacccggugacuuacagaucuaucauauuggcaaucuccugaaaggggaucgccuuaacggacaccugauccacaagauugagccacauuuuaacacauccuggaugucuugggacggcugugauuuggacuacuauugcaauaugggggauuggcccagcuguacuuacaccggagugacgcagcacaaccaugccgcuuucguuaaucuccugaacaucgaaacagacuauacuaaaaccuuucacuuccacuccaagcgggugacagcacauggcgauaccccucaacuagaccugaaagccagaccaacuuacggugcuggggagauaaccguccuuguagaaguggccgauauggagcuccacacaaagaaaguugaggugucaggacugaaguucgcaucuuuggcgugcacgggcugcuaugccuguaguucggguaucagcugcaaggucaggauucauguggacgaacccgaugaguuaacuguacacgugaaauccucugacccugaugucguugcugccucaaccagccugauggcacgaaagcucgaauuuggcacagacuccaccuucaaggcuuuuagugccaugccgaagacuucucuguguuucuacaucguggagcgggaauacugcaaaagcuguucagaggacgauacaaagaagugcguggacaccaaacuugagcagccacaguccauucugaucgaacauaaggggacgauaauuggaaaacaaaaugauacuuguacagcaaaggccaguugcugguuggagagcgucaaauccuuuuucuauggccuaaagaacaugcuggggucuguguuuggaaauuucuuuguuggcauccuccuguuccuugcucccuuuguauuacugguccucuucuucaucuuugguuggaagauuuuguucuguuuuaaaugcugucgcagaaccagggggcuguucaaguaccggcaccucaaagacgaugaagagaccggauaucgaaagaucauagaaagacugaacaguaaaaagggcaagaaucgccuucuggacggcgagagguuggcggaucguaaaauugccgagcuauuuagcacuaagacacacaucggguga

SEQ ID NO: 10411 - RNA, 5055 nt, Artificial Sequence
  derived and/or modified CDS sequence (opt3) from CCHFV(C-68031)__DQ211629.1__GP
auguacacuccccugcucugcgccgugcuuugucugcaguuguggagcuuagagggcucccacgggcugucuaacaagacacaacauucaaauaccaguacgaccaaagcuccugaagucagccaggaguucggacuaccaguuuccacagugucuacuaucaccucggacccgcccucaauuacaagcgcaguaaguguguccgguucugaaggcagcggggauaccaacacuuccccuucagucacaacccagggacucacgcugccagagacuacccuugaacuguugacaacuaccgacacagaugccaguagcaccgugguuguggacgucucuacgcagacugugaaggauacacccauauccaccacucacacaucacucccuagcaccccaagugcgcccacgaccccucaaggcacacaucacacugcuagaggucugcugucuguaaccuccacaaaaccagagggggccagcacucaggcaaauccggagaagaucucgauggaaaccaacucucccaggcucgccauuuccgagacaccuucauuuaguccaaccacucaggcucccacggaaaauagcaacccuaucacauccaaacaguuaauucugucugcacaaccaguuacccccaauccggugacuccucccguccagccagcccuuagccagucagacaccaguacagcuauccaggauauacauccuucccccaccagccggucuaagcgcaacuuggagauggagaucauucugacucuaucacaaggacucaagaaauauuacggcaagauccugaaacuucuggacuugacacucgaagaggauacggaaggccuguuagaguggugcaagcgaaaucuggggcucgugugugacgaugacuucuuucagaaacguauugaagaguucuuucuuaccggagagggucacuucaacgaagugcugcaguuuaagacuccaaguacauugagccccaccggcccugccagaacaggguccccaacugucgagccguucaagucuuauuuugcgaaaggauuccuaucgauggauagcggcuacuuuuccgcaaagugcuaucccagggccucaaauaguggucugcaacucaucaacguuacccagcacucuacgcggauaaccgacacaccugggccaaaagugacuaaucugaagaccauuaacuguaucaaucuuaaagcuagcguauucaaggaacaucgcgagauugaaaucaacgugcuguugccccaggucgccgugaaccucuccucaugccacguucugaucaaaagccaugugugugacuacucuuuagauauugacggaccugucagacugccaaggauacaccacgagggcacauuuauccccggcacuuauaagcuagugauugauaagaaaaauaagcagaacgaccggugcacccucaucacgaauuguguaauaaaagggcgcgagauucgaaagggacaauccguucugagacaguacaggacagaaaucaaaaucgguaaggcaaguagcggcucucggcgucuuuuguccgaggaaucaggggaugacugcauuagucgcacccagcugagcagaacugagacagcugaaauccauucggauaacuacggaggcccgggugacaagauuaccauauguaauggguccacuaucguggaucagaggcucggcucugagcugggaugcuauaccauuaaccgggucaagagcuucaaacuuugcgaaaauucagccacaggcaaaaguugugaaaucgacuccacgccuaucaagugccgacaaggguucugucugaaaauuacccaggagggacgcggucacgugaaguugucuagaggcagcgaagucgugcucgaugcgugcgacuccucaugugagauaaugaucccaaaggggacuggagacauucugguugauugcagcggcggucagcagcauuuucuuaaagacaaccugaucgaucuagggugucccaauauuccucuccugggcaagauggccaucuacauaugcaggaugaguaaccaccccaaaacaaccauggcauucuuauuuugguucucuuuuggauaugugaucacauguauuuugugcaagguaaucuucuaccugcucauugucgugggcacucuggggaaaaaguuuaagcaauaucgggaguuaaaaccacagaccuguacgaucugcgaaacaaccccuguuaaugcuauagacgccgagaugcaugaucugaacugcuccuacaauauuugucccuauugcgcuagccgccuuacuucggacggauuggccagacacgugaugcaguguccaaagaggaaagaaaaggucgaggaaaccgagcucuaccugaaccuagagcguaucccgugggugguacggaaacugcuccaggugucagaaucuacagguguugcacugaagcgaaguuccuggcuugucguguugcugguguuacucacugucagccugucuccuguucaaagcgcccccauuggccacgggaaaaccguggagacauaccagacgagagaaggauauaccuccaucugccuuuucgugcugggcucaauauuguuuaucguaaguugucucaugaagggucuggucgauagcgugggcaauucuuucuuuccagggcuauccauuugcaagacuuguucaaucggaaguauuaacggcuucgagacagaaagccauaaaugcuacuguucccuguuuugcugucccuauugcaggcacugcucugcugaccgcgagauccauaagcuccaccugucgauauguaaaaagcggaaaaccgggagcaacguuaugcuugcggugugcaagagaauguguuucagggcaacugucgaggugucaaauaaggccuugcugauucgcaacaucaucaauacaaccuucguugugugcauuuuaauccucgcuguaugugucguguccacgagugccguggaaauggagucucugccugcaggaacuugggaacgagaggaagaucuuaccaacuuuugccaccaggagugucaagucacagagaccgaaugccuguguccauacgaggcccuaguucuccggaaaccccuguucagcgacuccauugugaagggcaugaaaaauuugcugaacucaacuucuuuagaaacaagccucaguauagaggcuccuuggggugccaucaauguacaguccaccuuuaagccgacagugagcgcagcgaacauugcucugucuuggucauccgucgagcaucgugggaauaaaauccuugugaguggaagaagcgaaucgauuaugaagcuggaggaaaggacuggcaucucuugggauuuggguguugaggacgccuccgaaagcaagcuccugaccgugucaauaauggaucuaagucagauguauucuccagucuucgaguaccuguccggcgaccgccagguggaggaauggcccaaagcaacgugcacaggggacuguccugagcggugcggaugcaccagcucaacuugucuucacaaggaauggccacauaguagaaacuggaggugcaaucccaccugguguuggggcguugggacaggaugcacuuguugcggccucgaugugaaagaccuguuuaccgauuauauguucgucaaguggaaaguagaguacaucaagacggaagccauuguguguguugaguugacaagccaagagcgacagugcucccugaucgaagcugguacccgcuuuaacuuagggccugugacuauuacacucucugagccgcggaauauccagcagaagcugcccccagaaauagucacccuucacccuagaauugaggaaggauucuuugaccugaugcaugugaaaaagguauugagcgccuccacuguguguaaacuccaaucaugcacacacggcguccccggugaucugcagguuuaccacaucggcaaccuacugaagggggacaaagugaauggacaucuuauccacaagauugagccacauuucaacaccucuuggaugaguugggauggcugugaccucgauuauuacugcaacaugggggacuggccuucgugcagcuauacgggagugacucagcacaaucaugcagcuuuugucaacaugcugaauauagagaccgauuacacaaaaaucuuccacuuucacuccaagagggugaccgcccauggcgacacaccccaguuggauuuaaaggcgcguccaacuuauggugccggggaaauuaccguucugguagagguggcugacauggaacuccacacgaaaaagaucgagauuucuggacugaaauucgcaucacuuacauguacuggcugcuacgccuguagcuccgguaucaguugcaagguccgcauacauguggacgagccggaugaacugaccguucacgugaaaucugaggacccugauaucgucgcugccagcucauccuugauggcacggaagcuagaguucggcacagacaguaccuuuaaggcguucagcgccaugcccaaaacuucucuguguuuuuauauuguggagagagaauacugcaaguccuguucaaaagaggauacccaaaagugcguaaacacaaaacucgagcagccacagagcauccugauugaacacaaggggacgaucauaggaaagcaaaaugacacuuguaccucgaaagcuggcugcuggcuugagucugucaagaguuucuuuuacgggcuuaaaaacaugcuguccggaauuuucggcaauguguuuaucgguaucuuccucuuuuuggcccccuucauucugcucauccuguuuuucauguucggguggaggauauuauuuuguuucaagugcugccgacggacacgcggacuguuuaaauauagacauuugaaggaugacgaagagaccggcuacaggaagauuaucgaacggcuaaacaauaaaaagggcaaaaacaagcugcucgauggggagcgauuagcagacagaaaaauugcugagcuguucagcacuaagacacacaucggauga

SEQ ID NO: 10412 - RNA, 5052 nt, Artificial Sequence
  derived and/or modified CDS sequence (opt3) from CCHFV(K340_6)__KX013475.1__GP
augcacacccugcucgugugcuucauccuuuaccugcaguugagcggcuuagggggagcccauguccaauccaacgcuacagagcacaaugguacuaacacgaccacagcacccggcacuucucagucaccuaagccaccggccaguaccacacugccccauaccccugaaagcuccacuguuaaaccaacaacccccacgucugagacugaagggucgggagagaccacaccuccacccaauacuacccagggccuaccuccaacagguaccacgccggaaagaucagcgacuacagcuaccagcacaaguuccacagacaacaugaauagcaccacccaggugaccgauagcacacccacuuccaccguaucaacaaguccuucuucuuccucaagcaugccaaguacuucucaagggauucaccaucccgugaggucccuccugagcgucucgucuccuaagaccgugacaaccccaacucccauguccccgggagagaugucaccugagacgaguagccagcacuccgccaugucucggguucccacacuuuauaccgcaacucaggugagcaccgaaaacacagaccgcucaaccccacgacagagugaguccagcguccaaccugccacucagucucccauaacaucaccagcucagacgauccuguugaugagugcagcccccaaagcuauucaggauaugcacccuagcccaaccaaucguuccaagagaaaccucgaaguggagaucauucugacucugucucaaggccucaaaaaguacuauggcaagaucuuaaaacugcuucauuugacacuggaggaagacaccgaggggcuacucgaaugguguaagaggaaucugggaucgaacugcgaugacgacuuuuuccagaaacggauagaggaauuuuucaucacaggugagggcuacuuuaaugagguacuucaguucaagacucugagcaccuuguccccgacggaacccucacacguucgccucccuaccgccgagccauuuaaaaguuauuucgcgaagggguuucugucuauugauagcggauacuucuccgcaaaguguuaucccagaucaagcacaucuggcuuacaacugaucaacgugacucagcauccugccaggauugcugaaaccccaggucccaaaacaacuucccucaagaccaucaauugcauaaaccuucgggccagugucuuuaaagagcaccgcgaaguggagauuaaugugcuguugccgcagaucgcagucaaccuaagcaacugucacguugugauuaauucucauguaugcgauuacucccuggacacggaugggccugugcgacucccaagaauccaccaugagggaacauucauccccggcaccuacaagauugucauagacaggaaaaacaagcugaaugaucgguguucacuugugacuaacugcguuaucaaaggccgugaagugcgcaaggggcagaguguccugagacaauauaagacagagauuaaaaucggaaaggcuagcaccgguucgaggaaauugcucuccgaggaaccuggcgacgacuguauaucucggacucagcuguuaaagaccgaaacagccgagauucacgaugacaauuacgggggacccggcgauaaaaucacgaucugcaacgguagcaccauuguggaccagcgacuggggucagagcuaggcuguuauacuaucaaucgcguaaagaguuuuaagcucugcgaaaacuccacaaccggaaaaacaugcgagauugauucuacuccaguuaaguguagacagggcuucugccugaaaauaacccaagaagggaggggacaugugaagcugagccgggguuccgaggucguguuggacgcgugugauucaagcugcgagaucaugauuccuaaaggcacgggggacauccuggucgauuguaguggaggccagcagcacuuccucaaggacaaucugaucgaucuugguugcccccacauuccaccgcuggggaagauggccauauacaucugucgcaugucuaaccauccuagaacaaccauggcauuuuuguucugguuuuccuucggcuaugugauuacuugcaucuuuuguaaagcucucuucuacagccugauuaucauaggaaccuuaggcaagaaaaucaagcaguauagggaacugaaaccccaaacaugcacuauuugugagaccgccccaguuaaugcuaucgacgccgaaaugcacgaccuaaacugcucguacaauauuugccccuacugugcaucacgucucacaucugaugggcuggcccggcaugugacgcagugcccuaagcgaaaggagaaaguagaagagaccgagcuuuauuugaaccuggaaagaaucccauggauagucaggaagcuccuucaggugagugaguccacuggaguugcuuuaaaacgcagcucuuggcugauugugcuuuugguccuccugacagugagccuaucccccguacagucagcgccugugggucacggcaagaccaucgaaacuuaccaaacacgggagggguuuaccaguauuugucuguucaugcucggaagcauccuguuuauaguuucuugccuugucaaaggcuugguggacuccgugucagauaguuucuuuccgggucugagcgucuguaagacgugcuccaucgggucuauuaauggcuucgaaaucgagucgcacaaauguuauugcagcuuauuuuguugcccauacuguagacauugcucagcagacagggagauucaccagcuccaucuguccaucugcaagaagcgcaaaacuggaaguaacguuaugcuugccguguguaagcgaaugugcuucaaagcuaccauagaagccucucggcgugcacuguugauuagaagcaucaucaacacaaccuucgugauguguauucucacucuggccaucugcguagucuccacaucagcuguggagauggaagaucuacccgccggcaccugggagagggaagaggaccugacaaauuuuugucaccaggagugccaaguuacugaaaccgagugucucugcccuuaugaagcacuggugcuucgcaagccauugucucuggauagcauugucaaagggaugaagaacuuacucaauaguacgucccuggagacaagccuuucuauagaggcgcccuggggagcuaucaacgugcagucaaccuucaagccuacuguuuccaccgccaauauugcacugaguuggagcucgguggaacaucggggcaacaaaauccuaguaacagguagaucugaguccauuaugaagcucgaagagaggacuggggucagcugggaccugggaguggaagaugccucagagaguaaauugcugaccgugucuaucauggacuuaucccagauguacagcccggucuuugaguaucucucaggcgaucgacagguugaagaguggcccaaggcuacguguacaggugacugcccagaacgcuguggcugcaccaguagcacuugccugcacaaagaguggccucacucccggaauuggagauguaaccccacauggugcuggggugugggaaccggcuguacuugcugugggguagaugugaaggaccuuuucacagaccauauguuuauaaaguggaaagucgaauacaucaagaccgaggccauugugugcguugagcugacgucucaagaaaggcaguguagcuugaucgaggcaggaacucguuucaaucucggcccagugaccauuacacuguccgaaccucgcaacauccagcagaaacuacccccagagauaauuacccugcacccgaagaucgaagagggguuuuucgaucuuaugcauguccaaaaagugcucucagcuucuacaguuugcaagcugcagaguuguacucacgggaucccuggagacuugcagauuuaccauauaggcaaucuguuaaagggugaucgggugaacggccaccucauccacaaaauugagccccauuuuaauaccucguggaugagcugggacgggugcgaucuggacuauuacuguaacaugggagauuggccauccugcacguauacaggcgucacucagcacaaucaugccgcguucguaaaccuucugaacaucgaaaccgacuacacaaagaccuuucacuuccacucuaaaagagugacugcccauggggauacgccccaauuggaccucaaggcuaggccuacauauggagcaggcgagauuacgguucugguggaagucacugauauggagcuacacaccaaaaagguggagaucucaggucugaaauuugccagccuuacaugcaccggguguuacgcuugcuccaguggaauaucuuguaagguacgaauccauguggacgaaccagaugagcucacuguccacguuaagagcucagaccccgacgugguggccgcauccacaagucugauggcgcggaaauuggaguucggcaccgauagcacguucaaggccuuuucugcuaugccuaaaacuuccuuaugcuucuauauugucgaacgcgaauacuguaagucaugcagcgaggacgauacuaaaaaguguguggacaccaagcuggagcagccgcagucgauccucauugaacauaaagguaccaucauaggcaagcaaaaugauacuugcacagccaaagcaucuuguuggcuggagaguguuaaguccuuuuucuacgggcuuaaaaacaugcugggaagcguauuuggcucauucuuuguggggauuuugcuauuccuggcuccauuuguccuccuggugcuuuucuuuauguucggauggaagaucuuauucugcuuuaaguguugcagaaggacccggggccuguucaaauaucgacacuuuaaggacgaugaagagacagguuacagacgcaucauugaaaggcucaauuccaaaaaggggaaaaaccguuugcuggacggagagcggcucgccgauagaaagaucgcagagcuguucucuacuaagacgcacauaggcuga

SEQ ID NO: 10413 - RNA, 5055 nt, Artificial Sequence
  derived and/or modified CDS sequence (opt3) from CCHFV(Hy13)__AY900145.1__GP
auguacacuccccugcucugcgccgugcuuugucugcaguuguggagcuuagagggcucccacgggcugucuaacaagacacaacauucaaauaccaguacgaccaaagcuccugaagucagccaggaguucggacuaccaguuuccacagugucuacuaucaccucggacccgcccucaauuacaagcgcaguaaguguguccgguucugaaggcagcggggauaccaacacuuccccuucagucacaacccagggacucacgcugccagagacuacccuugaacuguugacaacuaccgacacagaugccaguagcaccgugguuguggacgucucuacgcagacugugaaggauacacccauauccaccacucacacaucacucccuagcaccccaagugcgacgaccacaccccaaggcacucaucacaccgcuagaggucugcugucuguaacauccacuaaaccugagggggccagcacccaggcaaauccagagaagaucucgauggaaacaaacucuccgaggcucgccauuuccgagacccccucauuuaguccuacuacgcaggcuccaacagaaaauagcaaccccaucaccuccaaacaguuaauuuucucugcacaaccuguuacuccaaaucccgugaccccgccuguccagcccgcccugagccagucagacacaaguaccgcuauccaggauauacauccauccccuacuagccggucuaagcgcaaccuugagauggagaucauuuugacacugucacaaggacuaaagaaauauuacggcaagauccucaaacugcuugaccugacguuggaagaggauaccgaaggccuccuggaguggugcaagcgaaauuuagggcuggugugugacgccgacuuuuuccagaaacguauugaagaguuuuuccucacuggagagggucacuuuaacgaagugcuucaguucaagacacccaguacccugagcccaacaggccccgcgagaacuggguccccuaccgucgagccauuuaagucuuauuucgcaaaaggauuuuugucgauggauagcggcuacuucuccgccaagugcuauccgagggcuucaaauaguggucuacaacugaucaacguuacgcagcacucuacccggauaacagauacucccgggccuaaagugaccaaucucaagacaauuaacuguaucaaucugaaagccagcguauuuaaggaacaucgcgagauugaaaucaacgugcuucugccacaggucgcagugaacuuguccucaugccacguucucaucaaaagccaugugugugacuacucucuggacauugauggacccgucagauuaccuaggauacaccacgagggcacuuucaucccaggcaccuauaagcuggugauugacaagaaaaauaagcagaacgaucggugcacgcuaaucacaaauuguguaauaaaagggcgcgagauucgaaagggacaauccguucucagacaguacaggaccgaaaucaaaaucgguaaggcuaguagcggcucucggcgucugcuuuccgaggaaucaggggacgauugcauuagucgcacucaguugagcagaacagagaccgccgaaauccauucggacaacuacggaggccccggugauaagauuacuauauguaauggguccaccaucguggaccagaggcugggcucugagcucggaugcuauacaauuaaccgggucaaaucuuucaagcugugcgaaaauucagcgacgggcaaaaguugugagaucgauuccaccccgaucaagugccgacaaggguuuugucuuaaaauuacucaggagggacgcggucacgugaagcugucuagaggcagcgaagucguguuggacgccugcgauuccucaugugagauaaugaucccuaaggggacaggagacauucucguugacugcagcggcggucagcagcauuuccugaaagauaacuuaaucgaccugggguguccaaauauuccccuacucggcaagauggcaaucuacauaugcaggaugaguaaccacccuaaaaccacaauggcuuuucuguucugguuuucuuucggauaugugaucacuuguauucuuugcaagguaaucuuuuacuugcugauugucgugggcacccucgggaaaaaguucaagcaauaucgggagcugaaaccccagacguguacaaucugcgaaaccacuccaguuaaugccauagaugcugagaugcaugacuuaaacugcuccuacaauauuuguccuuauugcgccagccgccugaccucggauggacuugcaagacacgugaugcagugucccaagaggaaagaaaaggucgaggaaacagaguuguaccucaaccuggagcguaucccaugggugguacggaaacuauuacaggugucagaaucuacugguguugcccucaagcgaaguuccuggcuggucgugcuuuuggugcuguuaaccgucagccucucuccgguucaaagcgcuccuauuggccacgggaaaacaguggagacguaccagaccagagaaggauauacuuccaucugccuguuugugcuuggcucaauacuguucaucguaaguuguuugaugaagggucucgucgacagcguggggaauagcuuuuuccccggcuccucaauuugcaagacauguaguaucggaagcauuaacggcuuugagaucgaaucccauaaaugcuacuguucucuguucugcuguccauauugcaggcacugcucggcggaucgcgagauacauaagcuacaccugagcauuuguaaaaagcggaaaaccgggucaaacguuaugcucgcagugugcaagagaauguguuucagggccacugucgagguguccaauaaggcucugcuuauccgcaacaucauuaauacaaccuuuguugugugcaucuugauucuggccguaugugucgugaguacgucugcaguggaaauggagagcuuacccgccggaacuugggaacgagaggaagaccucaccaacuucugccaccaggagugucaagcuacagagaccgaaugccuguguccuuacgaggcccuuguccugcggaaaccacuauuuuccgauucaauaguuaagggcaugaaaaaucuccugaacucuacuagcuuggaaacaagucuguccaucgaggcacccuggggugcgauuaaugugcagagcaccuucaagccuacaguaucugcugccaacaucgcauuaucaugguccaguguggagcaucgugggaauaaaauucucgucagcggaagaucggaaucuaucaugaagcuggaggaaaggacuggcauauccugggaccuugguguggaggaugccagcgaaucaaagcuguugaccguuaguaucauggaccucucucagauguauuccccgguguuugaguaccugagcggcgaucgccaggucgaggaauggccaaaagcuacgugcacaggggacugucccgagcggugcggaugcaccucaaguacuugucuacacaaggaauggccucauagcagaaacuggaggugcaauccaaccugguguuggggcguggggacaggaugcacuuguugcggccuggacguuaaagaucuuuucaccgaccacauguuugugaaguggaaagucgaguauauuaagacggaagccaucguauguguggagcucacaucccaagagcgacagugcucucugauugaagcagguacccgcuucaacuuggggcccguuacuaucacacugagcgagccucggaauauacagcagaaguuaccgcccgaaauugugacccuccauccaagaaucgaggaaggauuuuucgaucugaugcacgucaaaaaggugcuuuccgcuucaacuguauguaaacugcaaucuugcacacacggcgugccuggugacuugcaggucuaccauaucggcaaccuccugaagggggauaaaguuaauggacaccuaauucauaagauagagccccacuuuaacaccaguuggaugucgugggacggcugugaucuggacuacuauugcaacaugggggauuggccaagcugcuccuacacgggagugacucagcauaaucacgccgcguucgugaacaugcuuaauaucgagaccgacuauacaaaaauuuuucacuuccauucuaagagggucaccgcccacggcgauacaccucagcucgaccugaaggcucgucccacuuacggugcaggggaaaucaccguguugguugagguagccgauauggaauuacauacgaaaaagauugagaucucaggacugaaauucgcuagccucacauguacuggcugcuaugccuguuccagugguauaucuugcaaggugcgcauccacgucgacgagccagacgaacugaccgugcacguuaaaagcgaggauccggacauuguggcagcgucauccagucuuauggcccggaagcuggaauuuggcacagauagcaccuucaaggcuuuuucugccaugccuaaaacuuccuuguguuucuacaucgucgagagagaauauugcaagucauguagcaaagaggacacccaaaagugcgugaacacaaaacuagagcagccccagucgauucugaucgaacauaaggggacgauaauuggaaagcaaaaugauacuuguaccucuaaagcaggcugcuggcucgagaguguaaaguccuuuuucuacgggcugaaaaacaugcuuagcggaaucuuuggcaaugucuucaucgguauuuuucuguuccuggcuccauuuauccucuugauacuguucuucauguuuggguggaggauucucuucuguuuuaagugcugccgacggacacgcggacuguucaaauacagacaccuuaaggacgaugaagagaccggcuauaggaagaucauugaacggcugaacaauaaaaagggcaaaaacaaguugcuagacggggagcgacuggccgauagaaaaaucgcagagcucuuuucaacuaagacacauauaggauga

SEQ ID NO: 10414 - RNA, 5052 nt, Artificial Sequence
  derived and/or modified CDS sequence (opt3) from CCHFV(4574-ST-2008)__KR814870.1__GP
augcacacccugcucgugugcuucauccuuuaccugcaguuguuaggccccgggggagcccauggucaaccuaacgcuacagagcacaauagaacuaacacgaccacagcaccaagcacuucccagucuccgaagcccccugucucaaccgccccaccccaugcgcuggagaguccuacaauuaaaagcaccacuccaacauccgagaccgaaggcucuggggagacgacuucgcccccuaauaccacacagggaccaucacuaccggaaacuacccccaagaggccugcuacaaccgccacgagcacuccaaguacagacaacaccaauuccacuacacacguuaccgauaacaaucccacgucuaccauaagcacauccccuucaaguagcccaucuacucccuccaccccgcggggcauccaucacccugcacgcaaccuccugucagugagcagucccaaaacagccacuaccccaacaccuaccucucccggugagauuuccagcgagacuucgucucuucacuccgcuaugucacgaacgaguacacuguauaccgcaacucaggccagcaccgaaaaugcuaaccauuccgccccacgucaaucugagagccccgcgcagccuacaaccacuucauugaugacaaguccagcacaguccauccucguaaugagcgccgcuccgacggccauucagaauauccaccccucuccuaccaacagaucaaagaggaaucuggaaauggagauaauccugacucucagucaagggcugaaaaaguacuauggaaagauucugaaacuuuugcaucugacacuagaggaagacaccgagggccuccuggaaugguguaagcggaaccuuggcagcaauugcgaggaugacuuuuuccagaaacgcaucgaagaguuuuucaugacaggggagggauacuuuaacgaagugcugcaguucaagacuuuguccacccucucuccaacggagcccucgcacgcaagaccuccaaccgucgaacccuuuaaaagcuauuucgcuaaggguuuucuguccauugauucaggcuacuucagugccaaguguuauccgaggucuagcacauccggguuacagcugaucaacgugacucaacacccugcgcggauagccgagaccccaggacccaaaacaacuucacucaagaccauuaauugcaucaaccuucgcgcaagcguuuuuaaagaacaucgagagauugagaucaaugugcuguugccucagaucgcugucaaccuaucuaauugucacgugguaauuaacucccauguuugcgacuacagucuggauacggacggccccgugagacucccacacauauaccaugaagguacauucaucccugggaccuauaagauugucaucgauaaaaagaauaaacugaacgacagguguacucuugugacaaauugcgugauaaagggacgggagguccguaagggccagagcguucugcgccaauacaaaaccgaaauuaagaucggcaaagugucuacuggguccagaaaguugcucucagaggaaaguggagaugacuguaucagcaggacccagcuguuacggacagagacggccgagauucacgaugacaacuaugguggccccggggacaaaaucaccauuugcaauggaucgacuauaguagaucagcgacugggcuccgaacuagguuguuacacaaucaaccgcgugaagucuuuuaagcucugcgagaauagcgcuaccgggaaaacaugcgaaauugacucaacuccagucaaguguagacagggcuucugccugaaaaucacccaagagggaaggggccacgugaaacuuagucggggguccgagguuguguuggaugccugugacucuagcugcgaagucaugaucccgaaaggaacgggugauauucugguggacuguuccggcgggcagcagcauuuccucaaggauaaccugauagaccuuggaugcccucacaucccccuguugggcaagauggcaauuuauaucugucgcaugucaaaucauccaagaacaaccauggccuuucucuucugguuuagcuucgguuacguaauuacuugccuguuuuguaaggcuuuauucuauagucugaucauaaucgggacccuaggcaagaaaauuaagcaguacagggagcuccguccccaaacaugcacuaucugugaaaccgcgccuguuaacgcaauugaugccgagaugcacgaccugaacugcucuuacaauaucugcccauauugugcuucccggcuuacaagcgauggauuggcccgacacgugccccagugcccuaaaagaaaggaaaaggucgaggagacggaacuguaccucaaccuggagaggauaccguggauugugcgcaaauuacugcaggucucggaaucaaccggcguggcacuuaagcggucuaguugguugaucguucuccuggugcuacugacuguaucccucagcccaguccagucugcccccguggggcauggaaaaacaauugagaccuaucaaacuagagaagguuuuacaagcaucugucuguucaugcuuggcuccauauuguuucugguuucaugcuuagugaaggggcucgucgacagugugagcgacucuuucuuuccuggacuguccguauguaaaaccugcucaaucggcaguauuaaugguuucgagaucgagagccacaaguguuacugcucccuucuguguugcccauauuguaggcauugcucugcugaucgcgaaauucaccaguugcaucucucgaucugcaaaaagcgaaagacggggagcaacgugaugcuggccguuuguaaacggaugugcuuucgugcaacuauagaggcgucaagaagggcucuacugauucgcuccaucaucaauaccacauucgucauuuguauccucacccugacuauuugcguggugaguacaucugccgucgaaauggagaaccuucccagcggcaccugggaaaaggaggaggacuugacaaauuucugucaccaggaaugccagguuacugagaccgaaugucugugcccuuacgaggcauuagugcuccggaaaccgcuguuucuugauuccauagugaagggaaugaaaaaccugcuaaauucaacgucucucgagacaagccugaguaucgaagcccccuggggcgcuauuaacguacaauccaccuucaagccaacugucagcaccgccaauaucgcauugucuuggucauccguggagcacagagggaacaagauucugguuacaggaaggagugaaagcaucaugaaauuagaggaacgaacuggcgugucgugggaccucggugucgaggaugcuucugaguccaagcugcuuaccgugagcauaauggaccugucacagauguauaguccuguuuuugaauacuugucuggggaucgccagguggaggaauggcccaaagccacguguacaggagacugcccagagcgguguggcugcaccuccagcacuugccuccauaaggaauggccucacucaagaaauuggagguguaaccccacauggugcugggguguaggcaccggguguacuugcuguggagucgaugugaaagaccuguucacagaucauauguuugugaaguggaaggucgaguacaucaaaaccgaggcgauuguuugcguggaacuaacgagucaagagcgucaguguagccugaucgaagccggcacucgcuucaaucuugggccaguaaccauuacacucuccgagccgcggaacauccagcagaagcugccucccgaaauaauuaccuugcacccaaaaguggaggagggauuuuucgaccugaugcauguccaaaagguguuaucugcuagcacaguuugcaaacuccaguccuguacucacggcauccccggugauuuacagguguaucacaucgggaaccuucugaagggagacagagucaauggccauuugauucacaagauagaaccucauuuuaacaccucauggaugucuugggacgguugcgaucucgacuacuauuguaauaugggcgauuggccaaguugcacguacacaggggugacucagcacaaccacgcagccuucguuaaucugcuaaacaucgagaccgacuauacaaaaaccuuucauuuccacucgaagagggugacugcucauggagauacaccccaacuggaccuuaaagcccgaccuaccuacggcgcaggggaaauuacgguccucguagagguggcggauauggagcugcacacuaagaaaguugaaaucagcggauugaaguuugccuccuuagcuugcaccggcuguuaugccuguucuucagguauuagcugcaaagugcggauccaugucgacgagccggaugaacugacagugcacguaaaguccagugacccagauguggucgcagcuucuaccagccucauggcccgcaagcuggaguucgggacugacucaacauucaaagcauuuuccgccaugcccaagaccagucuuugcuucuacauaguugaaagagaguacuguaaaagcugcucugaggaagauacgcagaaguguguggacacuaaacuggagcagccucaguccaucuugauugaacacaagggaacaaucauuggcaagcaaaaugauaccugcaccgcuaaagcgucauguuggcuagagagcgugaagucguuuuucuauggucugaaaaacaugcucggcucugucuuugggaauuucuuuaucggaauacugcuuuucuuagcccccuuugugcugcucguuuuguucuuuauguucggcuggaagauucuguucugcuuuaaauguugcaggcgggcacgagggcuccugaaguacagacaucuuaaggacgacgaagagacuggauaucgcaaaaucaucgagaggcugaacaauaagaaaggcaagaaccguuugcuagauggugaacggcuggcugacagaaaaauugccgaacucuucaguacaaagacccacaucggguga

SEQ ID NO: 10415 - RNA, 5052 nt, Artificial Sequence
  derived and/or modified CDS sequence (opt3) from CCHFV(75-ST-2010)__KR814864.1__GP
augcacacccugcucgugugcuucauccuuuaccugcaguuguuaggccccgggggagcccauggucaaccuaacgcuacagagcacaauagaacuaacacgaccacagcaccaagcacuucccagucuccgaagcccccugucucaaccgccccaccccaugcgcuggaaaguccuacaauuaaaagcaccacuccaacauccgagaccgaaggcucuggggagacgacucccccuccaaauaccacacagggaccgucgcuacccgaaacuaccccugagaggccagcuacaaccgccacgucaacucccagcacagacaacaccaauaguacuacacacguuaccgauaacaauccuacguccaccauaucuacaagcccauccucaagucccagcacuccgucuaccccucggggcauccaucaccccgcacgcaaccuccuguccgugucaagcccaaagacagccacuaccccuacacccaccaguccaggugagauuucuuccgaaacuagcucgcuucacucugcuaugucccgaacgucaacacuguauaccgcaacucaggccaguaccgagaaugcuaaccauagcgcgccccgucaauccgaaucuccugcccagccaacaaccacuagcuugaugacaucaccggcacagaguauccucguaauguccgccgcucccacggccauucagaauauccacccuagcccaaccaacagaucuaaaaggaaucuggagauggagauaauccugacucucucacaaggguuaaagaaauacuauggaaagauucugaagcuguugcaucugacacuagaagaggacaccgaaggccuccuggagugguguaaacggaaccuuggcaguaauugcgaugacgauuucuuccagaagcgcaucgaagaguuuuucaugacaggggagggauacuuuaacgaagugcugcaguucaaaacuuugagcacccucucccccacggagccuucucacgcaagaccacccaccgucgaaccguuuaagucguauuucgcuaaagguuuucugagcauugacuccggcuacuucucagccaaguguuauccuaggaguucuacaagcggguuacagcugaucaacgugacucaacacccagcgcggauagccgagacccccggaccuaagacaacuucccucaaaaccauuaauugcaucaaccuucgcgcaucaguuuuuaaggaacaucgagagauugagaucaaugugcuguugccccagaucgcugucaaccuaagcaauugucacgugguaauuaacucucauguuugcgauuacucccuggacacggauggcccagugagacucccucacauauaccaugaagguacauucauccccgggaccuauaaaauugucaucgacaagaaaaauaagcugaacgauagguguacucuugugacaaauugcgugauaaaaggacgggagguccguaagggccagaguguucugcgccaauacaagaccgaaauuaaaaucggcaaggugagcacugggucuagaaaauugcucuccgaggaaucaggagacgauuguaucaguaggacccagcuguuacggacagagacggccgagauucacgacgacaacuaugguggcccaggggauaagaucaccauuugcaauggaagcacuauaguagaccagcgacugggcucggaacuagguuguuacacaaucaaccgcgugaaauccuuuaagcucugcgaaaauucugcuaccgggaagacaugcgagauugauagcacuccggucaaauguagacagggcuucugccugaagaucacccaagagggaaggggccacgugaaacuuucacgggggagugagguuguguuggacgccugugauuccucuugcgaagucaugaucccuaagggaacgggugacauucugguggauuguagcggcgggcagcagcauuuccucaaagacaaccugauagaucuuggaugcccccacaucccacuguugggcaagauggcaauuuauaucugucgcauguccaaucaucccagaacaaccauggccuuucucuucugguuuucauucgguuacguaauuacuugccuguuuuguaaggcuuuauucuauagccugaucauaaucgggacccuaggcaaaaagauuaaacaguacagggagcuccguccucaaacaugcacuaucugugaaaccgcgccaguuaacgcaauugacgccgagaugcacgaucugaacugcaguuacaauaucugccccuauugugcuucucggcuuacauccgacggauuggcccgacacgugccucagugcccgaagagaaaagaaaaggucgaggagacggaacuguaccucaaccuggagaggauaccauggauugugcgcaaguuacugcaggucagcgaaucgaccggcguggcacuuaaacggucaucuugguugaucguucuccuggugcuacugacuguaagucucucccccguccagagcgccccuguggggcauggaaagacaauugagaccuaucaaacuagagaagguuuuacaucuaucugucuguucaugcuuggcagcauauuguuucugguuuccugcuuagugaaagggcucgucgacucagugagugauagcuucuuuccaggacugucuguauguaagaccugcuccaucggcucaauuaaugguuucgagaucgagagucacaaauguuacugcagccuucuguguugccccuauuguaggcauugcuccgcugaccgcgaaauucaccaguugcaucucucuaucugcaagaaacgaaagacggggucgaacgugaugcuggccguuuguaagcggaugugcuuucgugcaacuauagaggcgagcagaagggcucuacugauucgcucaaucaucaauaccacauucgucauuuguauccucacccugacuauuugcgugguguccacaagugccgucgaaauggagaaccuuccuucuggcaccugggaaaaagaggaggauuugacaaauuucugucaccaggaaugccagguuacugagaccgaaugucugugcccguacgaggcauuagugcuccggaagccccuguuucuugacagcauagugaaaggaaugaagaaccugcuaaauuccacgucacucgagacaucucugagcaucgaagccccauggggcgcuauuaacguacaaaguaccuucaaaccuacugucuccaccgccaauaucgcauugagcuggucuucaguggagcacagagggaacaagauucugguuacaggaagguccgaaaguaucaugaaguuagaggaacgaacuggcgugagcugggaucucggugucgaggacgcuucggagucuaaacugcuuaccguguccauaauggaucugagccagauguauucacccguuuuugaauacuugaguggggaccgccagguggaggaauggccaaaggccacguguacaggagauugcccugagcgguguggcugcaccucuuccacuugccuccauaaagaauggccccacagcagaaauuggagguguaacccaacauggugcugggguguaggcaccggguguacuugcuguggagucgacgugaaggaucuguucacagaccauauguuugugaaauggaaggucgaguacaucaagaccgaggcgauuguuugcguggaacuaacgucacaagagcgucaguguagucugaucgaagccggcacucgcuucaaucuugggccgguaaccauuacacucagcgagccucggaacauccagcagaaacugcccccagaaauaauuaccuugcaccccaagguggaggagggauuuuucgaucugaugcauguccaaaaaguguuauccgcuucuacaguuugcaagcuccagagcuguacucacggcaucccuggugaccuucagguguaucacaucgggaaccuucugaaaggagacagagucaauggccauuugauucacaagauagaaccacauuuuaacaccuccuggaugucaugggaugguugcgaccucgauuacuauuguaauaugggcgacuggcccucuugcacguacacaggggugacucagcacaaccacgcagccuucguuaaucugcuaaacaucgagaccgauuauacaaagaccuuucauuuccacaguaaaagggugacugcucauggagacaccccucaacuggaucuuaaggcccgaccgacauacggcgcaggggaaauuacgguccucguagagguggcggacauggagcugcacacuaaaaagguugaaaucucgggauugaaauuugccagcuuagcuugcaccggcuguuaugccugcuccucugguauuucauguaaggugcggauccaugucgaugagccagacgaacugacagugcacguaaaaagcuccgaucccgacguggucgcagcuaguaccucucucauggcccgcaagcuggaguucgggacugauagcacauucaaggcauuuucagccaugccuaaaaccucccuuugcuucuacauaguugaaagagaguacuguaagaguugcagcgaggaagacacgcagaaauguguggacacuaagcuggagcagccccagucuaucuugauugaacacaaaggaacaaucauuggcaagcaaaaugauaccugcaccgcuaaggcguccuguuggcuagagucagugaaaucguuuuucuauggucugaagaacaugcucggcagcgucuuugggaauuucuuuaucggaauacugcuuuucuuagccccauuugugcugcucguuuuguucuuuauguucggcuggaaaauucuguucugcuuuaaguguugcaggcgggcacgagggcuccugaaauacagacaucuuaaggacgaugaagagacuggauaucgcaagaucaucgagaggcugaacaauaaaaagggcaaaaaccguuugcuagacggugaacggcuggcugauagaaagauugccgagcucuuuucuacaaaaacccacaucggguga

SEQ ID NO: 10416 - RNA, 5052 nt, Artificial Sequence
  derived and/or modified CDS sequence (opt3) from CCHFV(37-R-2013)__KR814858.1__GP
augcacacccugcucgugugcuucauccuuuaccugcaguuguuaggccuggguggagcccauagacaaagcaacgcuacagagcacaaugguacuaacacgaccacagcacccuccacuucucagucaccuaagccaccggucaguaccgcgcccccucaugccccagaaacaagcaccauuaaacccacuacuccugcuuccgagaccgaaggcucuggggagacgacuccacccccuaauaccacacagggaccaucgccgcccgaagccacuccugagaggccagcaaccacaguuaccucaacgcccagcacugacaacacaaauaguaccacucacgccacagauaacaauccuaccuccacgauaucuaccagcccauccucaagucccagcacaccgucuacuccucagggcauccaucaccccgcucggaaccuacucuccgugucaagcccaaagaccgcaacaacuccuacccccacaaguccaggugacauuucuuccgagaccagcucgcugcacucugccaugucccgcacucccacgcuucauacagcuacccaagccucaacugaaaaugcgaaccacagugcaccucgacagagcgaguccucugcccagcagaccacaaccagcccaaugacuucaccggcucaacccauccugguaaugagugccgcaccuacagcuauucagaauauccauccaucccccacgaaccguagcaaaagaaauuuggaaauggagauaauccucacccugucucaggggcugaagaaauauuacggaaagauucucaaguuacugcaccuuacuuuggaggaagauacagagggccugcuagaaugguguaaaaggaaccucggcucaaauugcgacgaugacuuuuuccagaagcggaucgaggaauuuuucaugaccggggagggauauuuuaacgaggugcugcaauucaaaacacuuaguacucugagcccuaccgaaccaucccacgcccgacccccgacggucgagccuuuuaagucuuacuucgcgaaaggguuuuugucgauugauagcggcuauuucuccgccaaguguuacccaagacucaccacaucagggcugcaguuaaucaacgugacucagcaucccgcaaggauagcugaaaccccuggacccaagacaacaagucugaaaaccauuaauugcaucaaccuccgggccucuguuuuuaaggagcaccgcgaaauugagaucaaugugcuucugccacaaaucgcugucaacuugagcaauugucaugugguaauuaacucccacguuugcgacuauucacuagauacggacggcccugugcgacugccccauauauaccacgaggguacauucaucccagggaccuacaaaauugucaucgauaagaaaaauaagcucaacgacagauguacucuggugacaaauugcgugauaaaaggaagggaaguccggaagggccagagcguucuucgucaguauaagaccgagauuaaaaucggcaaggccucuacugggucccgcaaacuguugagugaggaaccgggagaugacuguaucagcagaacccagcuccugaggacagaaacggcagagauucacgacgauaacuacgguggcccuggggacaagaucaccauuugcaauggaucuacuauaguggaucaacgguuaggcuccgagcuggguuguuauacaaucaaccgaguaaaaucauuuaagcuaugcgaaaauagugccaccgggaagacaugcgagauugacagcacucccgugaaaugucgccagggcuucugccucaagaucacccaggaaggaagaggccaugucaaacugucgaggggguccgaggugguucuugaugcuugugacacgucuugcgaggugaugaucccaaagggaacaggugauauuuuggucgacuguagcggcgggcagcaacacuuccugaaagauaaccucauagaccugggaugcccccauaucccucuucugggcaagauggcgauuuacaucugucggaugucaaaucacccacgcaccacuauggcauuuuuguucugguuuaguuucgguuaugugauuaccugcaucuuuuguaaggcccucuucuacucccugauaaucauugggacauuaggcaaaaagaucaaacaguauagagaacugaagccccagacuugcaccauuugugagacagcuccuguaaacgccaucgaugcagaaaugcacgaccuaaacugcucuuacaauauaugcccguacugugccagcaggcucacguccgacggacuggcucgucauguuccacagugccccaaacggaaggagaagguggaagagaccgagcuuuauuugaaccuggaacgcauuccuuggaucgucagaaaacuccugcaagugucagagagcacuggcgucgccuuaaagaggaguucuuggcugauugugcuuuugguucuccugacagugucccuaagcccaguacagucggcacccgucgggcacggaaaaaccaucgaaacuuaccagacacgcgaggguuuuaccucagugugucuguucaugcucggcucuauacuguuucuuguuaguugcuuggugaaggggcuggucgauuccgugagcgacucuuucuuuccuggauuaagcguauguaaaacgugcuccaucggcucaauuaaugguuucgaaaucgagagucauaaguguuauugcagccucuuuuguugcccguacugucggcacugcucugcggauagagagauucaucagcugcaccuuuccaucugcaaaaagaggaagauggggucaaacgugaugcuggcuguuuguaaacgcaugugcuuccgagccacuauagaagcaagucggcgugccuugcucauuagaagcaucaucaauaccacauucgucauuuguauccugacccuaacuauuugcgugguguccacaucugcugucgagauggaaaaccugcccucgggcaccugggagagggaagaggaccucacaaauuuuugucaccaagagugccagguuacugaaaccgagugucugugcccauaugaagcccuuguguugcgcaagccucuguucuuagauagcauagugaaaggaaugaagaaccuccuuaauucaacgucccuggagacaagucugucuaucgaggcacccuggggcgcuauuaacguacagagcaccuuuaaaccaacugucuccaccgccaauaucgcgcuaucauggucuagcguggaacaucgggggaacaagauucucguuacaggaagaagugaguccaucaugaagcuggaagagaggacuggcgugagcugggacuugggugucgaugacgccucugaaucaaaacuguuaaccguguccauaauggaucucagucaaauguacagcccuguuuucgaguaucugucgggggaccgacagguggaggaauggcccaaggcuacguguacaggagauugcccagagcgcuguggcugcaccucuuccacuugccuucacaaagaauggccgcauagccggaauuggagauguaacccuacauggugcugggguguaggcaccggguguacuugcuguggagucgacgugaaggaucuguuuacagaccacauguucgugaaauggaaggucgaguacaucaagaccgaagcaauuguuugcguggaguugacgucacaggagaggcaguguagucucaucgaagccggcacucguuuuaaucuggggcccguaaccauuacacuaucugagccacgcaacauccaacagaaacugcccccugaaauaauuacccuucauccaaagguggaggaaggauucuuugaccucaugcacguccagaaagugcuguccgcuagcacaguuugcaaguugcagucauguacucacggcauccccggugaucugcaaguguaccauaucgggaacuuacucaaaggagaccgggucaauggccaccugauucauaagauagagccucacuucaacaccaguuggaugagcugggaugguugcgaccuugauuauuacuguaauaugggcgacuggccguccugcacguauacaggggugacucagcacaaccaugccgcauuuguuaaucuguugaacaucgagaccgauuacacaaagaccuuccacuuucauucuaaaagagugacugcgcacggagacaccccacagcucgaucugaaggccaggcccacauauggcgcuggggaaauuacgguccuaguagagguggccgacauggaacugcauacuaaaaagguugagaucagcggacuuaaauucgcaucccucgcuugcaccggcuguuacgccugcucaucugguauuaguuguaaggugcgaauccacgucgaugagccugacgaacugacagugcacguaaaaucgaaugaucccgacguggucgcagccagcaccuccuugauggcucggaaguuagaguucgggacugacucuacauuuaaggcguucucagccaugccaaaaaccagccugugcuuuuauauaguugaacgcgaguacuguaaguccugcagugaagaggauacgcagaaauguguggacacuaagcucgagcaaccucagucuauccugauugaacauaaaggaacaaucauuggcaagcagaacgugaccugcaccgcaaaggcuagcuguuggcuugagucagucaaauccuucuuuuacggucugaagaauauguugggcaguguguucgggaacuuuuucaucggaauacuacuguuucucgcccccuucguucugcuuguauuauuuuucauguucggcuggaaaauucuguuuugcuucaaguguugcagaaggacucgggggcucuugaaauaucgacugcucaaggaugacgaagagacaggauacagacgcaucaucgaaaggcugaauaacaagaaaggcaagaaucgucuucuggauggugagcgguuggccgacagaaaaauugcugagcuauuuagcaccaagacacacaucggguga

SEQ ID NO: 10417 - RNA, 5052 nt, Artificial Sequence
  derived and/or modified CDS sequence (opt3) from CCHFV(Kashmanov)__DQ211631.1__GP
augcacacccugcucgugugcuucauccuuuaccugcaguuguuaggccuagggggagcccauggucaaagcaacgcuacagagcacaauggcacuaacacgaccacagcacccuccacuucucagucaccuaagccacuggucaguaccgccccgccccaugcgcucgaaagcuccacaauuaaaccuaccacuccagcuucugagacagaagggucgggagagaccacgcccccuccaaauacuacccagggccccucaccuccagaaacaacuccggagagacccgccaccacagcaaccagcacgccuaguacugacaacacaaauuccaccacucacguuacagauaacaauccaaccucuacgauaagcaccucccccucaaguagcccuucuacaccauccacuccccaggguauccaucacccggccaggaaccugcuuucagugagcaguccuaagaccgcuacaacucccaccccaacaucuccuggggagauuuccagcgaagcaucgucucugcacuccgccaugucacggaccaguacuuuguauacggcuacacaaguaagcaccgagaaugccaaccauuccgcgccccgccagucugaaagcucagcacagccaacuaccacaagucccaugaccuccccugcccagagcauccucgugaugucugcugccccaauugcaauccaaaauauacacccgucacccacuaaccgaaguaaacguaaucuggagauggagaucauucugacacucagccagggauuaaagaaauacuauggcaagauccugaaacuuuugcaucugacgcuagaagaggacaccgaaggccuccuggagugguguaaaagaaaccuuggguccaauugcgaugacgacuuuuuccagaagaggauugaagaguuuuucaugacuggagaggguuacuuuaacgaaguccugcaguucaaaacauugucuacccucucgccuacagagccaagccacgcugggcccccuacuguggaaccauuuaaguccuauuucgccaaaggguuucugucaaucgauaguggauacuucucugcgaaguguuauccccggagcuccaccucaggcuuacaacugauaaacguuacgcagcacccggcccgcauugcagagaccccugguccaaagacaacuagccucaaaaccaucaauugcauuaaccuuagagcuucuguguuuaaggaacauagggagaucgagaucaauguccuguugccccagauugccgugaaccuauccaauugucacguaguuauaaacagucaugugugcgauuacagccuggacacagaugggccuguccggcucccccacaucuaccaugaaggaacuuucauuccaggcaccuauaaaaucgugauagacaagaaaaauaagcugaacgaucgcuguacgcuugugacaaauugcgucauuaaaggccgagagguuagaaaggggcaaucugugcugaggcaguacaagaccgaaaucaaaaucggaaaggcuuccacugguucacggaaauugcucagugaggaaccuggcgacgauuguauuagccguacacagcuguuacgcaccgagacugccgagauccacgacgacaacuaugggggacccggcgauaagauuaccauaugcaaugguucgacaaucguagaccagagacugggguccgaacuaggcuguuacacgauuaacagggugaaaucuuuuaagcucugcgagaauagcgcaaccggaaagacuugcgaaaucgauucaacaccagucaaaugucggcaaggcuucugccugaagaucacccaggaggggcgaggacacgugaaacuuagucgcgguuccgagguuguguuggacgccugugauucuagcugcgaagucaugauuccgaagggcacaggggacauacugguggauuguuccggaggccagcagcauuuccucaaagacaaccugaucgaucuugguugcccucacauuccccuguuggggaagauggcuaucuauauuuguagaaugucaaaucauccaaggacuaccauggcguuucucuucugguuuagcuucggcuacguaaucacgugcauauuuuguaaggcacuguucuauaguuuaaucauuaucggaacacugggcaaaaagauuaaacaauaccgggagcuaaagccccagaccugcacuaucugugaaaccgccccuguuaacgcuauagacgccgagaugcacgaucucaacugcucuuacaauauuugcccauauugugcaucccgccugacaagcgacgggcuugccagacacgugccccagugcccuaaaaggaaggaaaaggucgaggagacugaauuguaccugaaccucgagcguaucccguggauugugcggaaacuguuacaggucucggaaucaaccggaguggcucugaagcgaucuaguuggcuuaucguuuugcucgugcugcuaacaguaucccugagcccaguccaaucugcccccgugggucauggcaaaacgauagagaccuaucagacuagagaaggguuuacaagcaucugucucuucaugcugggauccauucuguuuuugguuucaugccuggugaagggcuuagucgacagugugagcgauucuuucuuuccuggucucuccguauguaaaaccugcacuaucgggucaauuaauggcuucgagaucgagagucacaaguguuacugcagccuguuuuguugcccauauuguaggcauugcuccgcagaccgcgaaauacaccagcuucaucugucuauuugcaaaaagcggaagacaggaucgaacgugauguuggcgguuuguaaaagaaugugcuucagggcuaccaucgaggccagccgccgagcacuccugauccggucaauuaucaauacgacuuucgucauuuguauacuaacccugacaaucugcgugguguccaccagugccgucgaaauggagaaccuccccucuggcacuugggaacgugaggaggaucugacaaauuuuugucaccaggaaugccaaguuaccgagacagaaugucuuugcccuuacgaggcuuuggugcugagaaagccguuauuccucgacagcauugugaaagggaugaagaacucccuuaauucaacuucucuugagaccagccugaguaucgaagcccccuggggagcaauuaacguacaguccacguuuaaaccaacagucagcaccgcuaauaucgcccuaucuuggucauccguggagcacaggggcaacaagauacucguuacuggucgcagugaaagcaucaugaagcuggaggaacggaccggggugucgugggauuugggagucgaggacgcgucugaguccaaacuguuaacagugagcauuauggaucucucacagauguauaguccuguuuucgaauaccugucuggcgacagacaaguggaggaauggcccaaggccacuuguaccggugauugcccagagagguguggcugcacguccagcacaugccuucauaaagaauggccucacucacgaaauuggcgcuguaaccccaccuggugcuggggcguaggaacuggcuguacaugcuguggggucgacgugaaggaucuguuuaccgaccauauguucgugaaauggaaggucgaguacaucaagacugaggcuauuguuugcguggaauugacaagucaggagcggcaguguagccucaucgaagcaggaaccagauuuaaucugggcccaguaacgauaacucuauccgagccgaggaacauucagcaaaaacugccucccgaaaucaucacccuucacccaaagguggaggaggguuucuuugaucucaugcauguccagaaagugcugucugccagcacaguuugcaaguugcaguccuguacccacgggauucccggagacuuacagguguaucacauaggcaaccugcucaaaggugaccguaucaauggccaucugauucacaagaucgaaccucauuucaacacaucauggaugucuugggaugggugcgaccuugauuacuauuguaauaugggagacuggccaaguugcacuuacaccggcgucacgcaacacaaccacgcugccuuugugaaucuguugaacauugagacagauuauacuaagaccuuccauuuucacucgaaacgcguuacagcacauggggacacuccccagcucgaucugaaggcgcggccuacuuacggagccggcgaaaucaccgugcuagucgagguagcugacauggagcugcacacaaagaagguggaaauaagcggucuuaaauucgccucccucgcaugcacgggguguuaugcuuguucuucaggaaucagcugcaagguuaggauucauguggaugagccggacgaacugacuguccacgugaaauccagugauccagacguaguggccgcaucuaccagcuugauggccagaaaguuagaguucggcacagauucaaccuuuaaggcuuucuccgcgaugcccaaaaccagucugugcuuuuacaucgucgaacgagaguacuguaagagcugcucugaggaagacacacagaaauguguugacaccaagcucgagcagccucaauccauucugaucgaacacaaagguacgauaauuggcaagcagaaugauacuugcacagccaaggcaucauguuggcuugagagcgugaaaucguucuuuuaugggcugaagaacauguugggaucuguguucggcaacuuuuucaucgggauccuacuguuucucgcucccuucguccugcuuguguuauuuuucauguucggauggaaaauucuguuuugcuucaaguguugccggcgcaccagaggccucuugaaauacaggcaucugaaggacgaugaagagaccgguuaucggcgaaucauagagagacucaauaauaagaaagggaagaaccgccugcuugacggagaaaggcuggccgaucguaaaauugccgaguuguuuaguacuaagacacacaucggcuga

SEQ ID NO: 10418 - RNA, 5052 nt, Artificial Sequence
  derived and/or modified CDS sequence (opt3) from CCHFV(Haskovo-V46/13)__KR092379.1__GP
augcacacccugcucgugugcuucauccuuuaccugcaguuguuaggccuagggggagcccauggucaaagcaacacaacugagcacaauggcacgaacaauaccacagcucccgggacuucccagucuccuaagccacauaugucaaccacaccgccccacgcaccugaaaguagcaccauuaaaccaacuacacccaccuccgagacggaaggaucuggcgagacuaccccuccaucgaacacaacucagggucccucaccuccagaaaccacaagcgagagaccggccaccacggcgauaaguacuuccucuacagacaauaugaaccccaccagccagaugacugauaauacaccuaccuccacggucucaaucaguccaagcuccucccccucaaccccuagcacaccacaagggaugcaucaccccgcuaggagucugcucucuguuuccagcccgaagacugccaccacaccuacucccaccucgccaguggagguaggaucugaaacauccucacagcacagugcaaugagcuccaccccuacuccccauacggccacacaggugucuaccgagaacacuaaucacagcaccccacggcagucagaacccagugcucaacagacaaccccuuccccaaugccgagccccgcacagucuacucugcuuaugucagccgcuccuacagccguccagaacacgcauccaagucccaccaaucgcagcaaacgaaaccuggagauggagauuaucuugacucucucccaaggccugaagaaauauuacggcaagauucugaagcucuuacaccugacacuugaagaggacaccgaaggguugcuggagugguguaaacguaaucuaggaucuaacugcgaugacgacuuuuuccagaagagaaucgaagaguuuuucaugacaggugagggcuauuuuaaugaagugcuccaguucaaaacucugucgacccuuagcccuauggagccaucccacgcggaacugcccacggcagagccguuuaagucauacuucgccaaaggguuuuugaguauagacucuggauauuucagcgcuaaguguuacccuagguccucaaccagcggccuccaacugaucaacguuacacagcauccagcccggauugcagaaacucccgguccuaagaccacaucuuuaaaagcuaucaacugcauuaaucugcgcgccuccguguuuaaggagcacagagagaucgaaauaaacguccuccuuccccagauugcggugaaucugaguaacugucauguaguuaucaauagccacgugugcgauuauucuuuggacacugaugggccagucaggcuaccucauauuuaccacgagggaaccuucauccccggcacguacaaaaucgugauugacaagaaaaacaagcugaaugaucgguguacacucgugaccaacugcgucauaaaaggccgcgaaguucgaaaggggcaguccgugcugagacaauauaagacugagaucaaaauuggaaaggccucaacagguaguaggaaacuucugagcgaagaguugggcgacgauuguaucucgcggacccagcuccugcguacugagaccgcagaaauacacgacgacaauuacgggggaccaggcgauaagauuacaaucugcaacgguuccacgaucguagaccagcgcuuagggucugagcugggcuguuauaccauuaauagaggaaagagcuuuaaacuaugcgaaaacucagcuacuggcaagacaugcgagaucgauaguaccccggugaaauguaggcagggguucugccucaagauuacacaagagggacggggucaugucaaacugucccgaggcucugaagugguucuugacgccugugauagcuccugcgaggugaugauaccuaaggggacuggagacaucuuggucgauuguucaggcggucagcagcacuuccugaaagacaaucucauugaucuggggugcccccauaucccacuucugggcaagauggcuaucuacauuugucgcaugagcaaccaccccagaaccacgauggccuuuuuguucugguuuaguuucggauaugugauaacaugcaucuuuuguaaggcacucuucuacucucugauuaucauuggcaccuuagggaaaaagaucaaacaguauagggaacugaagccucaaacuugcaccauaugugagacaacuccaguaaaugccaucgacgcugaaaugcacgaucuaaacugcuccuacaacauuugccccuacugugcgagccggcucaccucggacggacuggcacgccauguuacacagugcccuaaaagaaaggagaagguggaggaaacggagcuuuauuugaaucuggaaaggaucccguggauuguccguaaacucuuacaggugucagagucuaccggugucgcccugaagcggaguuccuggcugaucgugcuuuugguucuccugccagugagccuaucucccguacagagcgcuccugucggccacgggaaaacuauagaaacauaccaaacccgagagggauuuacuuccauuugucuguucaugcucggcucaauccuguuuauugugaguugccuuguuaaggguuugguggacagcgucggggauucuuucuuuccaggccuguccguguguaaaacaugcucaaucggaaguauaaacggcuucgagaucgaaagccauaaguguuauugcuccuuauuuuguugccccuacuguagacacugcucugccgacagggagauucaucagcuccaccugucgaucugcaaaaagcgcaagaccgggagcaauguaaugcuugcaguguguaaacggaugugcuucagagccacgauugaggcuucaaggcgcgcccuguugauccgauccauaauuaacacuaccuucgcaauguguauccucacacugaccaucugcguugucaguacuucugcgguggagauggaaaaucuaccugcuggaacaugggagcgggaggaagaucugaccaacuuuugucaccaggagugccaagugacagaaacugagugucucugcccguaugaggcccugguccuucguaagcccuuguuccuggacagcauuguuaaaggcaugaagaauuuacucaacuccaccucacuggaaacgucucuuagcaucgaggcaccauggggugccauuaaugugcagaguacauuuaaaccuaccguguccacugcuaacauagcccugagcuggucuucaguagaacauagagggaauaagauccuagucaccggaagguccgagaguauuaugaagcucgaagaacgcacaggcgugagcugggaucuggguguugaggacgcaucggaaucuaaauugcugacuguguccaucauggauuuaagccagauguacucacccgucuucgaguaucucaguggcgacagacagguggaagaguggccaaaggcuaccuguacgggggauugcccugaacgguguggaugcacaucuucuaccugccugcacaaagaguggccccauagcaggaacuggcgauguaauccaacuuggugcuggggcguugggacaggauguaccugcuguggcguggacguaaaggaucuuuuuacugaccacauguucgucaaauggaagguggaguacauuaagacagaagccaucgugugcgucgagcugaccucacaagaacgccaguguaguuugauagaggcggguacgcgguuuaaccucgggccgguuacuaucacccugagcgaaccuagaaauauucagcagaaacuacccccagagaucauuacacugcaucccaagaucgaggaaggauucuuugaucuuaugcacgugcaaaaaguacucuccgccucuaccgugugcaagcugcagagcuguacacacggcauaccuggugacuugcaggucuaccauauuggcaaccuguuaaaaggggacagggugaacggacaccucauccauaagaucgagccacacuucaauacuuccuggaugucaugggauggcugcgaccuggauuauuacuguaacaugggggacuggcccucuugcaccuauacgggaguuacacagcacaaucaugcugcauuugugaaccuucugaauauugaaacugauuacaccaagacauuccacuuucauaguaaacgugucaccgcccacggcgacacuccucaauuggaucucaaggcucgcccgaccuauggugccggggagauaacagugcugguugagguggcagacauggaacuacauacgaaaaaggucgagaucucgggacugaaauucgcgagccuuacuugcaccggcuguuacgccugcuccucugguauuucauguaagguacggauccacguggaugaaccagacgagcucacaguucacgugaaaagcuccgaucccgacgucguggcugccggcaccagucugauggcaagaaaguuggaguucgggacugauucuacauuuaaggcuuucagcgccaugccuaaaaccucauuaugcuuuuauauuguagaaagggaguacuguaaguccugcagugaagacgacacgcagaaauguguggauacuaagcuggagcagccccaaagcauccucauagaacauaaaggaacaaucauuggcaagcagaacgauaccugcaccgcacgagccucuuguuggcuggaguccgucaagucauucuuuuacgggcuuaaaaauaugcugggaagcguuuucggcaacuuuuugaucgguauucuacuguuccucgcuccauuugugcugcuuguguuauucuuuauguucggguggaagauccuguucugcuuuaaauguugccggcgcacuagaggacucuucaaguauaggcacuugaaagaugacgaagagacaggcuaccggcgaauaauugagagacucaauucgaagaagggcaaaaaccgccugcuggauggggaaaggcuugcggaccguaagaucgccgagcuguuuucuaccaaaacacauaucggauga

SEQ ID NO: 10419 - RNA, 5052 nt, Artificial Sequence
  derived and/or modified CDS sequence (opt3) from CCHFV(Min)__KX013481.1__GP
augcacacccugcucgugugcuucauccuuuaccugcaguuguuaggccuagggggagcccauggucaaagcaacgcuacagagcacaauggcacuaacacgaccacagcacccuccacuucucagucaccuaagccacuggucaguaccgccccgccccaugcgcucgaaagcuccacaauuaaaccuaccacuccagcuucugagacagaagggucgggagagaccacgcccccuccaaauacuacccagggccccucaccuccagaaacaacuccggagagacccgccaccacagcaaccagcacgccuaguacugacaacacaaauuccaccacucacguuacagauaacaauccaaccucuacgauaagcaccucccccucaaguagcccuucuacaccauccacuccccaggguauccaucacccggccaggaaccugcuuucagugagcagucugaagaccgcuacaacuccuacccccacaucuccaggggagauuuccagcgaaaccucgucuuugcacuccgcaaugucacggacuagcacgcucuauacagccacccaaguaagcacugagaaugcuaaccauuccgccccucgccagucugaaagcucagcgcagcccaccacaaccaguccaaugacuucccccgcacagagcauccuggugaugucugccgcuccuauugccauccaaaauauacacccaucaccgacaaaccgaaguaaacguaaucuggagauggagaucauucucacguuaagccagggacugaagaaauacuauggcaagauccuuaaguugcugcaucuaacccucgaagaggacacugaaggccugcuugagugguguaaaagaaaccugggguccaauugcgaugacgacuuuuuccagaagaggauugaagaguuuuucaugacaggagaggguuacuuuaacgaagucuugcaguucaaaacccucucuacacugucgcccacugagccuagccacgcacggccacccaccguggaaccuuuuaaguccuauuucgcuaaaggcuuuuuaucaaucgauaguggguacuucucugccaaguguuauccacgcagcuccacgucaggacugcaacucauaaacguuacccagcaccccgcgagaauugccgagacaccgggcccuaagacuaccagccuuaaaacaaucaauugcauuaaccugagggcaucuguguuuaaggaacaucgggagaucgagaucaaugucuugcuaccacagauugcugugaaccuguccaauugucacguaguuauaaacagucaugugugcgauuacagccucgacacugauggucccguccgccugccucacaucuaccaugaagggaccuucauucccggaacguauaaaaucgugauagacaagaaaaauaaacuuaacgaucgauguacacuggugaccaauugcgucauuaagggcagagagguuaggaagggccaaucuguguugcggcaguacaagacugaaaucaaaaucgggaaggccuccacaggaucacguaaacuccugagugaggaaccaggugacgauuguauuagccgcacccaguuacugagaacugagaccgcugagauccacgacgacaacuauggcgggccuggagauaagauuacaauaugcaauggcucgacgaucguagaccagaggcuagguuccgaacucggguguuacaccauuaaccgggugaaaucuuuuaagcugugcgagaauagcgccacuggcaagacaugcgaaaucgauucaacccccgucaaaugucgacaaggauucugccuuaagaucacacaggagggccgcgggcacgugaaauugaguagaggauccgagguugugcuggacgcaugugauucuagcugcgaagucaugauuccaaaggguacuggcgacauacucguggauuguuccgggggacagcagcauuuccugaaagacaaccuuaucgaucugggcugcccgcacauuccuuugcucgguaagauggccaucuauauuuguaggaugucaaaucauccccggaccacgauggcuuuucuguucugguuuagcuucggguacguaaucacaugcauauuuuguaaggcguuauucuauagucugaucauuaucggcacccuagggaaaaagauuaaacaauaccgcgagcucaagccacagacuugcaccaucugugaaacagcacccguuaacgccauagacgcugagaugcacgaucugaacugcucuuacaauauuugcccuuauugugccuccagacuuacuagcgacggcuuggcaaggcacgugccacagugccccaaacguaaggaaaaggucgaggagaccgaacuguaccucaaccuggagcggaucccuuggauugugcgaaaauuacugcaggucucggaaucaacagggguggcccuuaagagaucuaguugguugaucguucuccuggugcuacugacgguaucccucagcccgguccaaucugcuccagugggacaugguaaaaccauagagacuuaucagacaagggaaggcuuuaccagcaucugucuguucaugcuuggguccauuuuguuucugguuucaugcuuagugaagggacucgucgacagugugagcgauucuuucuuucccggccuguccguauguaaaacuugcacaaucgguucaauuaauggguucgagaucgagagucacaaguguuacugcagccuguuuuguugcccuuauugucgccauugcuccgccgaccgggaaauacaccagcugcauuugucuauuugcaaaaagagaaagaccggcucgaacgugaugcucgcaguuuguaaaaggaugugcuuccgcgcgacgaucgaggcuagccgacgggcccugcuaauccguucaauuaucaauacuaccuucgucauuuguauacugacacucaccaucugcgugguguccacaagugcagucgaaauggagaaccugccaucuggaacuugggaaagagaggaggaucuuaccaauuuuugucaccaggaaugccaaguuacagagacugaauguuugugccccuacgaggcccugguguuaaggaagccucucuuccuggacagcauugugaaaggcaccaagaaccuucuuaauuccacgucacuagagacaucucucagcaucgaagcuccguggggagccauuaacguacagaguaccuuuaaacccacugucuccaccgcaaauaucgcucugagcuggucuucaguggagcaccgcggaaacaagauauugguuacaggccgguccgaaaguaucaugaagcuggaggaaagaacuggugugagcugggauuuaggggucgaggacgccucggagucuaaacuccugaccguguccauuauggaucuuagccagauguauucaccaguuuucgaauaccugaguggagacaggcaaguggaggaauggccuaaggcgacguguacaggcgauugccccgagcgaugugguugcaccucuuccacuugcuugcauaaagaauggccacacagccgcaauuggcgguguaacccuacauggugcuggggcguagggaccggauguacuugcuguggcgucgacgugaaggaucucuuuacagaccauauguucgugaaauggaaggucgaguacaucaagaccgaggccauuguuugcguggaacugacgucacaggagagacaguguagucuaaucgaagcugggacuagguuuaaucugggacccguaaccauaacacuuagcgagccacguaacauucagcaaaaacucccgccugaaaucaucacccugcaccccaagguggaggagggcuucuuugauuugaugcauguccagaaagugcuguccgcaucuacaguuugcaaguuacagagcuguacucacgguauuccaggggaccuccagguguaucacauaggaaaccugcuuaaaggcgaccgcaucaauggucaucugauucacaagaucgaaccccauuucaacaccuccuggaugucaugggauggcugcgacuuggauuacuauuguaauaugggggacuggccuucuugcacguacacaggagucacucaacacaaccacgccgcuuuugugaaucuccugaacauugagaccgauuauacaaagaccuuccauuuucacaguaaacggguuacugcccauggcgacaccccacagcuagaucugaaggcaagacccacauacggggcgggagaaaucacggugcuugucgagguagccgacauggagcuccacacuaaaaagguggaaauaucgggccugaaauucgcuagcuuggccugcaccgguuguuaugcaugcuccucugggaucucauguaagguuaggauucauguggaugagccugacgaauuaacaguccacgugaaaagcuccgauccggacguaguggcugccaguaccucucugauggcacgaaagcucgaguucggaacugauagcacauuuaaggccuucucagcuaugccaaaaaccucccugugcuuuuacaucgucgaacgggaguacuguaagaguugcagcgaggaagacacgcagaaauguguugacacuaaacuugagcagccccaaucuauucugaucgaacacaagggcacaauaauugguaagcagaaugauaccugcaccgcgaaggccuccuguugguuggagucagugaaaaguuucuuuuauggccuaaagaacaugcuggggucgguguucggaaacuuuuucaucggcauccuccuguuucuugcaccuuucgucuuacuggugcucuuuuucauguucggguggaaaauuuuguuuugcuucaaguguugccgcagaacuaggggacugcucaaauaccggcaucugaaggacgaugaagagacaggcuaucgaagaaucauagagcgccuuaauaauaagaaagguaagaacaggcuguuggacggggaacgucuagcugaucggaaaauugccgagcuguuuucuaccaagacacacaucggauga

SEQ ID NO: 10420 - RNA, 5052 nt, Artificial Sequence
  derived and/or modified CDS sequence (opt3) from CCHFV(Kosovo/9553/2001)__AY675511.1__GP
augcacacccugcucgugugcuucauccuuuaccugcaguuguuaggccuugggggagcccauggucaaagcaacgcuacagagcacaauggcacuaacacgaccacagcacccgggacuucccagucuccuaagccaccggccucaaccacacccagucaugcgccugaaagcuccaccauuaaacuaacuacaccaaccucugagacggaaggaucgggcgagacuacacccccuacaucaacuacccaggguagcccaccccucgaaacaaccccugagagaaguacgacuacagcuaccuccacuucugggacagacaauaugaacagcaccacgcagaugaccgauaauacaccaacucugaccgccuccacaucaccgaguagcucucccuccacuccuucaaccagccaaggacuucacuauccagucaggagucuguugucuguuuccagccccaagacagugaccacuccuacgccaaugucgcccggcgagaugucuuccgaaacaucaagucagcauagcgcaaugucccggaccccgacuccucacaccgccacacagguaucuaccgagaacgcuaaucgcagcacuucacgacagagugaauccagcgcacaacccgccacacagucuccagugacgaguccugcucagaguauacuccugaugagcgccacccccacuacaauccagaacauucacccaucccccaccaaucguucuaaaagaaaccuggagauggagaucauucucacauuaucgcaaggccugaagaaauacuaugggaagauccuuaaguugcugcaucuaacucucgaagaggacaccgaaggacugcuugagugguguaaaaggaaucuggguagcaacugcgaugacgacuuuuuccagaagcggauagaagaguuuuucaucacgggcgagggguacuuuaaugaagucuugcaguucaaaacccucuccacaccuucaccaacugagccgagucacgcgcgccugcccaccgcagaaccuuuuaagucuuauuucgccaaaggauuuuuaagcauugauuccggcuacuucucagcuaaguguuauccaagaagcucuacauccggucugcaacucaucaacgugacucagcaucccgccaggauugcagagaccccugggccaaagaucacgagucuuaaaacaauaaauugcauuaaccugcgggcuagcguuuuuaaggaacaccgcgagguggagaucaacgucuugcuaccccagauugccgugaaucugucuaacugucacguaguuaucaauucccaugugugcgauuacucacucgacaccgauggaccgguccgacugccuagaaucuaccacgaaggcacuuucaugccaggcacauauaaaauugugauagacaggaagaacaaacuuaaugaucgguguacccuggugacuaacugcgucaucaaggggcgugagguucgcaaaggacagaguguguugagacaauacaagaccgaaauuaagaucgguaaagcgcccacaggcagcaggaagcuccugucggaggaaccuggggacgauuguauaucccggacgcaguuacugcgaaccgagacugccgagauucaugacgacaauuauggaggccccggugauaaaaucacaaucugcaacgggucuaccauuguagaccagcgccuaggcagcgaacucggauguuacacaaucaauagagugaagucauuuaaacugugcgagaacagugcaacuggcaagaccugcgaaauugauuccacgccagucaaguguaggcagggguucugccuuaaaauaacacaagagggacggggucacgugaaguugucucgcggcagcgagguugugcuggacgcuugugauuccucaugcgaagucaugaucccuaaagggaccggagacauucucguggauuguagcggcggucagcagcauuuccugaaggacaaucuuaucgaucuggggugcccccacaucccauugcucggcaaaauggccauuuauauagcuagaaugaguaaccacccgaagacuaccauggccuuucuguucugguuuucuuuaggauacguaaucacauguauucugugcaaggcacuauucuauucccucaucauuaucggcacucuggggaaaaagauaaaacaguacagggagcuuaagccucaaaccuguacaaucugcgaaacggcccccguuaaugcuauugacgcggagaugcaugauuugaacuguagcuacaauaucugcccauauugcgcaucgcgucugaccucagacggacucgcccggcacgugaaacagugucccaagcgaaaggaaaaagucgaggagacugaacuguacuuaaaccuggagaggauuccuuggguggucagaaaacuucuccaggugucugaaaguacagguguugcuuugaagcgcuccagcuggcugaucgugcuacugguacuccugaccgucucucuuagcccagugcaguccgcccccguuggccaugggaagacuauagagacauaucaaacccgggaaggauuuacgucaauuugcuuguucaugcugggcaguaucuuauuuauugugagcugucucgucaaaggucugguggacucuguauccgauucauucuuuccugggcuuagugugugcaagacuuguagcaucggcuccauaaacggauucgagaucgagucucacaaaugcuacuguucgcuguuuugcuguccguauugcagacacuguagcgcagacagggaaauucaucaguugcaccucucaaucugcaagaagcgcaaaaccggcuccaauguuaugcuggccgucugcaagcgaauguguuuccgggcuacaauugaggccagucguagagcacuacugaucaggucuauaauuaacaccacuuuugugaucugcauccucacacugaccauuuguguggcgagcacauccgcugucgaaauggagacucuuccagccgcaaccugggaacgcgaggaggauuugacgaauuucugccaucaggaaugucaaguucccgagacagaaugccuguguccuuacgaggccuuagugcuccggaaaccacuguuccuugacucaaucgugaaggggaugaaaaaccugcuaaauucuaccagccucgagacuucacuguccauugaagcucccuggggagccauaaacguacagagcaccuuuaagccuacagucucuacugcaaauaucgcuuugucaugguccaguguggagcacagaggcaacaagauucugguuaccgguaggagcgaaucgaucaugaaauuagaggaacgaacgggggugucuugggaucucggagucgaggacgccuccgagagcaagcugcuuacagugucaauuauggaucugagucagauguauucuccgguuuucgaauacuuguccggcgaccgccagguggaggaauggcccaaagcgaccugcacuggugauuguccagagcggugcggcuguacaagcucaaccugccuccauaaggaauggccucacaguagaaauuggaggugcaaccccacuugguguuggggaguagggacaggcugcaccuguugcggggucgacgugaaagaucuguuuacggaccacauguucgugaaguggaaggucgaguacaucaaaacugaggccauaguuuguguggaacuaaccagccaagagcgucagugcucccugaucgaagcuggaacacgcuuuaaucuuggcccaguaaccauuacacucucugagccucggaacauccagcagaagcugcccccagaaauuaucacuuugcauccgaaaauagaggaggguuucuuugaucugaugcacgugcaaaaggucuuaagcgcauccaccguguguaaacuccagucaugcacgcaugggauuccuggagaccugcagguuuaucacaucggcaaucuucugaagggugacagagugaacggccauuugauccacaagauugaaccccacuucaauacaucuuggaugaguugggaugggugugaccucgauuacuauugcaacaugggagacuggccaucguguacuuacaccggcgucacacagcauaaccacgccgcuuuugugaaucugcuaaacauagagaccgauuauacuaaaaccuuccauuuucacagcaagaggguuacagcccacggggacacgccccaacuggaucuuaaagcacgaccuacuuacggagcgggcgaaaucaccgugcucgucgagguagccgacauggagcugcauacaaagaaaguggaaauuuccgguuugaaguucgcuucuuuagccugcaccgggugcuaugcauguucaagcggaaucuccugcaaaguucggauucacguggaugagccagacgaacugacuguccaugugaagaguucugaucccgacguaguggcugccagcacaucacucauggcacgcaagcuggaguuuggcaccgauuccacguucaaagccuucagugcuaugccuaagacuagccuuuguuuuuacaucgucgaaaaagaguacugcaagucuuguuccgaggacgacaccaaaaagugcguugauaccaagcuggaacagccgcagucaauauugaucgagcacagagguaccauuaucggcaaaccaaaugacacuugucccgcgaagacaagcugcuggcuagaaucggugaaaucuuucuuuuaugggcugaagaacaugcucggaaguguguucggcaacuuuuucauugggauccugcuguuuuuagccccuuucuuucuguggaugcucuccuucauguuuggauggaaaauauuguucuguuucaagugcuguaggcggacccgaggccuguuuaaguacagacaucucaaagaugacgaggaaacagguuaucgcaggauuaucgagcgucugaauaauaagaaagggaagaaccggcuucuggauggagagagauuggcagacaggaaaaucgcugaacuauucagcacuaagacgcacauuggcuga

SEQ ID NO: 10421 - RNA, 5052 nt, Artificial Sequence
  derived and/or modified CDS sequence (opt3) from CCHFV(4495-ST-2008)__KR814869.1__GP
augcacacccugcucgugugcuucauccuuuaccugcaguuguuaggccccgggggagcccauggucaaccuaacgcuacagagcacaauagaacuaacacgaccacagcaccaagcacuucccagucuccgaagcccccugugucaaccgccccaccccaugcgcuggaaaguccuacaauuaaaagcaccacuccaacauccgagaccgaaggcucuggggagacgacucccccuccaaauaccacacagggaccgucgcccccugaaacuaccccagagaggcccgcuacaaccgccacgucaacuccuagcacagacaacaccaauaguacuacacacguuaccgauaacaauccaacguccaccauaucuacaagccccuccucaaguccgagcacuccuucuacaccccggggcauccaucacccagcacgcaaccuacucuccgugucaagcccuaagaccgccacuacccccacaccaaccagucccggugagauuucuuccgaaacuagcucgcugcacucugcuaugucccgaacgucaacacuuuauaccgcaacucaggccaguaccgagaaugcuaaccauagcacaccucgucaauccgaaucuccagcccagccgaccacuacaagccugaugacgucacccgcgcagaguaucuugguaauguccgcagccccuaccgcuauucagaauauccacccaagccccacuaacagaucuaaaaggaaucucgagauggagauaauccugacacugucacaagggcucaagaaauacuauggaaagauuuuaaagcugcuucauuugacccuggaagaggacacagaaggccuacucgagugguguaaacggaaccugggcaguaauugcgaugacgacuuuuuccagaagcgcaucgaagaguuuuucaugacuggggagggauacuuuaacgaagugcuucaguucaaaacccugagcacguuguccccuaccgagccaucucacgccagacccccgacagucgaaccuuuuaagucguauuucgcaaaagguuuucucagcauugauuccggcuacuucucagcuaaguguuauccaaggaguucuacuagcgggcugcaguuaaucaacgugacccaacaccccgcccggauagcggagacaccuggacccaagacuaccucccugaaaacgauuaauugcaucaaccuccgcgccucaguuuuuaaggaacaucgagagauugagaucaaugugcuucugccacagaucgcagucaacuugagcaauugucacgugguaauuaacucucauguuugcgauuacucccuagacacagauggcccugugagacugccccacauauaccaugaagguaccuucaucccagggacuuauaaaauugucaucgacaagaaaaauaagcucaacgauagguguacacuggugaccaauugcgugauaaaaggacgggagguccguaagggccagaguguucuucgccaauacaagacugaaauuaaaaucggcaaggugagcaccgggucuagaaaacuguuguccgaggaaucaggagacgauuguaucaguaggacacagcuccugcggacggagaccgcugagauucacgacgacaacuaugguggcccgggggauaagaucacuauuugcaauggaagcacaauaguagaccagcgauuaggcucggaacuggguuguuacaccaucaaccgcgugaaauccuuuaagcuaugcgaaaauucugccacagggaagacuugcgagauugauagcaccccugucaaauguagacagggcuucugccucaagaucacgcaagagggaaggggccacgugaaacugucacgggggagugagguugugcuugacgcuugugauuccucuugcgaagucaugauccccaagggaacaggugacauuuugguggauuguagcggcgggcagcagcauuuccugaaagacaaccucauagaucugggaugcccacacaucccccuucugggcaagauggccauuuauaucugucgcauguccaaucauccuagaaccacuauggcauuuuuguucugguuuucauucgguuacguaauuaccugccucuuuuguaaggcccuguucuauagcuuaaucauaaucgggacacugggcaaaaagauuaaacaguacagggagcuacguccacaaacuugcaccaucugugaaacagcucccguuaacgcgauugacgcagagaugcacgaucucaacugcaguuacaauaucugcccuuauugugccucucggcugacguccgacggacuugcucgacacgugccgcagugcccaaagagaaaagaaaaggucgaggagaccgaauuguaccugaaccucgagaggauacccuggauugugcgcaagcuguuacaggucagcgaaucgacuggcguggcccugaaacggucaucuuggcuuaucguuuugcucgugcugcuaacaguaagucuguccccuguccagagcgcaccaguggggcauggaaagaccauugagacuuaucaaacaagagaagguuuuaccucuaucugucucuucaugcugggcagcauacuauuuuugguuuccugccuggugaaaggguuagucgacucagugagugauagcuucuuucccggacucucuguauguaagacgugcuccaucggcucaauuaaugguuucgagaucgagagucacaaauguuacugcagccugcuuuguugcccuuauuguaggcauugcuccgccgaccgcgaaauucaccagcugcauuugucuaucugcaagaaacgaaagacugggucgaacgugaugcucgcuguuuguaagcggaugugcuuucgugccaccauagaggcaagcagaagggcgcugcuaauucgcucaaucaucaauacaaccuucgucauuuguauccugacucucacaauuugcgugguguccaccagugcugucgaaauggagaaccugccgucuggcacaugggaaaaagaggaggaucuuacuaauuucugucaccaggaaugccagguuaccgagacggaauguuugugccccuacgaggcccugguguuacggaagccacucuuucuggacagcauagugaaaggaaugaagaaccuucuaaauuccacaucacuggagaccucucucagcaucgaagcaccuuggggcgccauuaacguacaaaguacuuucaaacccaccgucuccacagcuaauaucgcccugagcuggucuucaguggagcacagagggaacaagauuuugguuacuggaagguccgaaaguaucaugaagcuggaggaacgaaccggcauaagcugggauuuagguguggaggacgcaucggagucuaaacuccugacggucuccaucauggaucuuagccagauguauucaccaguguuugaauaccugaguggggaccgccagguugaggaauggccuaaggcuacauguaccggagauugccccgagcgguguggcugcacuucuuccacaugcuugcauaaagaauggccacacagcagaaauuggagguguaacccgaccuggugcuggggugugggcacuggguguacaugcuguggaguagacgucaaggaucucuucaccgaccauauguuugugaaauggaagguggaguacauuaagacggaggccaucgucugcguugaacugacuucacaagagcgucaguguagucuaauugaagcgggcacccgcuucaaucuggggccugugacaaucacccuuagcgagccccggaacauacagcagaaacucccacccgaaauuaucacacugcacccuaagguagaggagggauuuuucgauuugaugcaugugcaaaaaguccuguccgccucuacugugugcaaguuacagagcuguacccacggcaucccaggugaccuccagguuuaucacauugggaaccugcuuaaaggagacagagugaauggccaucugauacacaagaucgaaccccauuuuaacacguccuggaugucaugggaugguugcgacuuggauuacuauuguaauaugggcgacuggccuucuugcacauacacuggggucacccagcacaaccacgcugcauucgugaaucuccugaacauugagacagauuauaccaagacuuuucauuuccacaguaaaaggguuaccgcccauggagacacaccgcaacuagaucugaaggcucgaccaacguacggcgccggggaaaucacugugcuugucgagguagcagacauggagcuccacaccaaaaagguggaaauuucgggacugaaauuugcgagcuuggccugcacaggcuguuaugcuugcuccucugguaucucauguaagguucggauacauguggaugagcccgacgaauuaaccguccacgugaaaagcuccgauccugacguaguggccgcaaguacuucucugauggcucgcaagcucgaguucgggacagauagcaccuucaaggccuuuucagcaaugcccaaaacgucccugugcuucuacaucgucgaaagagaguacuguaagaguugcagcgaggaagacacucagagguguguugacacaaaacuugagcagccacagucuauucugaucgaacacaagggaaccauuaucggcaaacaaaaugauaccugcacugccaaggcuuccuguugguuggagucagucaagagcuuuuucuauggucuuaaaaacaugcugggcucgguguuugggaauuucuuuauaggcauucuccuguuccuugcgccuuuuguguuacugguccucuucuuuauguucggauggaagaucuuguucugcuuuaaauguugccggcgagccagagggcugcucaaguaccgccaucugaaagacgaugaagagacaggauauaggaagaucauugagcgucuuaacaauaagaaaggcaagaaccggcuguuggacggugaaagacuagcagauaggaaaaucgcugagcuguucucuaccaagacacacauaggguga

SEQ ID NO: 10422 - RNA, 5052 nt, Artificial Sequence
  derived and/or modified CDS sequence (opt3) from CCHFV(Mamon)__KX013478.1__GP
augcacacccugcucgugugcuucauccuuuaccugcaguuguuaggccuagggggagcccauggucaaagcaacacaacugagcacaauggcacgaacaccacaacugcucccuccaccucucagucaccuaagccacuggucaguacagcaccgccccaugcccucgaaagcuccaccauuaaaccuacuacaccagcgucugagaccgaagggucgggagagacgacucccccuccaaauauaacccagggccccucaccuccagaaacaacuccggagagacccgcuaccacagccaccagcacgccuaguacugacaacacaaauuccaccacucacguuacagauaacaauccaaccucuacgaucagcaccucccccucaaguagcccuucuacaccauccacuccccaggguauucaucacccggcaaggaaccugcuuucagugagcaguccuaagaccgccacaacucccaccccaacaucuccuggggagaucuccagcaaaaccucgucucugcacuccgcuaugucacggacgaguacuuuguauacagcaacccaaguaagcacugaaaaugccaaccauuccgcuccccgccagucugagagcucagcccagccaaccacaaccagucccaugacuuccccugcgcagagcauucucgugaugucugcagccccaacagcuauccaaaauauacacccgucacccacgaaccgaaguaagcguaaucuggaaauggagaucauucugacccucagccagggacugaaaaaguacuauggcaagauccugaaacuuuugcaucugacucuagaggaagacacagagggccuccuggaaugguguaagagaaaccuuggguccaauugcgaugacgacuuuuuccagaaaaggauugaggaauuuuucaugaccggagaggguuacuuuaacgagguccugcaguucaagacauugucuacucucucgccuaccgaaccaagccacgcccggcccccuacgguggagccauuuaaauccuauuucgcaaagggcuuucugucaaucgauaguggguacuucucugcuaaguguuauccccgcagcuccaccucaggauuacaacugauaaacguuacacagcacccggccagaauugcggaaacuccuggcccaaaaaccacaagccucaagacuaucaauugcauuaaccuuagggccucuguguuuaaagagcaucgggaaaucgagaucaauguccuguugccccagauugcagugaaccuauccaauugucacguaguuauaaacagucaugugugcgauuacagccuggacaccgaugguccuguccgccucccccacaucuaccaugaggggacguucauuccaggaacauauaagaucgugauagacaaaaagaauaaacugaacgaucgauguacccuugugacuaauugcgucauuaagggcagagaaguuaggaagggccaaucugugcugcggcaguacaaaacagagaucaagaucgggaaggcuuccaccggaucacguaaguugcucagugaggaaccuggugacgauuguauuagccgcacucagcuguuaagaaccgaaacagccgagauccacgacgacaacuauggcgggcccggagauaaaauuacgauaugcaauggcucgaccaucguagaccagaggcuggguuccgagcuaggguguuacacuauuaaccgggugaagucuuuuaagcucugcgaaaauagcgcuacaggcaaaaccugcgagaucgauucaacaccagucaagugucgacaaggauucugccugaaaaucacucaggaaggccgcgggcacgugaaacuuaguagaggauccgagguugugucugacgccugugauagcuccugcgaggucaugauuccgaaagguaccggcgacauauugguggauuguucagggggacagcagcauuuccugaaggacaaccucaucgaucugggcugcccucacauuccccuucuggguaagauggcaaucuauauuuguaggaugagcaaucauccacggacgacaguagccuuuuuguucugguuuaguuucggguacguuauaaccugcaucuuuuguaaagcucucuucuauucucugaucauuaucggcacuuuaggaaagaaaauuaagcaauaccgcgaacugaaaccccagaccugcacaaucugugagacugcgccugugaacgcaauagacgccgaaaugcacgaucuaaacugcuccuacaauauuugcccauauugugcuagcagacucaccucggacggccuggccaggcacgucccccagugcccuaagcguaaggagaaaguggaagagacagagcuuuacuugaaccuggaacggaucccguggauuguccgaaagcucuuacaggugucagagucuacggggguugcauuaaaaagaaguuccuggcugaucgugcuuuugguacuccugaccgucagccuaucuccagugcaaagcgcccccguuggacaugguaagacuauagaaacauaucagaccagggagggcuuuacuuccaucugucuguucaugcucgggucaauucuguuucuugugaguugcuuggucaaaggacugguggacagcguaucugauuccuucuuuccuggcuuaucaguguguaagacaugcaguaucgguagcauuaauggguucgaaaucgagucccacaaauguuacugcucucucuuuuguugcccauauugucgccauugcucggcugaccgggagauacaccagcugcaucuuagcauuugcaagaagagaaaaaccggcucaaacguuaugcuggccgucuguaagaggaugugcuuccgcgcaacgaucgaagcgucccgacgggcuuugcucauccguaguauuaucaauacuaccuucgugauuuguauacugacacuaaccaucugcguggucucuacuagcgccguugagauggaaaaccugcccuccggaacaugggagagagaagaggaucucaccaauuuuugucaccaggagugccaagugacagaaacugagugucugugcccuuacgaagcacuuguguugaggaaaccgcuguucuuagacucaauuguaaagggcaugaaaaaccuccuuaauucuaccagccuggagacgagucuguccaucgaggcccccuggggagcuauuaacguccagagcacauuuaagccaaccgugucuacugccaauaucgcacuaucaugguccaguguugaacaccgcgggaacaagauacucgugaccggccggagcgagucgaucaugaaacuggaagagagaacaggugucucuugggauuuggggguggaagacgcuuccgagagcaagcuguuaacuguuucaauuauggaucucagucagauguauucuccuguguucgaguaccuguccggagacaggcaaguagaagaguggcccaaagccaccuguacgggcgauugcccagaacgaugugguugcacaagcucaaccugccuucauaaggaguggccucacagucgcaauuggcgguguaaccccacuuggugcuggggcgucgggacaggauguaccugcuguggcguggacgugaaagaucuguuuacugaccauauguucgucaaguggaagguugaauacaucaaaacagaggcgauugugugcguagaguugaccagccaggaaagacaguguucccucaucgaggccgggacgagguuuaaucugggaccagugacuauaacccuaucugaaccgcguaacauucagcaaaagcugccucccgagaucaucacacuucacccaaaagucgaagagggcuucuuugaucucaugcaugugcagaagguucugagcgcuuccaccgugugcaaauugcagucauguacacacgguauucccggggaccugcaggucuaucacauaggaaacuuacucaagggcgaccgcgugaauggucaucugauccacaagauugagccucauuucaacacuucuuggaugaguugggauggcugcgaccuugauuacuauuguaauaugggggacuggccaucgugcaccuacacgggaguuacacaacacaaccacgcagccuuugugaaucuguugaacaucgaaacugauuauaccaaaacauuccauuuucacagcaagcgggucaccgcucauggcgacacuccccagcucgaucugaaagccagaccuaccuacggggcaggagagauuacagugcuaguagaaguugcggacauggagcugcacacgaagaaaguggagaucuccggccuuaaguucgccucucucgcuugcacugguuguuaugccugcucaagcgggauauccuguaaagucaggauccauguggaugaaccggacgagcugaccguacacgugaagaguucugauccagacgucguugcagcuagcacaucauugauggcccgaaaguuagaguucggaaccgauuccacuuuuaaagcauucagugccaugcccaagacaagccugugcuuuuacauuguggaacgggaauacuguaaaucuugcuccgaggaggacacccagaaguguguggacacgaaacucgaacagccucaaucaauccugauugagcacaagggcacuaucauagguaagcagaaugauacaugcaccgcuaaaaccagcuguuggcuugaaucggucaagucuuucuuuuauggccugaaaaacauguuggggaguguguucggaaacuuuuucauuggcauccuacuguuucucgcgcccuucguucugcuuguauuauuuuucauguucggguggaagauccuguuuugcuucaaauguugccgcagaacuaggggacucuugaaguaccggcaucugaaggacgaugaggaaacaggcuaucgaagaauuaucgagcgccucaauaauaaaaaggguaaaaacaggcugcuugacggggagcgucuggccgaucggaagauagcagaauuguuuuccaccaaaacacacauuggauga

SEQ ID NO: 10423 - RNA, 5052 nt, Artificial Sequence
  derived and/or modified CDS sequence (opt3) from CCHFV(81-R-2014)__KR814865.1__GP
augcacacccugcucgugugcuucauccuuuaccugcaguuguuaggccuagggggagcccauggucaaagcaacgcuacagagcacaauggcacuaacacgaccacaguccccuccacuucucagucaccuaagccacugguuaguaccacaccgccccaugcacucgaaagcuccaccauuaaaccuacuacaccaaccucugagacggaagggucgggagagacugccccucugccuaauaccacacagggcccacccccuccagaaacuaccccggagagacccgcgacaaccgugacgucaacuccuagcacagacaacaccaauaguacuauacacguaacagauaacaauccaaccuccacgaucucuaccagccccuccucaaguccuagcacaccaucuacuccccaggguauucaucacccggcuaggucccuucugucagugagcaguccuaagaccgccacaacucccaccccaacaucuccuggggagaucaacuccgaaaccagcucguugcacucugcaaugucccggacucccacgcuccauacagccacccaagucucaacugagaaugcuaaccacagugcaccacgccagagcgaauccucugcccagcccaccacaaccagccugaugacuucacccgcucagaguauucugcucauguccgccgcgccaacagcaauccaaaauacgcauccgagccccaccaaccgaucuaaacguaauuuagagauggagauaauccugacucuuucacagggauugaagaaauauuacggcaagauucugaagcuacuccaccugacacuugaagaggacaccgaaggccuguuggagugguguaaaagaaaccucgggaguaauugcgaugacgauuucuuccagaagaggaucggagaauuuuucaugacaggugagggcuauuuuaacgaggugcugcaguucaaaacuuuaagcacccuguccccuacggaaccaucucacgcccggcuccccaccguugagccuuuuaagucguacuucgcuaaaggguuucuuagcauugacuccggauauuucucagccaaguguuacccacgcaguucuacaagcggccugcaauugaucaacgugacucagcaucccgcaagaauagcugaaaccccggguccuaagacaacuucccuaaaaaccauuaauugcaucaaccugagggccucagucuuuaaggagcaccgggaaauugagaucaaugugcuccugccacagaucgcgguaaaccuuagcaauugucauguugugauuaacucucacgucugcgauuauucccuggacacggaugggcccgugcgcuugccucauauauaccacgagggaacauucauccccggcaccuacaaaauugugaucgacaagaaaaauaagcucaacgaucgauguacucuggucacaaauugcguuauaaaaggcagagaagugaggaaggggcaaaguguauuacggcaguauaagaccgagauuaaaaucggaaaggccagcacugguucucguaaacugcuauccgaggaaccaggcgacgauuguaucucacgcacccagcuccugagaacagaaacggcagagauucacgacgacaacuacgggggaccuggcgauaagaucaccauuugcaaugguaguacuauaguggaccagaggcuugggagcgaguugggcuguuauacaaucaaccgggucaaaucguuuaagcugugcgaaaauuccgcuaccggaaagacaugcgagauugauucuacucccgugaaaugucgacaaggcuucugccucaagaucacccaggaagggcgcggacauguuaaacugagcagagguucagaggugguccuugacgccugugauaguuccugcgaggugaugaucccaaagggcacgggggacauucugguagauuguucuggaggccagcagcacuucuugaaagacaaccucauagaucuggguugcccgcauaucccuuuacuggggaagauggcuauuuacaucuguaggaugagcaaucacccccggacaaccauggccuuucuauucugguuuuccuucggcuauguuauuacuugcaucuuuuguaaggcacucuucuacucacugauaaucauuggaacccuuggcaaaaagaucaaacaauaucgcgaauugaagccacagacaugcacuauuugugagaccgcccccgugaacgcuaucgacgcggaaaugcacgaucugaacugcagcuacaauauaugcccuuacugugcaaguagacucacaucugacgggcuggccaggcaugucccacagugccccaaacguaaggagaagguggaagagacggaguuauaucugaaccuugaacggauuccuuggaucguccgaaaauugcuccagguguccgagagcaccggaguugcucugaagagaucgucauggcuaauugugcugcucguacugcuuacugucucuuugaguccggugcaauccgccccaguuggucacggcaaaacaaucgaaaccuaccagacuagggagggguuuacaagcauaugucuguucauguuaggaucuauccucuuucuggugagcugccuugucaagggccugguggacuccguaucagauaguuucuuucccgguuugagcguguguaaaaccugcucuauuggguccaucaauggcuucgaaauugagucacauaaguguuauugcagucucuuuuguugcccuuacugucgccacugcagcgcagaccgggagauccaucagcugcaccuauccauaugcaaaaagagaaagacgggaucuaacguuaugcuggccgucuguaaaaggaugugcuuccgcgcuacuauugaagccucgcgacgggcacuccugauccguagcaucauuaauaccacauucgugaucuguauucuuaccuugacuauaugcguggucucaacauccgcgguugagauggaaaaccugccagcuggcaccugggagagagaagaggauuuaacaaauuuuugucaccaggagugccaagugacugaaaccgagugucucugccccuaugaagcccuggugcuuaggaagccucuguuccuagacaguaucguaaaagggaugaagaaccuccuuaauucuacgagcuuggagacaucccugucaauugaggcaccguggggagccaucaacguccagucuaccuuuaaacccacugugagcaccgcuaauauugccuuaaguugguccagcguugaacaucgcggcaacaagauccucgugacaggucggucugagucaauaaugaagcuggaagagagaacuggggucuccugggaucuuggaguggaagacgcaagugagagcaaacuguugaccguuucgaucauggaucucucucagauguacuccccaguguucgaguaucugagcggcgacaggcaaguagaagaguggccuaaggcuacguguacaggugauugccccgaacgauguggcugcaccucaaguacuugccuacacaaagaguggccacauucucgcaauuggcgguguaacccuacauggugcuggggagucgggaccggcuguacuugcugugggguggacgugaaggaucuguuuacagaccacauguucgucaaauggaagguugaauacauuaagaccgaggccaucgugugcguagagcuuacgucccaggaaagacaguguagccucauugaggcgggaacuagguuuaaucugggccccgugaccaucacauugucagaaccacguaacauacagcaaaaacugccgccugagauuaucaccuuacaucccaaggucgaagaggguuucuuugaucucaugcacgugcagaaaguucugagugccagcacagugugcaagcugcaguccuguacucacgggaucccaggagaccugcaggucuaccauauuggcaacuugcucaaaggugaccgcauaaauggccaccugauccauaagauugagccccacuucaacaccucuuggaugagcugggaugggugcgaccuagauuauuacuguaauaugggagacuggccuuccugcacguauacaggcgugacucaacacaaccaugcugcauuuguuaaucugcuuaacaucgaaaccgauuacacaaagaccuuccacuuucauucaaaacgggugacugcccacggggacaccccacagcucgaucugaaggcuagacccacauauggagccggcgagauuacggucuugguagaaguggcagacauggaguuacauacuaaaaagguugagaucucuggucugaaauucgcgagucucgccugcaccggguguuacgcuugcucgagcggaauauccuguaaggugaggauccacgucgaugaaccugacgagcugacagugcacguaaaaucuucagauccggacguggucgccgcaagcaccucccuuauggcucgaaagcuggaauuuggcacugauaguacauuuaaggccuucucugcaaugccaaaaaccagcuugugcuuuuauauuguugagcgggaauacuguaagucaugcuccgaggaggacacgcagaaauguguggacacucgccuagaacagccccaaaguauccugauugagcauaaggguacaaucauaggcaaacagaaugauaccugcaccgccaaggcuagcuguuggcucgaaucugugaaguccuucuuuuacgggcugaaaaacaugcuuggaucagucuucggcaacuuuuucauugggaucuuacuguuucucgcgccuuucguguugcugguucucuuuuucauguucggauggaagauccuguuuugcuucaaauguugcagaaggacucggggccuucugaaguaucgacacuugaaagacgaugaggaaacagguuacagacgcauuaucgagaggcuaaauaauaagaaggggaaaaaccgucugcucgacggagagcgguuagccgauagaaagauagcagaacuguuuagcaccaaaacacauauuggcuga

SEQ ID NO: 10424 - RNA, 5052 nt, Artificial Sequence
  derived and/or modified CDS sequence (opt3) from CCHFV(5180-R-2011)__KR814874.1__GP
augcacacccugcucgugugcuucauccuuuaccugcaguuguuaggccuagggggagcccauagacaaagcaacgcuacagagcacaaugguacuaacacgaccacagcacccuccacuucucagucaccuaagccaccggucaguaccgcgcccccuuaugccccagaaagcuccacaauuaaacccaccacuccugcuucugagacagaaggcucgggggagaccacgccacccccuaauacuacccagggaccaucaccgcccgaagccacaccugagaggccagcaacuaccgccacaagcacccccaguacggacaacacuaauuccacaacccaugcuacugauaacaauccuacaucuaccauaagcacguccccaucaaguagccccucuaccccguccacaccucagggcauccaccaucccgcacggaaccugcucucaguuagcaguccaaagacugccaccacaccuacucccaccucuccaggugacauuuccagcgagacaucgucucugcacuccgcuaugucacgcacccccacucuucacacggccacacaagcgaguaccgaaaaugcaaaccauagcgccccucgacaguccgagucuagcgcucagcagacuaccacaucaccaaugaccaguccggcccaacccauccuggugauguccgcagcuccuacugccauucagaauauccacccaagccccacaaaccguucuaaaagaaauuuggaaauggagauaauccucacgcugucacaggggcugaagaaauacuauggaaagauucucaaguuacugcaucuuaccuuggaggaagauacugagggccugcuagaaugguguaaaaggaaccucggcaguaauugcgacgaugacuuuuuccagaagcggaucgaggaauuuuucaugacaggggagggauacuuuaacgagguacugcaauucaaaacccuuagcacacuguccccuacugaaccaucucacgcgagacccccgaccguggagccuuuuaagucguauuucgccaaaggauuuuugagcauugauuccggcuacuucucagcaaaguguuauccacgccucaguacgucugggcugcaguuaaucaacgucacccagcaccccgcuaggauagccgaaacaccuggacccaagacuaccagccugaaaacaauuaauugcaucaaccuccgggcuuccguguuuaaggagcaucgcgaaauugagaucaauguucuucugccacaaaucgccgugaacuugucaaauugucacgucgugauuaacagccauguaugcgacuacucucuagauacugacggcccuguucgacugccccacauauaccaugaggguaccuucaucccagggacguauaaaauugugaucgauaagaaaaauaagcucaacgacagauguacacuggucaccaauugcgugauaaaaggaagggaaauucggaagggccaguccgugcuucgucaguacaagacugagaucaaaaucggcaaggcaaguacagggagccgcaaacuguugucugaggaaccgggagaugacuguauuuccagaacccagcuccugaggacugaaaccgccgagauccacgacgauaacuaugguggcccuggggacaagauuacaauaugcaauggaucaacgaucgucgaucaacgguuaggcagugagcuggguuguuacaccauuaaccgaguuaagagcuuuaaacuaugcgaaaauucggcuacugggaagacaugcgagaucgacuccacccccgugaaaugucgccagggcuucugccucaagaucacacaggaaggaagaggccacguaaaacugucuagggggagcgaggugguccuugaugcgugugacacuucaugcgaggugaugauuccaaagggaaccggugauauauugguugacuguaguggcgggcagcaacauuuccugaaagauaaccucaucgaccugggaugcccccacauuccucuucugggcaagauggcaaucuauauuugucggauguccaaucauccacgcacgacaauggccuuuuuguucugguuuucuuucgguuacgugauaaccugcaucuuuuguaaggcucucuucuauagccugaucauuaucgggacuuuaggcaaaaagauuaaacaguacagagaacugaagccccagaccugcacaaucugugagacugccccugucaacgcaauagaugccgaaaugcacgaccuaaacugcuccuacaauauuugcccguauugugcuucaaggcucaccagcgacggacuggcccgucacgugccacagugccccaaacggaaggagaagguagaagagacagagcuuuacuugaaccuggaacgaaucccuuggauuguuagaaaacuccugcaagugagugagucuacgggcgucgcauuaaagagguccagcuggcugaucgugcuuuugguccuccugaccgugucgcuaucaccaguucagucugcgcccguggggcauggaaaaacuauagaaacauaucagacccgcgaggguuuuacaaguguaugucuguucaugcucggcuccauccuguuucuugucagcugcuuggugaaggggcugguugauucugugagcgacuccuucuuuccuggauuaucagucuguaaaacaugcaguauuggcagcaucaaugguuucgaaauugagucucacaaguguuacugcucccucuuuuguugcccguauugucggcauugcucagcugauagagagauccaccagcugcaucuuaguauaugcaaaaagaggaagauggggagcaacgugaugcuggccguauguaaacgcaugugcuuccgagcaaccauugaagccucccggcgugcuuugcucaucagaucuaucauuaauacgacuuucgugaucuguauucugacccuaacaauaugcguugucucgaccagcgccguggagauggaaaaccugcccucaggcacuugggagagggaagaggaccucacaaauuuuugucaccaagagugccaggugaccgaaacagagugucugugcccauacgaagcacuugucuugcgcaagccucuguucuuagauuccaucguuaaaggaaugaagaaccuccugaauaguacuucucuugagaccagccuguccauugaggcucccuggggcgccaucaacgugcagucaacguuuaaaccaacagugucuaccgcgaauauugcccuaagcuggaguuccguagaacaccgggggaacaagauccucgucacuggaagaagcgagucuauaaugaagcuggaagagaggaccggcgugucaugggacuuggguguugaagaugcuuccgagaguaaacuguuaacagugagcaucauggaccucucgcaaauguauucuccugucuucgaguaccuguccggggaucgacagguggaagaguggcccaaggcaacuuguaccggagacugcccagaacgcuguggcugcacgagcucaacaugccuucauaaagaguggccgcacagucggaauuggagauguaacccuaccuggugcugggguguuggcacuggguguacaugcuguggaguggauguaaaggaccuguuuaccgaucauauguucgucaaauggaagguggaauacauuaagacugaggccaucgugugcgucgaguugacaucucaggaaaggcaguguucccucauugaggcuggcacccguuuuaaucuggggcccguuacgaucacucuaagcgaaccacgcaacauacaacagaaacugcccccugagauuaucacccuucacccaaagguggaagagggauucuuugaccucaugcauguacagaaagugcugucagccaguacagucugcaaguugcagagcuguacccacggcauccccggugaccugcaaguguaucacauugggaacuuacucaaaggagaucggguuaauggccaucugauacacaagaucgagccucauuucaacacauccuggaugucuugggacgguugcgaucuugacuacuauuguaauaugggcgauuggccgagcugcacuuacaccggggugacgcagcacaaccacgcagcguuugucaaucuguugaacauugaaacagacuauacuaagaccuuccauuuucacuccaaaagagugacagcccauggagauaccccacagcucgaccugaaggcuaggcccacuuacggcgccggggagaucaccguucuaguggaagucgcagauauggagcugcacacuaaaaagguagagauuucaggacuuaaauucgcuucucucgccugcacgggcuguuaugcaugcaguucggguaucagcuguaaggugcgaauacauguugacgaaccugaugagcugacugugcacgucaaauccaaugaccccgaugugguagccgcuucuaccucauugauggcgcggaaguuagaguucgggacagacagcaccuuuaaggccuucuccgcaaugccaaaaacaagucugugcuuuuacaucguggaacgcgaauacuguaagucuugcagcgaggaggacacucagaaaugugucgauaccaagcucgaacaaccucagucaauucugaucgagcacaaaggaacgauuaucggcaagcagaacgacacuugcacagcuaaggccuccuguuggcuugaaaguguuaagagcuucuuuuauggucugaaaaauauguugggcucuguguucgggaacuuuuucauagguauucuacuguuucucgcccccuucgugcugcuugucuuauuuuucauguucggcuggaaaauccuguuuugcuucaaguguugcagaaggacccgggggcucuugaaauaccgacugcucaaggaugacgaggaaaccggauauagacgcaucauugagaggcugaauaacaagaaaggcaagaaucgucuucuggauggugagcgguuggcugacagaaaaaucgcagaacuauuuuccacuaagacacauauaggguga

SEQ ID NO: 10425 - RNA, 5052 nt, Artificial Sequence
  derived and/or modified CDS sequence (opt3) from CCHFV(24-R-2012)__KR814856.1__GP
augcacacccugcucgugugcuucauccuuuaccugcaguuguuaggccuggguggagcccauagacaaagcaacgcuacagagcacaaugguacuaacacgaccacagcacccuccacuucucagucaccuaagccaccggucaguaccgcgcccccucaugccccagaaagcuccacaauuaaacccaccacuccugcuucugagacagaaggcucgggggagaccacgccacccccuaauacuacccagggaccaucaccgcccgaagccacaccugagaggacugcaaccacagccaccagcacgccaaguacugacaacacaaauuccaccacucacgcuacagauaacaaucccaccucuacgauaagcaccuccccuucaaguagcccaucuacacccuccacuccgcagggcauccaucacccugcacggaaccuacucucaguuagcagucccaagaccgccacaacuccaaccccuacaucucccggugacauuuccagcgagaccucgucucugcacuccgcuaugucacgcacuccaacgcuucauacagccacccaagcgaguacugaaaaugcaaaccacagcgcuccccgacaguccgagucuagcgcccagcagaccacaaccucaccuaugacuagcccagcccaaccgauccuggugauguccgcagcucccacagccauucagaauauccauccuagcccaacgaaccguucuaaaagaaauuuggaaauggagauaauccucacccugucacaggggcugaagaaauauuacggaaagauucucaaguuacugcaccuuacuuuggaggaagauacagagggccugcuagaaugguguaaaaggaaccucggcaguaauugcgacgaugacuuuuuccagaagcggaucgaggaauuuuucaugaccggggagggauauuuuaacgagguacugcaauucaaaacacuuagcacucugucccccaccgaaccuucucacgcgcgcccacccacgguggagccguuuaagucguacuucgccaaaggguuuuugagcauugauuccggcuauuucucagcaaaguguuacccuagacucaguaccucugggcugcaguuaaucaacgucacacagcauccagcuaggauagccgaaacucccggaccuaagaccacaagccugaaaacuauuaauugcaucaaccuccgggcuuccguguuuaaggagcaccgcgaaauugagaucaauguucuucugccccaaaucgccgugaacuugucaaauugucaugucgugauuaacagccacguaugcgacuauucucuagauaccgacggcccaguucgacugccucauauauaccacgaggguacguucauccccgggacauacaaaauugugaucgauaagaaaaauaagcucaacgacagauguacccuggucacuaauugcgugauaaaaggaagggaagugcggaagggccaguccguccuucgucaguauaagacagagauuaaaaucggcaaggcaaguaccgggagccgcaaacuguugucugaagaaccaggagaugacuguaucuccagaacucagcuccugaggaccgaaacagccgagauucacgacgauaacuacgguggcccgggggacaagaucacgauuugcaauggaucaaccauaguugaucaacgguuaggcagugagcuggguuguuauacuaucaaccgagugaaaaguuuuaagcuaugcgaaaauucggcuacagggaagaccugcgagauugacuccacaccuguaaaaugucgccagggcuucugccucaagaucacucaggaaggaagaggccaugugaaacugucuagggggagcgaggucgugcuugaugcgugugacaccucaugcgagguuaugauccccaagggaacgggugauauuuugguggacuguaguggcgggcagcaacacuuccugaaagauaaccucauagaccugggaugcccacauaucccccuucugggcaagauggcaauuuacaucugucggauguccaaucacccucgcacaaccauggccuuuuuguucugguuuucuuucgguuaugucauuacuugcaucuuuuguaaggcucucuucuacagccugauaaucauugggaccuuaggcaaaaagaucaaacaguauagagaacugaagccacagacaugcacuauuugugagaccgcccccgugaacgcaaucgaugccgaaaugcacgaccuaaacugcuccuacaauauaugcccuuacugugcuucaaggcucacaagcgacggacuggcccgucauguaccgcagugcccaaaacggaaggagaagguugaagagacggagcuuuauuugaaccuggaacgaauccccuggauugugagaaaacuccugcaagucagugagucuaccggcguggcauuaaagagguccagcuggcugauuguccuuuuggugcuccugacuguuucgcuaucaccugugcagucugcgccaguagggcacggaaaaacaaucgaaaccuaccagacucgcgaggguuuuacaagugucugucuguucaugcucggcuccauacuguuucuugugagcugcuugguuaaggggcugguggauucugucagcgacuccuucuuucccggauuaucaguguguaaaaccugcaguaucggcagcauuaaugguuucgaaaucgagucucauaaguguuauugcucccucuuuuguugcccuuacugucggcacugcucagcugauagagagauucaucagcugcaccuuaguaucugcaaaaagaggaagauggggagcaacguaaugcuggccguguguaaacgcaugugcuuccgagcaacgauagaagccucccggcgugcuuugcucauuagaucuaucaucaauacuaccuucguuauuuguauccugacacuaaccauuugcgucgugucgacuagcgccguggagauggaaaaccugccgucaggcacaugggagagggaagaggaccucaccaauuuuugucaccaagagugccaggucacagaaacugagugucugugccccuaugaagcacuuguuuugcgcaagccacuguucuuagauuccauagugaaaggaaugaagaaccuccugaauaguaccucucuugagacgagccuguccaucgaggcuccuuggggcgccauuaacgugcagucaacauuuaaacccaccguaucuacugcgaauaucgcccuaagcuggaguuccgucgaacaucgggggaacaagauucucgugaccggaagaagcgagucuaucaugaagcuggaagagaggacaggcguuucaugggacuuggguguggaagaugcuuccgagaguaaacuguuaacugucagcauaauggaccucucgcaaauguacucuccaguguucgaguaucuguccggggaucgacagguugaagaguggccuaaggcaaccuguacgggagacugccccgaacgcuguggcugcacaagcucaaccugccuucacaaagaguggccacauagucggaauuggagauguaacccgacuuggugcuggggugugggcacaggguguaccugcuguggaguagaugucaaggaccuguuuacugaucacauguucgugaaauggaagguggaauacaucaagacagaggccauugucugcguugaguugaccucucaggaaaggcaguguucccucaucgaggcuggcacgcguuuuaaucuggggccugugacuauuacccuaagcgaaccccgcaacauccaacagaaacugccacccgagauaauuacacuucauccuaagguagaagagggauucuuugaccucaugcacgugcagaaaguccugucagccaguaccgugugcaaguugcagagcuguacacacggcaucccaggugaccugcaaguuuaccauaucgggaacuuacucaaaggagaucgggugaauggccaccugauucauaagauagagccccacuucaacacuuccuggaugucuugggacgguugcgaucuugacuauuacuguaauaugggcgauuggccuagcugcaccuauacgggggucacacagcacaaccaugcagcguuugugaaucuguugaacaucgaaacugacuacaccaagacauuccacuuucauuccaaaagaguuaccgcccacggagauacuccgcagcucgaccugaaggcuaggccaaccuauggcgccggggagauuacagugcuagucgaaguagcagauauggagcugcauacgaaaaagguggagaucucaggacuuaaauucgcuucucucgccugcacuggcuguuacgcaugcaguucggguauuagcuguaagguucgaauccacguggacgaacccgaugagcugaccguccacgugaaauccaaugacccugauguaguggccgcuucuacaucauugauggcgcggaaguuagaguucgggaccgacagcacuuuuaaggccuucuccgcaaugcccaaaacaagucugugcuuuuauauagucgagcgcgaauacuguaagucuugcagcgaggaggacacccagaaauguguugauacgaagcucgaacaaccacagucaauccugauugagcauaaaggaacuaucauuggcaagcagaacgacacaugcaccgcuaaggccuccuguuggcuugaaagugugaaaucuuucuuuuacggucugaagaauauguugggcagcguguucgggaacuuuuucaucggaauacuacuguuucucgccccuuucguccugcuuguguuauuuuucauguucggcuggaaaauucuguuuugcuucaaguguugcagaaggacccgggggcucuugaaauaucgacugcucaaggaugacgaggaaacuggauacagacgcaucaucgagaggcugaauaacaagaaaggcaagaaucgucuucuggauggugagcgguuggcugacagaaaaauugcagaacuauuuuccacaaagacccacaucggguga

SEQ ID NO: 10426 - RNA, 5052 nt, Artificial Sequence
  derived and/or modified CDS sequence (opt3) from CCHFV(46-ST-2012)__KR814860.1__GP
augcacacccugcucgugugcuucauccuuuaccugcaguuguuaggccugggaggagcccauggucaaagcaacgcuacagagcacaauggcacuaacacgaccacaguccccuccacuucucagucaccuaagccacugguuaguaccacaccgccccaugcacucgaaagcuccaccauuaaaccuacuacaccaaccucugagacggaagggucgggagagacugcgccccugccuaauaccacacagggcccacccccuccagaaacuaccccggagagacccgccacaaccgugacgucaacuccuagcacagacaacaccaguuccacuauacacguaacagauaauaacccaaccucuacgaucagcaccucccccucaaguagcccuucuacaccauccacuccccaggguauucaucacccggcuaggucacuucugagcgugaguucuccuaagaccgccacaacucccaccccaacauccccuggggagaucaauagcgaaaccucgucuuugcacuccgcaaugucacggacucccacgcuccauacagccacccaagucaguacugagaacgcuaaucacagcgcaccacgccaguccgaaucuagcgcccagcccaccacaaccucacugaugacaaguccugcucaguccauucugcucaugagcgccgcgccaacagcaauccaaaacauacauccgucucccacgaaucgaucaaaacguaacuuagagauggagaucauucugacccuuagucagggauugaagaaauauuacggcaagauccugaagcuacuccaccugacucuugaagaggacacagaaggccuguuggagugguguaaaagaaaucucgggagcaacugcgaugacgacuuuuuccagaagaggauugaagaguuuuucaugaccggagaggguuauuuuaaugaagugcugcaguucaaaacauuauccacucugucuccuaccgagccaucgcacgcccggcuccccacgguugaaccuuuuaagagcuacuucgcuaaaggcuuucuuuccguggauucaggguauuucagugccaaguguuacccacgcucuagcaccuccggacugcaauugaucaacgucacacagcaucccgcaagaauagcugagacuccgggcccuaagaccacaucacuaaaaacuauuaacugcaucaaucugagggccagcguguuuaaggaacaccgggagauugagaucaacguacuccugccacagaucgcgguuaaucuuucuaacugucauguggucauuaauucccacgugugcgauuauagucuggacaccgauggucccgugcgcuugccucauauauaccacgaagggacguucauccccggaacauacaaaauugucaucgacaagaaaaacaagcucaaugaucgauguacccugguuacuaacugcgugauaaaaggcagagagguaaggaagggccaaagcguguuacggcaguauaagacagaaauuaaaaucgggaaggccucuaccggaucccguaaacugcuaucagaggaaccaggugacgauuguaucagucgcacucagcuccugagaaccgagacagcagagauucacgacgacaauuacggcgggccuggagauaagaucacgauuugcaacggcagcaccauagucgaccagaggcuugguucggaauugggguguuauacuaucaaucgggugaaauccuuuaagcugugcgagaacucugcuacaggcaagaccugcgaaauugauagcacacccguuaaaugucgacaaggauucugccucaagaucacucaggagggccgcgggcaugugaaacugucaagaggaagugaggucgugcuugacgccugugauuccucuugcgaaguaaugaucccaaaggguaccggcgacauucugguugauuguagcgggggacagcagcacuucuugaaagacaaucucauagaucugggcugcccgcauaucccuuuacuggguaagauggcuauuuacaucuguaggauguccaaccacccccggacgacaauggccuuucuauucugguuuucauucggguaugugauuaccugcaucuuuuguaaggcacucuucuacagccugauaaucauuggcacucuugggaaaaagaucaaacaauaucgcgaguugaagccacagaccugcacaauuugugaaacugcccccgucaaugcuaucgacgcggagaugcacgaucugaacugcaguuacaacauaugcccuuacugugcaucuagacucaccuccgacggccuggccaggcaugugccacagugccccaaacguaaggaaaaggucgaggagacagaauuauaucugaaucuugagcggauuccuuggaucgugcgaaaauugcuccagguuagcgaaucgacggggguggcucugaagagaucaucuuggcuaauuguacugcucguccugcuuaccgugaguuuguccccgguucaaagcgccccagugggacacgguaaaacuaucgagacauaccagaccagggaaggcuuuacuucuauaugucuguucauguuagggagcauccucuuucuggucuccugccuugugaagggacugguagacucagugagugauagcuucuuucccggcuugucuguuuguaaaacaugcuccauugguucaaucaacggguucgagauugagagucauaaguguuauugcagccucuuuuguugcccuuacugucgccacugcuccgcagaccgggaaauccaucagcugcaccuaucuauaugcaaaaagagaaagaccggcucgaaugucaugcuggccguguguaaaaggaugugcuuccgcgcuacgauugaggccagccgacgggcacuccugauccguucaaucauuaacgcgacuuucgugaucuguauucuuaccuugacaauaugcgucguuuccaccagugcuguggaaauggagucucugccagccggaacuugggaaagagaggaggauuuaacaaauuuuugucaccaggaaugccaagugaccgagacagaaugucucugccccuaugaggcacugguacuuaggaagccucuguuccuagacagcaucgucaaaggcaugaagaaccuccuaaauuccacuucauuggagaccucucugagcauugaagccccguggggagcuaucaacgugcagaguacguuuaaacccacaguuuccaccgccaauauugcauuaagcuggucuucaguggagcaucgcgggaacaagauccucgucacuggccgguccgaaaguauaaugaagcuggaggaaagaaccggugugagcugggaucuugggguugaggacgcuucggagucuaaacuguugacaguguccaucauggaucucagccagauguacucaccaguauucgaauaucugaguggagacaggcaagucgaggaauggccuaaggccacuuguaccggcgauugccccgagcgaugugguugcacgucuuccacaugccuacacaaagaauggccacauagccgcaauuggcgguguaacccuaccuggugcuggggcguggggacuggauguacaugcuguggcguggacgucaaggaucuguuuaccgaccacauguucguuaaauggaagguggaguacauuaagacugaggcgaucguaugcguggaacuuacaucacaggagagacaguguagucucauugaagccgggaccagguuuaaucugggacccgucacgaucacuuugagcgagccacguaacauacagcaaaaacugccgccugaaauuaucaccuuacaucccaagguggaggagggcuucuuugaucucaugcacguucagaaagugcuguccgcuucuacagucugcaagcugcagagcuguacccacgguaucccaggggaccuucagguguaccauauuggaaauuugcucaaaggcgaccgcauaaacggucaccugauccauaagauugaaccccacuucaacacauccuggaugucaugggauggcugcgaccuagauuauuacuguaauaugggggacuggccuucuugcacuuauaccggaguuacgcaacacaaccaugcagccuuugugaaucugcuuaacaucgagacagauuacacuaagaccuuccacuuucauaguaaacgggucacagcucacggcgacaccccacagcucgaucugaaggccagacccacuuauggggcaggagaaauuaccguauugguggagguugcggacauggaguuacauacuaaaaagguggaaaucucgggccugaaauucgccagccucgcuugcacggguuguuacgccugcuccucugggauaucauguaaggucaggauccacguggaugagccugacgaacugacuguacacgugaaaagcuccgauccggacgucguugcagcuaguaccucucuuauggcccgaaagcuggaguucggaacagauagcaccuuuaaggcauucucagccaugccaaaaacuuccuugugcuuuuauauuguggaacgggaguacuguaagaguugcagcgaggaagacacacagaaauguguggacacccgccuagagcagccccaaucuauccugauugaacauaagggcacgaucauagguaaacagaaugauacuugcacagcuaaggcguccuguuggcucgagucagucaagagcuucuuuuacggccugaaaaacaugcuugggucgguguucggaaacuuuuucauuggcaucuuacuguuucucgccccuuucguuuugcugguacucuuuuucauguucggguggaagauccuguuuugcuucaaauguugcagaaggacccggggacuucugaaguaucgacacuugaaagacgaugaagagaccggcuacagacgcauuaucgagaggcuaaauaauaagaaggguaaaaaccgucugcucgacggggaacgguuagcagauagaaagauagcugagcuguuuucuacuaaaacacauauuggauga

SEQ ID NO: 10427 - RNA, 5052 nt, Artificial Sequence
  derived and/or modified CDS sequence (opt3) from CCHFV(ROS/HUVLV-100)__DQ206448.1__GP
augcacacccugcucgugugcuucauccuuuaccugcaguuguuaggccuagggggagcccauagacaaagcaacgcuacagagcacaaugguacuaacacgaccacagcacccuccacuucucagucaccuaagccacuggucaguaccgccccgccccaugcgcucgaaagcuccacaauuaaaccuaccacuccaguuucugagacagaaggcucgggggagaccacgcccccuccaaauacuacccagggacccucaccuccagaagcuacaccggagaggcccacuaccacagccaccagcacgccuaguacugacaacacaaauuccaccacucacgugacagauaacaauccaaccucuacgauaagcaccucccccucaaguagcccuucuacaccauccacuccccagggcauccaucacccggcacggaaccugcuuucaguaagcaguccuaagaccgccacaacucccaccccaacaucuccuggugagauuuccagcgaaaccucgucucugcacuccgcuaugucacgcacuuccacguuguauacagcaacccaagugagcacugagaaugccaaccauuccgcuccccgacagucugaaagcucagcccagcagaccacaaccaguccaaugacuucccccgcgcaaagcauccucgucaugucugcagccccuacagcuauucagaauauccacccaucaccgacgaaccguaguaaaagaaaucuggagauggagauaauccugacccucagccagggguuaaagaaauacuauggaaagauucugaaacuuuugcaucugacucuagaagaggacacagaaggccuccuggagugguguaaaaggaaccuuggcuccaauugcgaugacgacuuuuuccagaagcggaucgaagaguuuuucaugaccggggagggauacuuuaacgaagugcugcaauucaaaacauugucuacucucucgcccaccgagccuagccacgcccgcccacccacgguugaaccuuuuaaguccuauuucgcaaaagguuuucugucaauugauaguggcuacuucucugcuaaguguuauccaagauuaagcaccuccgggcugcagcucaucaacgugacacagcaccccgccaggauagcggagacuccgggaccuaagaccacaucacuuaaaacuauuaauugcaucaaccugcgggccagcgucuuuaaggaacaucgcgagauugagaucaauguguugcuaccacaaaucgcaguaaaccugucuaauugucacguugugauuaacucccaugucugcgauuacagucucgacaccgauggccccgugcgacugccucacauauaccaugaagguacguucauccccgggacauauaaaauugugaucgacaagaaaaauaaacuuaacgauagauguacccuggucacuaauugcguuauaaagggaagggaggugcggaagggccagagcguauugcgucaguacaagacagaaauuaaaaucggcaaggcuucuaccgggucccgcaaacuccugucagaggaaccaggagacgauuguaucaguagaacucaguuacugaggaccgagacagccgagauucacgacgacaacuaugguggcccuggggauaagaucacgauuugcaauggaagcaccauaguggaccaacggcuaggcucggaacucgguuguuacacuaucaaccgagucaaauccuuuaagcugugcgaaaauucugcuacagggaagaccugcgagauugauagcacacccgugaaaugucgccagggcuucugccuuaagaucacucaggagggaagaggccacguuaaauugucaagggggagugaggugguccuggacgccugugauuccucuugcgaagugaugaucccaaagggaaccggugacauucucguagauuguagcggcgggcagcaacauuuccugaaagacaaccuuauagaucugggaugcccgcacaucccuuugcucggcaagauggcaauuuauaucugucggauguccaaucauccccgcacgacaauggccuuucuguucugguuuucauucgguuacguuauuaccugcaucuuuuguaaggcuuuauucuauagccugauaaucauugggacucuaggcaaaaagaucaaacaguacagagagcucaagccacagaccugcacaauuugugaaacugcgcccgugaacgcaaucgacgccgagaugcacgaucugaacugcaguuacaauauaugcccuuauugugcuucuaggcuuaccuccgacggauuggcccgucacgucccacagugccccaaacggaaggaaaagguggaggagacagaacuguaccucaaccuggagcgaaucccuuggauugucagaaaauuacugcaagugagcgaaucgacgggcguugcacuuaagaggucaucuugguugauugugcuccugguacuacugaccgucagucucuccccggugcagagcgccccaguugggcauggaaaaacuaucgagacauaucagacccgcgaagguuuuacuucuauaugucuguucaugcuuggcagcaucuuguuucugguguccugcuuagucaaggggcucguggacucaguaagugauagcuucuuucccggacugucuguguguaaaacaugcuccauuggcucaaucaaugguuucgagauugagagucacaaguguuacugcagccuguuuuguugcccuuauugucggcauugcuccgcugacagagaaauccaccagcugcauuugucuauaugcaaaaagaggaagaccgggucgaacguuaugcucgccgucuguaaacgcaugugcuuccgagcaacgauugaggcgagccggcgugcucugcuaaucagaucaaucauuaauacuaccuucgugaucuguauucugacacucaccauaugcguggucuccacaagugccguugaaauggagaaccugccaucuggcacuugggaaagggaggaggaucuuaccaauuuuugucaccaagaaugccaggugacagagacugaauguuugugccccuacgaggcacugguguuacgcaagccucucuuccuggacagcaucguaaaaggaaugaagaaccuucuuaauuccaccucacuagagacgucucucagcauugaagccccguggggcgcuaucaacguccagaguacauuuaaacccaccguguccacugccaauauugcacugagcuggucuucaguugagcaccgggggaacaagaucuuggugaccggaagauccgaaaguauaaugaagcuggaggaaaggacaggcgucagcugggauuuagguguggaggacgcuucggagucuaaacuccugacuguuuccaucauggaucuuagccaaauguauucaccaguguucgaauaccugaguggggaccgacagguagaggaauggccuaaggccaccuguacgggagauugccccgagcgcuguggcugcacaucuaguaccugcuugcauaaagaauggccacacagccggaauuggagauguaacccuacuuggugcuggggugucggcacaggguguaccugcuguggaguggacgugaaggaucucuuuacugaccauauguucgucaaauggaagguugaguacauuaagacagaggcgaucgugugcguagaacugaccucacaggagaggcaguguagucuaauugaagccggcacgcguuuuaaucuggggcccgugacuaucacccuuagcgagccacgcaacauacaacagaaacucccgccugaaauuaucacacugcaccccaaggucgaggagggauucuuugauuugaugcaugugcagaaaguucuguccgcuucuaccgugugcaaguuacagagcuguacacacggcaucccaggugaccuccaagucuaucacauugggaaccugcuuaaaggagaccgggugaauggccaucugauacacaagaucgaaccccauuucaacacuuccuggaugucaugggaugguugcgacuuggauuacuauuguaauaugggcgacuggccuucuugcaccuacacggggguuacacagcacaaccacgcagccuuugugaaucuccugaacauugagacugauuauaccaagacauuccauuuucacaguaaaagagucaccgcucauggagacacuccacagcuagaucugaaggccaggcccaccuacggcgcaggggaaaucacaguacuuguggagguugcggacauggagcuccacacgaaaaagguggaaauuucgggacugaaauucgccagcuuggcuugcacuggcuguuaugccugcuccucugguaucucauguaagguccgaauacauguggaugagccugacgaauuaaccguacacgugaaaagcuccgauccggacgucguugcagcuaguacaucucugauggcccggaagcucgaguucgggaccgauagcacuuuuaaggcauucucagccaugccaaaaacaucccugugcuuuuacaucguggaacgcgaguacuguaagaguugcagcgaggaagacacccagaaauguguggacacgaaacuugagcaaccccagucuauucugaucgaacacaagggaacuauuaucggcaagcagaaugauacaugcaccgcuaaggcguccuguugguuggagucagucaagagcuucuuuuauggucuaaagaacaugcugggcucgguguucgggaacuuuuucauaggcauucuccuguuucuugccccuuucguuuuacugguacucuuuuucauguucggauggaaaaucuuguuuugcuucaaguguugcagaaggacccgggggcugcucaaauaccgacugcuuaaggacgaugaagagacuggauauagacgcaucauugagaggcugaauaauaagaaaggcaagaaccguuugcuagacggugaacggcuggcagauagaaaaaucgcugagcucuuuucuacaaagacccauauaggguga

SEQ ID NO: 10428 - RNA, 5052 nt, Artificial Sequence
  derived and/or modified CDS sequence (opt3) from CCHFV(Saf)__KX013487.1__GP
augcacacccugcucgugugcuucauccuuuaccugcaguuguuaggccuagggggagcccauggucaaagcaacgcuacagagcacaauggcacuaacacgaccacagcacccuccacuucucagucaccuaagccacuggucaguaccgccccgccccaugcgcucgaaagcuccacaauuaaaccuaccacuccagcuucugagacagaagggucgggagagaccacgcccccuccaaauacuacccagggccccucaccuccagaaacaacuccggagagacccgccaccacagcaaccagcacgccuaguacugacaacacaaauuccaccacucacguuacagauaacaauccaaccucuacgauaagcaccucccccucaaguagcccuucuacaccauccacuccccaggguauccaucacccggccaggaaccugcuuucagugagcaguccuaagaccgcuacaacucccaccccaacaucuccuggggagauuuccagcgaaaccucgucucugcacuccgcaaugucacggaccaguacguuguauacagccacccaaguaagcacugagaaugcuaaccauuccgcgccccgccagucugaaagcucagcccagccaaccacaaccagucccaugacuuccccugcacagagcauccucgugaugucugccgcuccaacagccauucaaaauauccacccgucacccacgaaccgaaguaaacguaaucuggagauggagauaauccugacccucagccagggauuaaagaaauacuauggcaagauucugaagcuguugcaucugacucuagaagaggacacagaaggccuccuggagugguguaaaagaaaccuuggguccaauugcgaugacgacuuuuuccagaagaggaucgaagaguuuuucaugaccggagaggguuacuuuaacgaaguccugcaguucaaaacauugucuacucucucgccuaccgagccaagccacgcacggcccccuacgguggaaccauuuaaguccuauuucgcuaaaggcuuucugucaauugauaguggguacuucucugccaaguguuauccccgcagcuccaccucaggauuacaacugaucaacguuacacagcacccggcgagaauagccgagacuccuggcccaaagaccacaagccucaaaacuauuaauugcaucaaccuuagggcaucuguguuuaaggaacaucgggagauugagaucaauguccuguugccccagaucgcugugaaccuauccaauugucacguaguuauuaacagucaugugugcgauuacagccuggacaccgaugguccuguccgccucccccacauacaucacgaagggacguucaucccaggaacauacaaaauugugaucgacaaggagaauaaacugaacgaucgauguacccuugugacuaauugcgucauaaagggcagagaaguuaggaaaggccaaucugugcugcggcaguauaagacagagauuaagaucgggaaagccuccaccggaucacguaaguugcucagugaggaaccuggugacgauuguaucagccgcacucagcuguuaagaaccgagacagcugaaauucacgacgacaacuacggcgggcccggagauaaaaucacgauuugcaauggcucgaccauaguagaccagaggcuggguuccgagcuaggguguuauacuaucaaccgggugaagucuuuuaaacucugcgaaaauagcgccacaggcaagaccugcgagauugauucaacaccagucaagugucgacaaggauucugccugaaaaucacucaggagggccgcgggcaugugaaacuuaguagaggauccgaaguuguguuggacgcaugugauucuagcugcgaggucaugaucccgaaggguaccggcgacauucugguggauuguuccgggggacagcagcacuaccucaaggacaaccugauagaucuuggcugcccucauaucccccuguuggguaaaauggccauuuauaucuguaggaugucaaaucacccacggacgacaauggcuuuccucuuuugguucagcuuuggguacguaauuaccugcaucuucuguaaggcgcuguuuuauaguuuaauaaucauuggcacucugggaaagaaaaucaagcaauaccgcgaacuaaaaccccagaccugcacaauuugugagacugcaccuguuaacgccaucgacgcugaaaugcacgaucucaacugcucuuacaauauaugcccauauugugccuccagacugaccagcgacggccuugcaaggcaugugccccagugcccuaagcguaaagagaaggucgaggaaacagaguuguaccugaaccucgaacggauuccguggaucgugcgaaagcuguuacaggucucggagucaacggggguggcccugaaaagaucuaguuggcuuauuguuuugcucgugcugcuaaccguaucccugagcccaguccaaucugcucccgugggacacgguaagacuaucgaaacauaucagaccagggagggcuucacuagcauaugucucuuuaugcugggguccauccuuuucuugguuucaugccuggugaaaggauuagucgacagugugagcgauuccuuuuucccuggccucucuguauguaagacaugcucaauugguaguaucaauggguuugagauugaaagccauaaauguuacugcucccuguucuguugcccauauugucgccacugcucugccgaccgggagauccaucagcuucaccugucgauaugcaagaaaagaaagaccggcagcaacgugauguuggcaguuuguaagaggaugugcuuucgcgcgacgauugaggcuucacgacgggcccuccugauccguuccaucauuaauacuaccuucgucaucuguauucuaacacugaccauaugcguggugaguacuucugcagucgaaauggaaaaccuccccagcggaacaugggagagagaggaagaucugaccaauuucugucaccaggagugccaaguuacagaaacugagugucuuugcccuuacgaggccuuggugcugaggaaaccguuauuuuccgacucaaucgugaagggcaugaaaaaccuccuuaauucuaccagccuugaaacgagucuguccauugaggcucccuggggagccaucaacguacagagcacauucaagccaaccgucucuacugcaaauauugcucuaucaugguccaguguggaacaucgcgggaacaaaauccucguuaccggccggagcgagucgauaaugaagcuggaagagagaacaggugugucuugggauuugggggucgaggacgccuccgaaagcaagcuguuaacugugucaaucauggaucucagucagauguauucuccuguuuuugaguaccuguccggagacaggcaaguggaagaguggcccaaagcgaccuguacgggcgauugcccagaacgaugugguugcacaagcucaaccugccuucacaaggaguggccucauagucgcaauuggcgguguaaccccacuuggugcuggggcguagggacaggauguaccugcuguggcgucgacgugaaagaucuguucacugaccacauguuugugaaguggaaagucgaguacauuaagacagaagccaucguuugcguggaguugaccagccaggaaagacaguguucccucauugaggcugggacgagguucaaucugggaccaguaacuaucacccuaucugaaccgcguaacauacagcaaaagcugccucccgagauuaucacacuucauccaaaaguggaggaaggcuuuuucgaucucaugcacguccagaaggugcugagcgcauccaccguuugcaaauugcagucauguacacacgguauccccggggacuuacagguguaucauauuggaaaccugcucaagggcgaccgcgucaauggucaccugauacauaaaaucgagccucacuuuaacacuucuuggaugaguugggauggcugcgaccuugauuacuauuguaauaugggggacuggccaucgugcaccuacacgggagugacacaacacaaccaugccgcuuucguuaaucuguugaacauugaaacugauuauaugaagaccuuucacuuccauagcaagcgggugacagcccacggcgacacuccccagcucgaucugaaagcaagaccuacuuacggggcgggagagaucaccguccuaguagagguggccgacauggaacugcauacaaagaaaguugagauuuccggccuuaaguuugugucucucgcuugcacggguuguuaugccugcucaagcgggaucuccuguaaagucaggauacacguggaugaaccggacgagcugacuguacacgugaagaguucugauccagacgucguugcagcuagcaccucauugauggcccgaaaauuagaguucggaacagauuccaccuucaaggcauuuagugccaugcccaagacuagccugugcuucuacaucguggaacgggaguacuguaaaucuugcuccgaagaggacacacagaaguguguggacaccaaacucgaacagccucaaucaauucugaucgagcauaagggcacgauuaucgguaaacagaaugauacuugcacagcuaaggcgagcuguuggcuugaaucggucaagucuuucuuuuauggccugaaaaacauguuggggaguguguuuggaaauuucuuuauaggcauucuacuguuccucgcccccuuuguucugcuuguauuauucuuuauguucggguggaagauccuguucugcuuuaaauguugccgcagaaccaggggacucuugaaguaccggcaccugaaagacgaugaggagaccggcuaucgaagaaucauugaacgccucaacaauaagaaggguaaaaacaggcugcuugacggggagcgucuggcagaucggaagaucgcugaauuguucuccacuaaaacacauauaggauga

SEQ ID NO: 10429 - RNA, 5052 nt, Artificial Sequence
  derived and/or modified CDS sequence (opt3) from CCHFV(52-R-2014)__KR814862.1__GP
augcacacccugcucgugugcuucauccuuuaccugcaguuguuaggccuggguggagcccauagacaaagcaacgcuacagagcacaaugguacuaacacgaccacagcacccuccacuucucagucaccuaagccaccggucaguaccgcgcccccucaugccccagaaagcuccacaauuaaacccaccacuccugcuucugagacagaaggcucgggggagaccacgccacccccuaauacuacccagggaccaucaccgcccgaagccacaccugagaggccagcaacuaccgccacaagcacccccaguacggacaacacuaauuccacaacccacgcuacugauaacaauccuacaucuaccauaagcacguccccaucaaguagccccucuaccccguccacaccucagggcauccaucaccccgcacggaaccuacucucaguuagcaguccaaagacugccaccacaccuacucccaccucuccaggugacauuuccagcgagacaucgucucugcacuccgcuaugucacgcacccccacucuucauacggccacacaagcgaguaccgaaaaugcaaaccacagcgccccucgacaguccgagucuagcgcucagcagacuaccacaucaccaaugaccaguccggcccaacccauccuggugauguccgcagcuccuacugccauucagaauauccauccaagccccacaaaccguucuaaaagaaauuuggaaauggagauaauccucacgcugucacaggggcugaagaaauauuacggaaagauucucaaguuacugcaccuuaccuuggaggaagauacugagggccugcuagaaugguguaaaaggaaccucggcaguaauugcgacgaugacuuuuuccagaagcggaucgaggaauuuuucaugacaggggagggauauuuuaacgagguacugcaauucaaaacccuuagcacacuguccccuacugaaccaucucacgcgcgacccccgaccguggagccuuuuaagucguacuucgccaaaggguuuuugagcauugauuccggcuauuucucagcaaaguguuacccaagacucaguacgucugggcugcaguuaaucaacgucacccagcaucccgcuaggauagccgaaacaccuggacccaagacuaccagccugaaaacaauuaauugcaucaaccuccgggcuuccguguuuaaggagcaccgcgaaauugagaucaauguucuucugccacaaaucgccgugaacuugucaaauugucaugucgugauuaacagccacguaugcgacuauucucuagauacugacggcccuguucgacugccccauauauaccacgaggguaccuucaucccagggacguacaaaauugugaucgauaagaaaaauaagcucaacgacagauguacacuggucaccaauugcgugauaaaaggaagggaagugcggaagggccaguccguccuucgucaguauaagacugagauuaaaaucggcaaggcaaguacagggagccgcaaacuguugucugaggaaccgggagaugacuguaucuccagaacccagcuccugaggacugaaaccgccgagauucacgacgauaacuacgguggcccuggggacaagaucacaauuugcaauggaucaacgauaguugaucaacgguuaggcagugagcuggguuguuauaccaucaaccgagugaaaaguuuuaagcuaugcgaaaauucggcuacugggaagacaugcgagauugacuccacccccguaaaaugucgccagggcuucugccucaagaucacacaggaaggaagaggccaugugaaacugucuagggggagcgaggucgugcuugaugcgugugacacuucaugcgagguuaugaucccaaagggaaccggugauauuuugguggacuguaguggcgggcagcaacacuuccugaaagauaaccucauagaccugggaugcccccaugucccucuucugggcaagauggcaaucuacauuugucggauguccaaucacccacgcacgacaauggccuuuuuguucugguuuucuuucgguuaugugauuaccugcaucuuuuguaaggcucucuucuacagccugaucauaaucgggacuuuaggcaaaaagauuaaacaguauagagaacugaagccccagaccugcacaaucugugagacugccccuguaaacgcaauugaugccgaaaugcacgaccuaaacugcuccuacaauaucugcccguacugugcuucaaggcucaccagcgacggacuggcccgucauguuccacagugccccaaacggaaggagaagguggaagagacagagcuuuauuugaaccuggaacgaauaccuuggauugucagaaaacuccugcaagugagugagucuacgggcgucgcauuaaagagguccagcuggcugaucgugcuuuugguucuccugaccgugucgcuaucaccaguacagucugcgcccgucgggcacggaaaaacuauugaaacauaccagacccgcgaggguuuuacuagcgugugucuguucaugcucggcuccauccuguuucuuguuagcugcuuggugaaggggcuggucgauucugugagcgacuccuucuuuccuggauuaucaguauguaaaacaugcaguauaggcagcaucaaugguuucgaaauugagucucauaaguguuauugcucccucuuuuguugcccguacugucggcacugcucagcugauagagagauccaucagcugcaccuuaguauuugcaaaaagaggaagauggggagcaacgugaugcuggccguuuguaaacgcaugugcuuccgagcaaccaucgaagccucccggcgugcuuugcucauaagaucuauuaucaauacgacuuucgucaucuguauucugacccuaacaaucugcguggugucgaccagcgccgucgagauggaaaaccugcccucaggcacuugggagagggaagaggaccucacaaauuuuugucaccaagagugccagguuaccgaaacagagugucugugcccauaugaagcacuuguguugcgcaagccucuguucuuagauuccauugugaaaggaaugaagaaccuccugaauaguacuucucuugagaccagccuguccauagaggcucccuggggcgccaucaacguacagucaacguuuaaaccaacagucucuaccgcgaauauugcccuaagcuggaguuccguggaacaucgggggaacaagauccucguuacuggaagaagcgagucuauuaugaagcuggaagagaggaccggcgugucaugggacuugggugucgaugacgcuuccgaaaguaaacuguuaacagugagcaucauggaucucucgcaaauguacucuccuguuuucgaguaucuguccggggaccgacagguggaggaauggcccaaggcaacuuguaccggagauugcccagagcgcuguggcugcacgagcucaacaugccuucacaaagaauggccgcauagucggaauuggagauguaacccuaccuggugcugggguguaggcacuggguguacaugcuguggagucgacgugaaggaucuguuuaccgaccacauguucgugaaauggaaggucgaguacauaaagacugaagccaucguuugcguggaguugacaucucaggagaggcaguguucccucauugaagcuggcacccguuuuaaucuggggcccguaacgaucacucuaagcgagccacgcaacauucaacagaaacugcccccugaaaucauaacccuucauccaaagguggaggaaggauucuuugaccucaugcacguccagaaagugcugucagccaguacaguuugcaaguugcagagcuguacccacggcauucccggugaucugcaaguguaccauaucgggaacuuacucaaaggagaccgggucaauggccaccugauccauaagauugagccucacuucaacacauccuggaugucuugggaugguugcgaccuugauuauuacuguaauaugggcgacuggccgagcugcacuuauaccggggugacgcagcacaaccaugcagcguuuguuaaucuguugaacauagagacagauuacacuaagaccuuccacuuucauuccaaaagagugacagcccacggagacaccccacagcucgaucugaaggcuaggcccacuuauggcgccggggaaaucaccguccuaguagagguggcagacauggaacugcauacuaaaaagguugagauuucaggacuuaaauucgcuucucucgccugcacgggcuguuacgcaugcaguucggguaucagcuguaaggugcgcauucacgucgaugagccugacgaacugacugugcacguaaaauccaaugaucccgacguggucgccgcuucuaccucauugauggcgcggaaguuagaguucgggacagacagcaccuuuaaggccuucuccgcaaugccaaaaacaagucugugcuuuuauaucguugaacgcgaguacuguaagucuugcagcgaagaggauacacagaaauguguggacaccaagcucgagcaaccucagucaauacugaucgaacauaaaggaacgauuaucggcaagcagaacgauacuugcacagcuaaggccgguuguuggcuugaguccgugaaaaguuucuuuuacggccugaagaauauguuggggagcgucuucggaaacuuuuucauuggcauccuacuguuucucgcccccuucgugcugcuuguuuuauuuuucauguucggguggaaaauacuguuuugcuucaaguguugcagaaggacccggggacucuugaaauaucgacugcucaaggacgaugaagagaccggcuacagacgcauuaucgaaaggcugaauaacaagaaagguaagaaucgucuucuggacggggagcgguuggcugauagaaaaaucgcagagcuauuuucuacuaagacacacauuggauga

SEQ ID NO: 10430 - RNA, 5052 nt, Artificial Sequence
  derived and/or modified CDS sequence (opt3) from CCHFV(Turkey-Kelkit06)__GQ337054.1__GP
augcacacccccuuggugugcuucauccucuaccuucagcuguuguguuuaggcggggcccauggacaacugaacgcuacagagcacaaugguacuaacaauacgaccgcaccuggcgccagccaguccccaaagccgcccaugucuacaacuccuccacaugcgcccgaaucaaguaccauuaaaccuacaaccccaauaagcgaggcugaaggguccggagagacuacaucucccccuaacaccacgcagggccuaucgucaccagaaacuaccagcgagagaccggccacaacuagcaucuccaccucuagcacagacuccaccaaucccacgacucagaugacagauaacaccccuacuccaacagucucaaccagucccaguucuuccccuucaacgccaagcacaccccaagguauucaccauccggcaaggagucuccugucuguuuccagcccuaagacagugacuacccccacaccaacuucgccuggggagaugucuuccgaaaccucaagucagcacagcgccaugucccggauccccacaccacacaccgcuacucgcguaucuacggagauuacaaaucaucgaacuccccgucagagcgaaucaagugcacagcaaaccaccccuuccccaaugacaagcccggcccagucuauccuucugaugucagcugcccccaccgcggugcaggacauacacccuaguccaacuaacagaagcaaaaggaauuuggagacagagaucauucucacgcugucccagggacugaagaaauauuacggcaagauccucaaguuacugcaucuuaccuuggaacaagauacugagggccugcuagaauggugcaaagggaaccucggaucuaauugugacgaugacuuuuuccagaagcggauugaggaauuuuucaugacaggugagugcuauuuuaacgagguccugcaguucaaaacccuuucgacacugagccccacugaaccuucccacgcacgcuugccaaccgccgagcccuuuaagucauacuucgcuaaaggcuuucucaguaucgauucuggguauuucagcgccaaguguuacccgagauccucagcaagcggacugcaauuaauaaaugugacgcagcacccugcuaggauugccgaaaccccaggccccaagacaacuucucugaaaaccaucaacugcauuaaucuccgggcguccguuuuuaaggagcaucgcgaaguggagaucaacguccuucugccucagaucgccgugaacuugaguaauugucacguaguuauuaacagccaugugugcgacuauucucuagauacagacggucccguccgacugccaagaauauaccacgaggggacuuucaucccuggaaccuacaaaauugugaucgauaagaaaaauaagcucaacgacagguguacgcuggugacaaauugcgucauaaaaggccgggaaguucguaagggccaguccgugcuucgccaauauaagaccgagauuaaaaucgggaaggcaucaacuggauuuagaaaacuguugagugaggaacccggugaugacuguaucagcaggacacagcuccugcggaccgaaacugcugagauucaugacgauaacuacggcgggccaggagacaagaucaccauuugcaauggcucgacaauaguagaucagcgauuagguuccgagcuggggugcuauacgaucaaccgcgugaaaucuuucaagcuauguaagaauagcgccaccggcaaaacuugcgaagucgacucaacaccggugaaguguagacagggauucugccucaaaauuacccaagagggcagggggcacguuaagcugagucggggauccgaagugguccuugaugcuugugacucuagcugcgaggugaugaucccuaaagguacaggcgauaucuugguagacuguuccgggggacagcagcacuuucugaaggauaaccucauugaccugggcugcccccauauaccacuucugggucgcauggccaucuacauuuguagaaugucaaaucaccccaggacuaccauggcauucuuguuuugguucagcuuuggguauguuaucacgugcauuuucuguaaggcccucuuuuacagucugaucauaaucggcacauuagggaaaaagauuaaacaguaucgugagcugaagccucaaaccugcacuaucugcgaaaccgcuccagugaacgcgauugaugcagagaugcaugaccuaaauuguucuuacaacaucugccccuacugugccucccggcucacaagcgacggccuggcucgacacgucacucagugcccuaaaagaaaggaaaagguggaggaaaccgagcuuuauuugaaucuggagaggauaccguggauuguccgcaaacucuuacaggugucggaaucaacagggguugcccugaagcggucuaguuggcugaucgugcuuuugguacuccugacggucucccuaagcccagugcagucugcacccguuggacacgguaaaaccauugagaucuaccaaacuagagaaggcuucgccagcauaugucuguuuaugcucggguccauccuguucauugugucaugccuugucaagggauugguggauaguguaagcgagucuuucuuuccuggccuguccguguguaaaacaugcucaaucgguaguguuaacggguuugaaauugagagccauaaguguuauugcuccuuauucuguugcccauacugcaggcacuguucugcugaccgcgagauccaucagcuccaccugucgauaugcaaaaagcgaaagaccggcagcaacgucaugcuugccguguguaaacggaugugcuuccgugcaacuauugaagcgucaagaagggcucuguugauccgcuccaucauuaauacaaccuuugugaucuguauucucacgcugacuauaugcgucguuaguaccucugccguggagauggaaaaccuacccgcaggaacaugggagcgggaagaggaucugaccaauuucugucaucaggagugccaagugacugaaacagagugucucugcccuuaugaagcccugguacuuagaaagccguuguuucuggacagcaucgucaaaggcaugaagaacuuacucaauuccaccucacuggagacaucucuuagcauugaggcucccuggggagccaucaacgugcagaguacuuucaaaccaaccguuuccacggcaaauauugcucugagcuggucuucagugguccacaggggaaacaagauccuagugacaggccgauccgaaaguauaaugaagcucgaggaacgcaccgguguuagcugggaucuggggguggaggacgccucggaaucuaaauugcugacuguauccaucauggauuuaagccagauguacucaccugucuuugaguaucucaguggagacagacagguggaggaauggcccaaggcgaccuguacaggcgauugcccagagcggugcgguuguacuucuucuaccugccugcacaaagaauggagccauucaaggaauuggcguuguaacccuacguggugcuggggcguggggacaggauguaccugcuguggcgucgacguuaaggaucuuuucacugaccacauguuugugaaauggaagguagaguacauuaagacagaagccaucgugugcgucgcucugaccagucaagagcgccaguguagcuugauugaggcagggacucgguucaaucucggacccgugacaaucacccuguccgaaccaagaaacauacagcagaaacuaccgccugagauuaucacgcugcaucccaagaucgaagagggcuuuuucgaucuuaugcacguucaaaaagugcucucugccagcacugucugcaagcugcaguccuguacccaugguauuccaggggacuuacagguguaccacauaggaaaucugcugaaaggcgacaggguuaacggucaccucauccauaagauugaaucacacuuuaauacaucuuggaugaguugggauggcugcgaccuggauuauuacugcaacaugggggacuggcccucguguaccuauacaggagugacucagcauaaccacgcugccuucgucaaucuucugaacaucgagaccgauuacacgaagacauuucacuuccauagcaaacgaguaacugcacacggcgacaccccucaauuggaucucaaggcgcggccaacauauggggccggaggcauuaccgugcugguugagguggcugacauggaacuacauacuaaaaaggucgagaucuccggucugaaauucgccucucuugcaugcaccggguguuacgcuugcucaagcggaauauccuguaaggugcgcauccacguagaugaacccgacgagcucacagugcaugucaaaaguucugauccugacguuguggccgcaagcacgucacugauggccagaaaguuggaguuuggcacugauuccaccuucaaggcuuuuagugcgaugccgaaaaccagcuuaugcuucuauauuguggaaagggaguacuguaagucuugcuccgaagacgacacccagaaaugugucgauacucggcuggagcagccacaaucaauccucauugaacacaaggguacaaucauaggcaaacagaaugauaccugcacggccaaggcaagcuguuggcuggagucggugaaguccuuuuucuacgggcuuaaaaacaugcugggaaguguuuuuggcaauuuguucauugggauccuacuguuucucgcucccuucguacugcuuguguuauuuuucauguucggauggaagauccuguuuugcuucaaaugcugucgaagaacucgcggccucuuuaaguauaggcacuugaaagacgacgaggaaacagguuaccgucggauuaucgagagacugaacuccaagaaggggaaaaauaggcuccuggauggagaccgccuugccgaucgaaagauagccgaacuguucagcaccaaaacccauauuggcuga

SEQ ID NO: 10431 - RNA, 5052 nt, Artificial Sequence
  derived and/or modified CDS sequence (opt3) from CCHFV(V42/81)__GU477490.1__GP
augcacacccugcucgugugcuucauccuuuaccugcaguuguuaggccuugggggagcccauguccaacccaacgcuacagagcacaauagaacuaacacgaccacagcaccugguacuagccauucccuaaagccacucguuucuaccacaccgccccaggccccugaaucaaguaccauuaaaccaacuacacccaccagcgagacggaaggcuccggggaggcgacuccucugucuaauaccauacaggcuccaucgucacccgaaacaacuagcgagaggccugccaccgcagugaucaguacauccggaaccgacucuacgaacagcacuacacagaccacugauaauaacccaacaaccacgguaggcaccuccccgucaaguagccccucuacaccuuccacuccacaagguauucaccaucacgcccggucacuucugagcgugaccagucccgagacagucacuaccccuaagccaacaucuccccgcgaaauguccagcgagaccucgaaucagcacucugcuaugucccgaacuccgacgcaucacacagugacccagguuucaacugaaaacaccagucauagcacaccucgucagcccgaguccucugcacaaccaaccagcucaaguccuaugacuucccccgcccagagcacauugcucaugucugcugccccaacggcggugcagucaauccaccccaguccuaccaauagaagcaaaaggaaccuggagacugaaauuauccugacacucucccagggguuaaagaaauauuacggaaagauacugaaacuuuugcaccugacccuagaggaagacacagagggccuccuggaaugguguaagcggaaucuuggcucuaacugcgaugacgacuuuuuccaaaagcgcaucgaggaguuuuucaugacuggggaaggauauuuuaaugagguccugcaguucaaaaccccaucgacggugagcccgaccgaacccucccaugcaagauugccuacagccgagccauuuaagucauacuucgcuaaagguuuucucaguauugauucuggcuauuucagcgccaaguguuacuccaggucaagcacuucugggcugcaguuaaucaacguaacccaacaccccgcacggauugcugaaacaccuggaccaaagacuaccucccugaaaacgaucaauugcauaaaccuccgcgccaguguuuuuaaggagaaccgagagauugaaaucagcgugcuucugccccagauugcggucaauuugucuaacugucauguggugaucaauucccacgucugcgauuauucacuagacacagauggcccgguuagacugccuaggaucaaccaugaggguaccuucauuccagggacuuacaaaauagugaucgacaagaaaaauaagcucaacgaucgguguacacugguaaccaauugcgugauuaaaggacgugaaguccgcaagggccagagugugcuuagacaguacaagacugagaucaaaauaggcaaggccagcaccgggucgaggaaacuguuguccaaggaacccggagacgauuguauuucucggacacaacucaugcgaacggagaccgcagagauccacgacgacaacuaugguggcccuggggauaaaaucacuauuugcaauggaagcacaaucguugaccagcgccugggcucagaauuagguuguuacaccauuaacagagugaagaguuuuaagcugugcgaaaauuccgcuacagggaaagccugcgaggucgauucuacucccgugaaguguaggcagggcuucugccuaaaaauaacccaggagggacggggccacguaaagcucagccgcggguccgagguugugcuggacgcuugugauucaagcugcgaagucaugaucccaaaaggaacgggugacauucuuguggauuguaguggcgggcaacagcauuucuugaaggacaaccugaucgaucucgagugcccucacaucccccugcuuggaaagcuggccauuuauauauguagaaugucuaaucauccaaggacaaccauggcauuuuuguucugguuuggcuucgguuacgucaucacuugcauucucuguaaagcccuguuuuauuccuuaaucauuaucgggacccugggcaagaaaauaaagcaguaccgugaacuaaaaccgcagacaugcacuaucugugagaccgcuccugugaacgcgauugacgcagaaaugcacgaucucaauugcagcuauaacaucugccccuacugugccucgcggcugacaucagacggacuugcucgacacguuacgcaaugcccaaagagaaaggagaaaguggaggaaaccgaguuguaccugaaccucgaaaggauucccuggaucguacgcaagcuguuacaggucucugagaguacuggcgugguucugaaacgguccagcuggcuuauaguguugcucguccugcuaacagugucucugagcccuguacaguccgccccaguggggcauggaaagaccauugaaacuuaucagacaagagaggguuucaccucaaucugucucuuuaugcugggcaguauucuuuucaucguuagcugcauagucaaaggguugguggacucuguguccgauucauuuuuccccggacugagugucuguaagacgugcagcaucuccucuauuaauggcuuugagaucgaaucgcacaaauguuacugcagcuuauucuguugcccuuauuguaggcauugcucagcagaccgcgagauucaccaacuccaucuguccaucugccgaaagcggcguacugguaguaacguuaugcuugccguguguaagagaaugugcuuuagggcuaccauagaagugucucgccgggcccuguugauuagaagcaucaucaauacaaccuucguaauuuguauccucacucugacaauuugcgucguguccaccucagcaguugagauggaaaaccuaccggcggggacaugggagagggaggaagaucugacuaauuucugucaccaggagugccaggugaccgaaacggagugucucugcccauacgaggcucugguccuucgaaaacccuuguuucuggacucuauagugaagggcaaaaagaacuuacucaauagcacaagucuggaaaccucccuuagcaucgaggccccuuggggagcaauuaacauccaaucuacuuucaaaccaaccguuucagccgcuaauauugcccuguccuggaguagcguggaacaccgcggcaacaagauccuaguaucggggcggucugaguccauaaugaagcucgaagagagaacaggagucagcuggaaucugggcguggaggaugcaucagaaaguaaauugcugacugugucuaucauggacuuaucccagauguauagccccgucuuugaguaccucucaggugauaggcagguugaagaguggccuaaggcuaccuguacgggggacugcccggaacguuguggaugcacaaguagcacuugccugcauaaagaguggccccacucccgcaacuggcgguguaauccaaccuggugcuggggcguggguacaggcuguaccugcugugggguagaugugaaggaccuuuucauugaucauauguuugucaaauggaagguggaguauaucaagacugaagccauuguuugcguggagcugacaucucaggaaagacaauguagcuugaucgaggcgggaaccagguucaaccucggcccugucacgauaacucuguccgaaccccgaaauauucagcagaaacuaccaccugagaucaucacccugcaccccaagauugaggaaggguuuuucgaccuuaugcaugugcagaaaguucucucagccucuacagugugcaagcugcaaaguuguacccacggaauaccaggcgauuugcaggucuaccacaucgguaaccuguuaaaaggggaccggguaaacggacaucucauucacaagaucgagccgcauuuuaauacaucguggaugagcugggacggcugcgaucuggacuacuauuguaacaugggugauuggccuuccugcacuuacaccggcgugacgcagcacaaucacgcugcauucguuaaccuucugaauauugaaacagacuauacuaagaccuuucauuuccacucuaaacgcgugacagcccauggggagacuccccaguuggaucucaaggcuagaccagccuacggagcaggcgagaucaccguccugguggaaguagcggacauggagcuacacaccaaaaagguggaaauaucagggcugaaauuugccagccuugcuugcacaggauguuaugccugcuccaguggcaucucuuguaaggucaggauucauguugaugagcccgacgaacucacggugcacgugaaaagcaacgauccugacgucguggcagcuucaacuucccugauggcccggaaguuggagagugguaccgauagcacauucaaggcauucucugccaugccaaaaaccuccuuaugcuuuuacaucguugagcgagaauauuguaagucaugcagcgaggacgauacucaaaaauguguagaaacaaagcuggagcagccccagucgauucucaucgaacacaaagggaccauaauuggaaagcaaaaugacacgugcacugcuaaggcgucuuguuggcuggagagugugaaauccuucuuuuacggccuuaagaacaugcuggguagcgucuucggcaauuucuuuaucgggaucuugcuauuucuggccccuuucgugcuccugguucuguuuuucauguuuggauggaaaauuuuauucugcuucaaguguugcagacgcacaaggggccuguuuaaauaccgucaucucaaggaggacgaagagaccggguaucggagaaucauagaaagguugaacucaaagaaaggaaagaaucgccugcucgauggcgagcgacuggcagacagaaaaauugcugaacuuuucuccaccaagacucacaucgguuga

SEQ ID NO: 10432 - RNA, 5052 nt, Artificial Sequence
  derived and/or modified CDS sequence (opt3) from CCHFV(75-R-2012)__KR814863.1__GP
augcacacccugcucgugugcuucauccuuuaccugcaguuguuaggccuagggggagcccauagacaaagcaacgcuacaggucacaauggcacuaacacgaccacagcacccuccacuucucagucaccuaagccacuggucaguaccgccccgccccaugcgcucgagagcuccauuauaaaacacacaaccccuguuucugaaacugaggggucgggagaaacaaccccacccccuaauacgacucagggcccaucaccccuggagaccacaccugaaaggccagcuacuaccgccacaagcaccccgaguacggacaacacuaauuccacaacccaugugacugauaacaaucccacaucuaccaucagcacguccccuucaaguagcccaucuacccccuccacaccucaggguauucaccacccagcacggaaccuucugucaguaagcaguuugaagacugccaccacacccacuccgaccucuccuggggagaucuccagcgagacaucgucucuccauuccgcuaugucacgcaccaguacucuguauacggcaacacaagugagcaccgaaaaugccaaccacuccgcuccccgacagucugagagcucagcccagcagacuaccacaaguccaaugaccuccccugcgcaaagcauucuggucaugucugcagcccccacugcuauccagaauacacauccaucacccacgaaccguaguaaaagaaaucucgaaauggagauaaucuuaacccugagccagggacuuaagaaauacuauggcaagauuuugaagcugcuacaccucacucuggaggaagacacagagggccuucuggaaugguguaaaaggaacuugggguccaauugcgaugacgacuuuuuccagaagcggaucgaggaauuuuucaugaccggagaggguuacuuuaacgaggugcuccaauucaaaacacugucuacucagucgccuaccgaaccaagccacgcccgcccgcccacgguugagccuuuuaaguccuauuucgcaaaaggcuuuuuaucaauugauaguggguacuucucugcuaaguguuauccaagacugagcaccuccggacuccagcuuaucaacgugacacaacaucccgccaggauagcggaaacuccuggcccaaagaccacaucacugaaaacuauuaauugcaucaacuugcgggccagcgucuuuaaggagcaccgcgaaauugagaucaaugugcuacugccccagaucgcaguaaaccucucuaauugucauguugugauuaacucccacgucugcgauuacagucuggacaccgaugguccggugcgacuuccucauauauaccacgaggggacguucaucccaggaacauauaaaauugugaucgacaagaaaaauaagcugaacgauagauguaccuuggucacuaauugcguuauaaaaggcagggaagugcggaagggccagagcguacuccgucaguacaagacagagauuaaaaucgggaaggcuucuaccggaucccgcaaacuguuaucagaggaacccggugacgauuguaucaguagaacucaacugcuaaggaccgaaacagccgagauucacgacgacaacuauggcgggccuggagauaagaucacgauuugcaauggcagcaccauaguggaccagcggcucgguucggagcugggguguuacacuaucaaccgagucaaauccuuuaaacuuugcgaaaauucugcuacaggcaagaccugcgagauugauagcgcccccgugaaaugucgccagggauucugcuugaagaucacacaggaaggcagagggcauguuaaacugucaaggggaagugaggugguccucgacgcaugugauuccucuugcgaggugaugaucccaaaggguacuggcgacauucugguagauuguagcgggggacaacagcacuuccuuaaagacaaccugauagauuugggcugcccucauaucccccuccuggguaagauggccauuuauaucugucggauguccaaucacccacgcaccacgauggcguuuuuauucugguuuucauucggguacguuauuacaugcaucuuuuguaaggcucuguucuauagccuaauaaucauuggcacccucgggaaaaagaucaaacaguacagagaacugaagccgcagacuugcaccauuugugagacagcaccugugaacgccaucgacgcugaaaugcacgaucuuaacugcaguuacaauauaugccccuauugugccucuagguugacuuccgacggccuggcacgucaugucccacaaugccccaaacggaaggagaagguggaagagaccgagcucuaccugaacuuagaacgaaucccuuggauugucagaaaacugcuucaggugagcgagucgacagggguugccuugaagaggucaucuuggcucauugugcugcuaguacugcucacggucagucuguccccagugcagagcgcucccguuggacacgguaaaaccaucgaaacuuaucagacacgcgagggcuuuaccucuauaugucuuuucauguuggggagcauccuguuuuuaguguccugccucgucaagggacugguaaauucagugagugacagcuucuuuccuggccuuucuguguguaaaacuugcuccauugguucaaucaacggguucgaaauugagagucauaaguguuacugcagccuguuuuguugcccguauugucggcacugcuccgccgauagagagauccaucaauugcaccucucuauaugcaaaaagaggaagacaggcucgaauguuaugcuggcagucuguaaacgcaugugcuuccgagcgaccauugaagcuagccggcgugcccuacugaucagaucaaucauuaacacgacuuucgugaucuguauucucacccugacaauaugcguggucuccaccagugcaguugagauggaaaaucuuccaucuggaacuugggagagggaagaggacuugacaaacuuuugucaccaggagugccaggugaccgaaacagagugucugugccccuacgaagccuuagugcuccgcaagccucuguuccuugauagcaucguaaaaggcaugaagaaucugcuaaacuccacuucacucgagaccucucugagcauugaggcuccauggggagccaucaauguccaaaguacguuuaaacccacaguguccaccgcaaacauugcuuugagcuggucuucaguugaacaucggggaaauaagauccuggugacuggcagauccgagaguauaaugaaguuagaagagaggaccggugucagcugggaccucgggguggaagaugccucggagucuaaacugcuuacaguuuccaucauggaccugagccagauguauucaccuguguucgaguacuugaguggagaucgacagguagaagaguggccgaaggcgacuuguaccggcgacugccccgaacgcugugguugcacgucuuccacaugccuccacaaagaguggccacauagccggaacuggagauguaauccuaccuggugcuggggcgucgggacuggauguacaugcuguggcguggaugugaaggaccuguuuaccgaucacauguucgucaaauggaagguugaauacauuaagacugaggccaucgugugcguagagcuaacaucacaggaaaggcaauguagucugauugaggcugggacccguuuuaaccuuggacccgugacgaucacucucagcgaaccacgcaacauacagcagaaacugccucccgagauuaucaccuugcauccaaaggucgaagagggcuucuuugaccugaugcacgugcagaaaguuuuauccgcaucuacagugugcaagcuccaaagcuguacccacgguaucccgggggaucugcaggucuaucauauuggaaaucuucugaaaggcgaccgggugaacggucacuugauacauaagaucgagccucacuucaauacauccuggaugucaugggacggcugcgaucucgacuacuauuguaacaugggggauuggcccucuugcacuuacaccggaguuacgcagcacaaucaugccgcuuuugugaaccugcuaaauauugaaacagacuauacuaagaccuuccacuuucauaguaaaagagucacagcccacggcgauaccccacagcuggaccuuaaggcaaggcccacuuacggggcgggagagaucaccguacucguggaaguugccgauauggagcugcauacgaaaaagguggagauuucgggcuugaaauucgcuagcuuagccugcacagguuguuaugcaugcuccucugggaucucauguaagguccgaauacacguggacgaaccugaugagcugacuguacacgugaaaagcuccgacccagaugucguugcugccaguaccucucucauggcacggaagcuggaguucggaacagacagcaccuuuaaggccuucucagcuaugcccaaaacuucccuuugcuuuuacaucguggaacgcgaauacuguaagaguugcagcgaggaggauacacaaaaauguguggacaccaagcuggaacagccucagucuauuuugaucgagcauaaaggcacgauuaucgguaagcaaaacgacacuugcacagcgaaggccuccuguuggcuagaaucagucaagagcuuccuguauggccucaagaauaugcuggggucgguguuuggaaacuucuuuauaggcauucuuuuauuccuggcaccguuuguucucuugguacuguucuuuauguucggguggaaaauccucuucugcuuuaaguguugcagaaggacccggggacugcuuaaauaccgacuguugaaggaugacgaggaaaccggcuauagacgcaucauugagaggcuaaauaacaagaaagguaagaaucgucugcucgauggggagcgguuagcugacagaaaaaucgccgaacuguucucuacuaagacacacauaggauga

SEQ ID NO: 10433 - RNA, 5052 nt, Artificial Sequence
  derived and/or modified CDS sequence (opt3) from CCHFV(VLG/TI29414)__AY179961.1__GP
augcacacccugcucgugugcuucauccuuuaccugcaguuguuaggccucgggggagcccauauucaaagcaacgcuacagagcacaaugguacuaacacgaccacagcacccuccacuucucagucaccuaagccccuagucaguaccgccccgccccaugcgcucgaaagcuccacaauaaaaccuaccacuccaguuucugagacagaaggcagugggggaaccacgcccccuccaaauacuacccagggccccucaccuccagaggcuacaccggaaagacccgccacuaccgcaacaagcaccccuaguacggacaacacuaauuccacaacccacgugacugauaacaauccaacaucuaccaucagcacgucccccucaaguagcccuucuaccccauccacaccccaggguauucaucacccggccaggaaccugcuuucaguaagcaguccuaagacugcuaccacacccacuccaaccucuccuggggacaucuccagcgagacaucgucucugcacuccgcaaugucacggaccaguacuuuguauacggccacacaagugagcaccgagaaugcuaaccauuccgccccacgccagucugaaagcucagcgcagcagacuaccacaaguccaaugaccucccccgcacaaccuauucucgucaugagcgccgcuccaacugccauccagaauauacacccgucucccacaaaccgaucaaaacguaaucuggagauggaaaucauucugacgcucagucagggauuaaagaaauacuauggcaagauccugaaacuuuugcaucugacccuagaggaggauacugaaggccuccuggagugguguaagagaagccuuggguccaacugcgacgaugacuuuuuccagaagaggauugaagaguuuuucaugacaggagaagguuacuuuaaugaggugcugcaauucaaaaccuugucuacacucucgccuacugagccaagccacgcacggcccccuaccguugaaccauuuaaguccuauuucgcuaaaggcuuucugucaaucgauaguggguacuucucugccaaguguuauccccgcuuaagcacguccggacugcagcucauaaacgugacccagcacccggcgagaauugccgagacaccuggcccaaagacuaccucacuuaaaacaaucaacugcauuaaucugagggcaagcgucuuuaaggaacaucgggagaucgaaaucaacguguugcuaccccaaauugcuguaaaucugucuaacugucacguugugauaaauucccaugucugcgacuacagucucgauacugacgguccugugcgccugccccacaucuaccaugaggggaccuucauuccaggaacguauaaaaucgugauagauaagaaaaacaaacuuaaugaccgauguacacuggucaccaacugcguuauuaagggcagagaggugaggaagggccagagcguauugcggcaguacaagacugaaaucaaaaucgggaaggccucuacaggaucccguaaacuccugucagaggaaccuggugaugacuguauuagucgcacccaguuacugagagcugagcccgccgaaauccacgacgauaauuauggcgggccaggagacaagauuacuauaugcaacggcagcaccaucguggaucaaaggcuagguucggagcucggguguuacacaauuaaucgggucaaauccuuuaagcugugcgagaacucugcaacgggcaagaccugcgaaaucgacagcacuccggugaaaugucgacagggauucugccuuaagaucacacaggagggccgcgggcacguuaaauugucaagaggaagugaagugguccuggaugccugugacuccucuugcgaggugaugauuccuaaggguaccggcgauauacucguagacuguagcgggggacagcaacauuuccugaaagauaaucuuaucgaccugggcugcccccacauuccauugcucgguaagauggcuaucuauauuuguaggauguccaaccauccccggacaacuauggcguuucuguucugguuuucauucggguacguuauaaccugcaucuuuuguaaggcauuauucuauagccugaucauuaucggcacgcuagggaaaaagauuaaacaguaccgcgagcucaagccucagacaugcaccaucugugaaacugccccagugaaugcuauagaugccgagaugcacgaccugaacugcaguuacaacauuugccccuauugugcaucuagacuuaccuccgacggcuuggccaggcacgucccucagugcccgaaacguaaggaaaagguggaggaaacagagcuguaccucaaucuggagcggaucccauggaacguccgaaaauuacugcaagugagcgaaucgacugggguugcucuuaagagaucaucuugguugauugugcuccugguacuacugaccgucagucucucccccgugcagagcgccccuguuggacaugguaaaacaaucgagacguaucagaccagggaaggcuuuacuucuauaugucuguucaugcuugggagcaucuuguuucugguguccugcuuagucaagggacucguggauucaguaagugacagcuucuuuccaggccugucuguguguaaaacaugcuccauugguucaaucaauggguucgagauugaaagucacaaguguuacugcagccuguuuuguugccccuauugucgccauugcuccgcagaucgggagauccaccagcugcauuugucuauaugcaaaaagagaaagaugggcucgaacguuaugcucgcggucuguaaaaggaugugcuuccgcgcuaccauugaggccagccgacgggcacugcuaauccguucaaucauuaauacuacauucgugaucuguauucugacccucacgauaugcguggucuccacuucggccguugaaauggagaaccugccuucuggaaccugggaaagagaggaagaccuuacaaauuuuugucaccaagagugccaggugaccgagacugaauguuugugcccguacgaggcucugguguuaaggaagccccucuuccuggauagcaucguaaaaggcaugaagaaccuucuuaauuccacaaaccuagaaaccucacucucuauugaggccccauggggagcaaucaauguccagagcacauuuaaaccuacugugaguaccgcuaacauugcccuguccuggagcucuguugagcaccgcggaaauaagaucuuggugacgggccggucagaauccauaaugaagcuggaggaaagaacaggugucaguugggacuuagggguggaggaugcgagcgaaucgaaacuccugaccguuucuaucauggaccuuucccaaauguauagccccguguucgaguaccugucaggagauaggcagguagaggaauggccaaaggccacuuguaccggcgacugcccugagcgaugugguugcacaaguucuacuugcuugcauaaagaauggccccacucccgcaacuggcgguguaauccaaccuggugcugggaggucggcacgggguguacaugcuguggauggaacgugaaggaucucuuuaccgaccauauguucgugaaauggaaggucgaauacauuaagacugaggcuaucguuugcguggagcugacaagccaggaaagacaguguucacuaauugaggcaggcaccagguuuaaccuggggccgguaacuaucacacuuagugaaccucguaauauacaacagaaacugcccccagagauuaucacccugcaccccaagguggaagagggauucuuugauuugaugcauguccagaaagugcugagcgccuccacgguuugcaaguuacagucuuguacucacggcaucccuggugaccuccaaguguaucacauugggaaccugcuuaaaggagaccgcgucaauggccaucugauacacaagaucgagccacauuucaacaccagcuggauguccugggaugguugcgacuuggauuacuauuguaauaugggcgacuggcccucaugcacauacaccgggaugacacagcacaaccacgcugccuuugugaaucuccugaacauugaaacugauuauaccaagacguuccauuuucacucuaaacggguuacagcacauggagacacuccucagcuagaucugaaggcgagaccgaccuacggcgccggggagaucacagugcuugucgaaguagcugacauggagcuccacaccaaaaagguggagauuaguggacugaaauucgccucguuggcaugcacuggcuguuaugcuugcagcuccgguaucucuuguaagguuaggauacauguggaugaaccagacgaguuaaccguccacgugaaaucaaaugaucccgacguaaucgccgcaagcacaucccugauggcccgaaagcucgaguucgggacggauaguacuuuuaaggcuuucucugcgaugccuaaaaccagccugugcuuuuacauugccgaacgggaauacuguaagucaugcuccgaggaggacacacagaaauguguggacaccaaacuugaacaaccccagaguauccugauugagcacaagggaacuaucauaggcaagcagaacgauacaugcaccgcaaaggcuagcuguugguuggaaucugucaaauccuucuuuuauggucuaaagaauaugcugggcucaguuuucgggaacuuuuucauuggaauccuccuguuucuugccccauucguguuacuggugcucuuuuucauguucggcuggaaaaucuuguuuugcuucaaguguugccgcagaacgagggggcugcucaaauaccggcugcuuaaggacgaugaggaaacuggauaucgaagaauuaucgagcgccugaauaacaagaaaggcaagaauagguugcuagacggugagcgucuggccgaucggaaaauagcugaacucuuuagcacaaagacccauauuggguga

SEQ ID NO: 10434 - RNA, 5055 nt, Artificial Sequence
  derived and/or modified CDS sequence (opt3) from CCHFV__KJ648916.1__GP
augcacaucagccugauguacgccauucucugccuucagcuguguggcuugggggagacccauggaucccacaacgaaacaagacauaauaagacugacacgaugaccacacccggugauaacccuucuucagagccaccggugaguacugcuuuaagcauaacccuggaccccuccacagucaccccuacuacaccagcaucuggccuagaagggucgggagagguuuauaccucacccccuaucacgacuggcagccucccacugagugaaaccacacccgagcuuccugugacuaccgguacagauacccuguccgccggggacguagauccaucuacgcagacugcgggaggcacaagcgcuccgaccgugaggacuuccuugcccaauucaccuaguacaccaagcacaccccaggacacgcaccauccuguccggaaccuccugucugugaccuccccaggccccgaugagacaucaacuccgagcgggaccggaaaagaaaguucugccacauccagcccucaccccguuucgaaucgcccaccuacucccccagcaaccgcccagggucccacagagaacgacucucacaaugcuaccgaacauccugagucccugacucagucagcaacgccaggccucaugacaaguccgacccaaauugugcacccccagagcgccacuccuaucaccguccaggauacacauccaucccccaccaacgcuucuaaggccaauuuaaaaauggagauuauccugacucuuagccagggguugaagaaauacuauggaaagauacugcgacuacuccaacugacacuugaagaggacacggaaggccuguuggaguggugcaagcguaaccucggucuggauugugacgauaccuucuuucagaaaagaaucgaagaguucuuuauuacuggggagggacacuucaaugaaguguuacaguuuaggacaccuggcacccugucaacaacugagaguaccccagcgggccuccccacggcagaaccguucaaguccuacuuugccaaaggguuccuuagcaucgacucuggauauuacucagcuaagugcuauagugguaccagcaacuccggccugcaguugauuaauaucacacggcacucuacucgcauaguagacaccccugggccaaaaauuacaaaccuaaagacuaucaauuguauuaaccugaaggccucgaucuuuaaagagcauagagaaguugagaucaacgugcuccugccccaagucgcagugaaucuuagcaacugccacguggucauuaagucccauguuugugauuacucacuggacauagauggagcugugagguugccucacaucuaccaugagggcguauucauucccgguaccuauaaaaucgugauagacaagaaaaauaagcucaacgaucggugcacgcuguuuacagacugugucauuaaagggcgcgaagugcgaaagggccagaguguuuuaagacaguacaagaccgagaucaggaucggaaaagccucuacuggcagccggcgucugcuauccgaggaaccaucagaugacugcauuagccgcacacaacuccugagaaccgaaacugcggagauccacggggauaauuauggagguccuggcgacaagauuaccauauguaacgggucuacaaucguggaucagaggcuuggauccgaguugggcugcuacacgauuaaucggguccgaaguuucaaacugugcgaaaacagcgccaccgguaagaauugugagaucgacucugugcccguaaaaugccgccagggguauugucucagaaucacucaggaaggcaggggacacguuaagcugucccggggcucagaggugguccuugacgcaugcgauacaaguugugagauuaugauaccaaaggggaccggagacauccugguggauugcagcgguggccaacagcauuuucuuaaagacaaccucauugaucugggguguccgaagaucccuuuacugggaaaaauggcuauuuacaucugccgcaugucgaaucaccccaagacaacuauggccuuccuauucugguuuuccuucggcuaugucauaaccuguauccucugcaaagcuaucuuuuaccugcuuauuauuguggguacguuggggaagagacugaagcaguacagggaacucaaaccacagacauguaccaucugcgagacuacccccguuaacgccauagacgcagaaaugcaugaucugaauugcucuuauaacauuuguccuuacugcgccagccguuuaacaucagacggccuggcucggcacgugauccaauguccaaagcgaaaagagaagguagaagagacugagcuuuauuugaaucucgaaaggauucccugggucgugagaaaacugcuacagguuagugaguccaccggaguggcgcugaagcgcucuagcuggcucaucguccugcuuguguuguucacaguaucccugucaccugugcagagcgcaccgauaggccaggggaagacgaucgaagccuaccgggcuagagagggauauaccaguauuugcuuauuuguucucggcucuauccuguucauugucuccugucuuaugaaaggucugguggauagcguggggaacucguuuuucccaggauugucaaucugcaagacuuguucuauaaguuccauuaacggcuuugaaaucgagagccacaaaugcuacuguucucucuucugcugucccuauugcaggcauugcagcacagacaaggagauccacaaacugcaucuauccauuuguaagaaacgcaagaaggguucaaaugucaugcuggccguuugcaaacucauguguuuucgagcaaccauggaagugaguaaccgggcccuguucauccguagcauuauaaauacuacauuugugcuuugcaucuugauucuggcuguaugugucgugucuaccuccgccguugagauggaaaacuuaccugcaggcacgugggagagagaagaggaucucacuaauuucugccaccaagagugucaggugaccgaaacagagugccuguguccauacgaagcgcuuguccugaggaagccccuauuccucgacucaaccgcuaaagggaugaagaaccuguugaauaguacuagccuggagacauccuuaucuaucgaggccccuuggggagcaauuaacgugcagucgaccuacaaaccgacaguuagcacugccaauaucgcucucucaugguccaguguggaacaucgcggcaacaagauacugguaucugggcggagcgaguccaucaugaaacuugaagagagaaccggaauuucaugggaucugggcgucgaagacgccucugagagcaaauugcucacggugagugugauggaccugucccagauguauagccccgucuuugaguaccuaucuggugauaggcaaguuggggaauggccaaaggcaacaugcaccggagacuguccugagcgaugcggcugcacuucauccaccugucugcacaaagaauggccccacagucgcaauuggcggugcaacccaacaugguguuggggugugggcacugggugcaccuguugcggacuugauguaaaggaccucuucacggauuauauguuugugaaauggaaggucgaguacaucaagacagaagcuauuguguguguugagcugaccagccaggagagacagugcucguugaucgaagccggcacuagguucaaucuggggccugugacaauaaccuuaucugagccccguaacauucaacagaaacucccaccggaaaucaucacucugcauccucgcauugaggaaggauuuuucgaccuuaugcacguccagaaggugcuguccgcgagcacaguuuguaaauugcagucaugcacccauggcgugcccggugaucuccaagucuaucacauagggaaucugcuaaagggagacaaaguaaacggccaucugauccacaagauugagccacacuuuaacacgaguuggaugucuugggaugguugugaccuugauuacuauugcaauaugggcgacuggcccuccugcacuuacaccggggugacacagcauaaccacgccagcuucguuaaucuccugaacaucgagaccgauuacacaaagaauuuucauuuccacucaaaacgggugacugcucacggagacaccccucaguuggacuuaaaggcaagaccaacguauggcgccggggaaauuacaguccugguggagguagcugauauggaacuccauacuaaaaagaucgagauaaguggacugaaauuugccagccuugcauguaccggcugcuacgcguguuccucugguaucagcugcaaggugaggauucacgucgacgagcccgaugaacugacaguucaugugaaauccgacgauccugacguggucgccgcuucaucuaguuugauggcccgaaagcuagaguucgggaccgauucgacuuuuaaggcauucagcgcuaugccgaaaaccucccuguguuucuauaucguggaacgggagcacugcaagucuuguucagaagaggacaccaaaaagugcguuaacacgaaacucgagcagccacaaagcauucugaucgaacauaagggaacuauaauuggcaagcaaaauuccaccuguacagccaaagcaaguugcuggcuugagucuguaaagagcuuuuucuacggcuuaaagaacaugcugucagggaucuuuggaaauguguucauggguaucuuucucuucuuggcccccuuuauucugcucauccuguucuuuauguucggcuggcgcauauuguuuuguuucaagugcugcagaaggacccgggggcuguucaaauaucgacacuugaaggaugacgaagagacuggauacagacgcauuaucgaaaagcuaaacaauaaaaagggcaaaaacaagcugcucgauggugagagguuagcugaccgucggauugcggagcuguuuuccacaaaaacccacaucggguga

SEQ ID NO: 10435 - RNA, 3495 nt, Artificial Sequence
  derived and/or modified CDS sequence (opt3) from CCHVF(CCHVF 10200)__U39455.2__Gn-NSm-Gc
agcgaggaacccuccgacgauugcgugucuagaacccagcugcucaggacagagacugccgaaauccacggcgacaacuacgggggaccuggugauaagauuacgauauguaauggcucaaccaucgucgaccaacggcuugggagugagcugggaugcuauacaauuaaccgcguucgaucuuucaaauugugugaaaauuccgcuacuggcaagaacugcgagaucgauucugugccaguaaaaugucgucaggguuacugcuuaagaauuacccaggaggggaggggacaugugaagcugucgcggggcucagaagucgugcuagacgcaugugauacaagcugcgagaucaugauaccgaaaggcaccggggacauccucguugauuguaguggaggucagcaacacuuucugaaggacaaucuuauugaucugggcugccccaagaucccuuugcucgggaaaauggccauuuauaucugucgcauguccaaccauccaaagacuacaauggcguuccuguuuugguucucuuuuggauacgugauaaccugcauucugugcaaagcuaucuucuaucucuuaauuaucgucggcacgcuggguagaaggcuuaagcaguaccgggaauugaaaccccagacuuguaccaucugcgagacaacuccugugaaugccauugacgcagagaugcacgaucugaacuguagcuauaauauaugcccauacugugccucccgccuaaccucagacgggcucgcucgacauguaauccagugccccaagagaaaggaaaaaguugaggaaacagagcuguaccuuaaccuggaaaggauuccuugggugguccggaaguugcuccaagugagugagagcaccggaguggcacugaaacguucuuccugguuaaucguccugcucguucuuuuuacggugucacugagcccaguacagagugccccgauaggccagggcaagacuauugaggcuuaucgcgccagagaaggguacacaucuaucuguuuguucgugcuaggauccauccuguuuauugucagcugccucaugaaaggucugguggacucgguuggcaauucuuucuuucccgggcuuuccaucuguaagaccugcucaauuaguagcauaaacggauucgagaucgaaucccacaaauguuauugcucucuguuuugcuguccuuacugcaggcacuguagcacugauaaggagauucauaaguugcaccucucaaucugcaaaaagcggaaaacaggcaguaaugugaugcuggcggucuguaaguuaaugugcuuccgagcaaccauggaaguguccaaccgcgcccuguucaucagaagcauuauaaauacgaccuuuguacuauguauccucauucuggcuguuugcguggucucuacaucagccguggagauggagaaccuuccagcagguacuugggaaagggaggaagacuugaccaacuucugucaucaggagugccaagucacagaaacugagugucugugccccuaugaggcucucgugcugcggaaaccucuuuuucuggauaguaccgccaaggggaugaagaauuugcucaacagcacaucccuggaaaccucuuuaucgaucgaggcgccauggggcgccauuaauguucagagcacuuacaaacccacgguguccacagcaaacaucgcucugucauggaguucuguagaacaccgcggaaauaagauacuugucagcggcagauccgagucaaucaugaaacucgaggaaaggaccgggauuagcugggaccugggaguggaggaugccucugaauccaagcuauugacuguuagugugauggaccugagccagauguauucuccggucuucgaguaccucuccggugaucgucaaguggaagaguggccuaaagcuaccugcacaggcgacugucccgagcggugcggguguaccucaaguacuugccugcacaaggaauggccacauagccgaaacuggagauguaauccuacauggugcuggggaguaggcacggguuguaccugcuguggguuagaugugaaggaccuguuuacugauuacauguucguuaaauggaaggucgaguauaucaaaacagaagccauugugugcguggagcuuaccucgcaggaaaggcaguguuccuugaucgaggcaggcacacgcuuuaaccucggacccgucacuauaacccugucugagccacggaauauucagcaaaagcuacccccugaaaucauuacgcugcacccaagaaucgaggaaggcuucuuugaccucaugcauguucagaaagugcugagcgccucaaccgugugcaaacuucagaguugcacacacgggguaccgggagacuugcaggucuaccauauagguaaccuguuaaagggcgauaaggugaaugggcaccucauccacaagauugagccccauuucaacacuuccuggaugucuugggacggaugugaucuggacuauuacugcaauaugggcgauuggccuagcuguaccuauacagguguuacucaacacaaccaugcuuccuuugugaaucuucugaacaucgaaaccgacuacacgaaaaacuuccacuuucacucaaagagggucacagcgcauggggauaccccacaguuggaccucaaagcacgccccacuuauggcgccggagagauuacagugcugguugagguggcugauauggaacuacacaccaagaaaaucgagauaagcggccugaaguucgccagucucgcaugcacuggguguuacgccugcagcuccagcauuucguguaagguacgaauccaugucgacgaaccugaugagcugaccgugcacgugaaaucagacgauccagacgucguugcugccucuaguucccuuauggcacggaaguuggaguucggaacagacagcacguuuaaagcguucucugcuaugcccaagaccagccugugcuuuuacaucguggaacgugagcauuguaaauccugcucagaagaggauacuaagaaguguguaaauacaaaauuagaacagccgcagaguauucucaucgagcacaagggcaccauuauagguaaacaaaacagcacaugcacugccaaggcaucuugcuggcuggaguccgugaaaucauucuuuuaugggcuuaagaauaugcugaguggaaucuucggcaacgucuuuauggguauuuuccuauuucucgccccuuucauccuguugauucuguuuuucauguuuggcuggagaaucuuauucuguuucaagugcuguaggcgcacccgggggcucuuuaaauacagacaccugaaggacgaugaagagacgggauauaggcgaauaaucgaaaaacuuaauaacaagaaaggcaagaauaagcuguuggacggggagcgccucgcugauggacggauugccgaacuguucagcacaaaaacccauaucggc

SEQ ID NO: 10436 - RNA, 3495 nt, Artificial Sequence
  derived and/or modified CDS sequence (opt3) from CCHVF(CCHVF IbAr10200)__AF467768.2__Gn-NSm-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcguccgaucuuucaaauugugugaaaauuccgcuacuggcaagaacugcgagauugauucuguuccagugaaaugucgucaggguuacugcuuaagaaucacccaggaggggaggggacauguaaagcugucgcggggcucagaagugguccuagacgcaugugauacaagcugcgagauaaugaucccgaaaggcaccggggacauucucguggauuguaguggaggucagcaacacuuucugaaggacaaucuuaucgaucugggcugccccaagauuccuuugcucgggaaaauggccaucuauauaugucgcauguccaaccauccaaagacuacaauggcguuccuguuuugguucucuuuuggauacguuauuaccugcauccugugcaaagcuauuuucuaucucuuaaucaucgugggcacgcuggguaagagacuuaaacaguacagggaauugaagccccagacuuguaccauuugcgagacaacuccugucaaugccauagacgcagagaugcacgaucugaacuguagcuauaauaucugcccauacugugccucccggcuaaccucagacgggcucgcucgccaugugauucagugccccaagcgaaaagaaaagguagaggaaacagagcuguaccuuaaccuggaaagaaucccuuggguugugaggaaauugcuccaagucagugagagcaccggaguggcacugaagcggucuuccugguuaauagugcugcucguccuuuuuacgguuucacugagcccagugcagagugccccgauuggccagggcaaaacuaucgaggcuuaucgugcccgcgaaggguacacaucuaucuguuuguucguacuaggauccauucuguuuaucgugagcugccucaugaagggucuggucgacucggugggcaauucuuucuuucccgggcuuuccauuuguaaaaccugcucaauaaguagcaucaacggauucgagauugaaucccacaaguguuauugcucucuguuuugcuguccuuacugcagacacuguagcacugauaaggagauccauaaauugcaccucucaaucugcaagaaaaggaagaaaggcaguaauguuaugcuggcgguguguaaguuaaugugcuuccgggcaacaauggaagucuccaaccgagcccuguucauucgcagcauaaucaauaccacguuugugcuauguauucucauccuggcuguaugcguugugucuaccucagccgucgagauggagaaccuuccagcagguacaugggaaagagaggaagacuugacuaacuucugucaucaggagugccaagugaccgaaacagagugucugugccccuaugaggcucucguccugaggaagccucuuuuucuggauaguacugccaaagggaugaagaauuugcucaacagcaccucccuggaaacaucuuuaucgauugaggcgccauggggcgccaucaaugugcagagcaccuacaaacccacuguuuccacggcaaacauagcucugucauggaguucuguggaacaccggggaaauaagauccuaguaagcggccgcuccgagucaauuaugaaacucgaggaaagaacagggaucagcugggaccugggagucgaggaugccucugaauccaaacuuuugaccgugaguguuauggaccugagccagauguauucuccgguguucgaguaccucuccggugauaggcaagucggcgaauggccuaaggcuacuugcaccggggacugucccgagcguugcggauguacaucaaguaccugccugcacaaagaguggccacauagccggaacuggcgauguaauccuacuuggugcuggggcguggguacaggguguacgugcuguggcuuagauguaaaggaccuguuuaccgauuacauguucgugaaauggaagguugaauauauuaaaacugaggccaucgucugcguggaacuuacaucgcaggagagacaguguuccuugauagaagcaggaaccagguuuaaccucggccccgugacaauuacucugucugagccacgcaauauccagcaaaagcuacccccugagauuaucacccugcacccacggauagaagagggguucuuugaccucaugcauguccagaagguucugagcgccucaacggugugcaaacuucagaguugcacccacggagugccgggugacuugcagguauaccauaucggcaaccuguuaaagggggauaaagucaauggacaccucauucacaagaucgaaccccauuucaacacauccuggaugucuugggacggcugugaucuggacuauuacugcaauaugggugauuggccuagcuguacuuauaccggggugacacaacacaaccaugcuuccuuuguuaaucuucugaacauugagacugacuacaccaaaaacuuccacuuucacucaaagagagugacggcgcauggcgauacaccacaguuggaccucaaagcaaggcccaccuauggagccggcgaaaucacuguccugguggagguugcugauauggagcuacacacaaagaagauagaaauuagcgggcugaaauucgccagucucgcaugcaccggauguuacgccugcagcuccggcaucagcuguaaggugcgcauccauguagacgagccugaugaacugacuguccacgugaaaucggacgauccagacguggucgcugccucaucuagucuuauggcacgaaaguuggaguucgguaccgacuccacauuuaaagcguucagcgcuaugcccaagacgucucugugcuuuuacauuguugagcgggaacauuguaagagcugcuccgaggaagauaccaaaaagugugugaauacuaaauuagagcagccgcagucaauccucauugaacacaaggggacaauaaucggaaaacaaaacaguaccugcacagccaaggcaagcugcuggcuggagucuguaaaguccuucuuuuauggccuuaaaaauaugcugucagguauuuucggcaacguguuuauggggaucuuccuauuucucgccccuuucauucuguugauccuguuuuucauguuuggauggcguauauuauucuguuucaagugcuguagaaggacucgcggccucuuuaaauaccggcaccugaaggacgaugaggaaaccggguauagaaggaucauugagaaacuuaauaacaagaagggaaagaauaagcuguuggacggcgaacgacucgcugaucgccggaucgccgagcuguucaguacgaaaacacauauuggu

SEQ ID NO: 10437 - RNA, 3495 nt, Artificial Sequence
  derived and/or modified CDS sequence (opt3) from CCHVF(CCHVF Turkey-Kelkit06)__GQ337054.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguuguguaaaaauagcgcuacuggcaagaccugcgaaguugacuccacaccagugaaaugucgacaggguuuuugcuuaaagauuacccaggaggggcguggacauguaaagcugucuagaggcucggaggugguccuagaugcaugugacucaagcugcgaagugaugaucccgaaaggcacuggggauauacucguugacuguaguggaggucagcaacacuuccugaaggauaaccuuaucgaccugggcugcccccauauuccuuugcucgggaggauggccaucuacauuugucggauguccaaucacccacgcacaaccauggcguuucuguucugguuuucuuucggauaugugaucacgugcauauuuugcaaagcucuguucuacagccucauuaucauuggcacuuuagguaagaaaaucaagcaguauagagagcugaagccccagaccuguacaaucugcgaaacugccccugucaacgcaauugaugccgagaugcaugaccuuaauuguuccuacaacauaugcccauauugugcuucaagguugaccagugacgggcuggcacggcacgugacacagugccccaaacgcaaggagaaaguagaagagaccgaacuauaccucaaucuggagcgaaucccuuggauuguuagaaaacuucugcaagugagcgaaucuacgggagucgccuugaagagguccucauggcucaucgugcuguuagugcugcucacugucagccuuaguccaguucagucugcuccggugggccacggcaagacaauagagauuuaccagacccgggagggguuugccuccaucugucuguucauguugggaagcauccuauuuauuguaucgugccuggugaaaggucucgucgauucuguguccgaaucauucuuucccggccugaguguuuguaagacuugcagcaucggguccgugaacggauucgagauugaaucucauaaguguuauugcagccuuuucugcuguccuuacugccgucacuguucagcggaccgcgagauacaucagcugcacuugaguaucugcaaaaagagaaaaacaggcuccaaugucaugcucgcaguguguaagaggaugugcuuucgggccaccauugaagcuagccgacgcgcccuguuaaucagaucuaucauuaacacgaccuucguaauauguauccugacacuaacuauuugcguugugucaaccagugcagucgagauggagaaucucccagcugguacaugggaaagggaggaagaucugacuaacuuuugucaccaagagugccaggugaccgaaacagagugucuuugccccuaugaggccuugguccugcggaaaccucucuuccuggacagcaucgugaaggggaugaagaaucuucugaacuccaccucuuuggaaacuucgcucagcauugaggcgccauggggcgccaucaacguucaguccacguuuaaacccacagugucaaccgcaaauauagcucugaguuggucuagcguaguccaucgcggaaacaagaucuuagugacuggcagauccgaaucaauuaugaaacuggaggagaggaccgggguuagcugggaucuaggaguggaagacgccucugaguccaagcuccugacagucaguaucauggaucuuagccaaauguacucuccgguguucgaauauuuguccggugaccgucagguagaggaauggccuaaagcuaccugcacuggcgauugucccgagcggugcggguguacaucaaguacgugccugcacaaggaguggagccauucgcgaaauuggagauguaacccaaccuggugcuggggagugggcacugguuguacaugcugugggguugacgucaaggaucucuuuaccgaccacauguucgugaaauggaagguggaauacauuaaaacagaggccaucgucugcguugcacugacuucccaggaaaggcaguguucuuuaauagaggccggcacccgcuuuaaucugggaccugugacgauuacccuuagcgaaccccggaacauccaacagaaguugccacccgagauuaucacacuccauccuaaaauagaggaaggcuucuuugaccugaugcacgugcagaagguacuaucagcuaguacugucugcaagcugcaguccugcacccacgggaucccaggagaucuccaaguguaucauauugguaaucugcuuaaaggcgacagaguuaacgggcacuugauccauaagauugagucucacuucaauacaagcuggauguccugggauggaugugaccuggauuacuacugcaacaugggcgacuggccgucauguacuuauaccggugugacgcagcacaaucaugcggcauuugucaacuuacucaauaucgaaacagauuacaccaaaacuuuccacuuccauagcaagagggugacagcccacggggacacuccccagcuggaucuuaaagcucgcccuaccuauggcgccggaggcauaaccguucugguggagguagcagacauggaauugcauacaaagaaagucgagauuagugggcucaaguuugccucucuggcuugcacgggauguuacgccugcuccagcggcaucucguguaaggugcgaauccacguggaugagccagacgaacuaaccguccacguuaaaucaucugaucccgacgugguagcagcgaguacuucccugauggcucggaagcucgaguucgguacagacagcaccuuuaaagccuucucugcaaugccuaagacaagccugugcuuuuauauuguggaacgugaguacuguaaauccugcucagaggaugacacucagaagugugucgauaccagacuugaacaaccacagaguaucuugauugagcauaaggggacgauaaucggaaaacagaacgacacaugcaccgccaaggcuagcugcuggcuggaaucugugaaauccuucuuuuauggcuuaaagaauaugcucgguucaguuuucggcaaccuguuuauugggauccuucuguuccuagcccccuuugugcuccuggucuuguucuuuauguucggauggaaaauucuguucuguuuuaagugcuguaggcgcacucggggcuuauucaaguacagacaccucaaagaugacgaggaaaccggguacaggcgaaucauagagcgccugaacaguaagaaaggaaagaaucggcuucuggauggcgacagauuggcagauaggaaaaucgcugagcucuuuagcacaaagacucauauuggu

SEQ ID NO: 10438 - RNA, 3498 nt, Artificial Sequence
  derived and/or modified CDS sequence (opt3) from CCHVF(CCHVF SR3)__AJ538199.1__Gn-NSm-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugcgaaguuucaaauugugugaaaauuccgcuacugguaagucuugcgagauugauucgaucccuguaaaauguaagcagggguacugcuuaaaaauuacccaggagggacguggccaugugaagcugucaagaggcagcgaagucgugcuagacguuugugauaguuccugcgaggugaugaucccaaaggggacaggagacauacucgucgauuguucugguggccagcaacacuuucugaaagacaaccuuguggaucuggggugcccgaagauccccuugcucggaaaaauggcaauuuauaucuguaggaugagcaaucauccuaagaccacuauggccuuccuguuuugguucuccuuuggcuacguaauuacaugcauccugugcaaagcgauauucuuucucuuaauuaucuucgguacccuggggaagcgguuuaagcaguaucgcgaacuuaaaccacagacguguacuauuugcgagaccacacccguuaacgcuaucgacgccgagaugcacgauuugaauuguucauacaacaucugcccuuauugugcaaguagacugacuagcgacggacuagccaggcaugugacccagugcccacggcgcaaggaaaaagucgaggaaacagagcucuaccugaaucuugaacgaauacccuggguggugagaaagcuguugcaagucucugaguccaccggcacgguucucaaaaggucaagcuggcugauuguguuacugguacucuucacugugagucuuucuccuguccaguccgcuccaaucggccacgggaagacaauugagaccuaccgggugcgugaagaguauacuagcaucugucuguuuguuuugggaucgauacuauucauugugucuuuucugaugaaaggucucgucgacggcguggggaacaucuucuucccgggacuguccguaugcaagacauguucaaucggcaguauuaaugguuuugaaaucgagagccacaagugcuacuguucccuuuucugcugccccuauugucgccauugcucugcagauggggaaauucaccagcugcauuugagcauauguaaaaagagaaaaaccggcucaaacguuaugcucgccgugugcaagaggauguguuuucgggcuacgauggaggucaguaauaaagcccuguucauccgauccauuaucaacaccacauuugugaugugcaucuuaaagggagaguucgcggcagucaagagcauucacccuauagaaauggagucucugccagccggcacuugggaacgcgaggaagaccuaaccaauuuuugucaccaggagugccaagugacagagacugaaugucucugccccuacgaggcucugguucuuagaaggccuuuguuccuggauucaaucgugaaagggaugaagaaccuccugaacaguaccagccuugaaacaucccugucuauugaggccccauggggagcaaucaauguacagucgaccuauaaacccacugucagcacggcuaacauugccuuguccuggucaaguguggagcaucgggguaauaagguucucgugucuggccgcagcgaauccaucaugaaacuggaggaaagaacagggauaucaugggacuuaggagucgaggaugcgagcgaaucuaagcugcuaaccguguccguaauggaccucagucagauguacagcccgguguuugaguaucugucuggcgauaggcaaguugaggaauggccuaaggccacuuguaccggugacugccccgagcguugcggguguacauccucaaccugccuucacaaagaauggccacauagucggaacuggcgauguaauccuacuuggugcuggggcgucggaacaggcuguacgugcuguggguuggaugugaaggaccuguucaccgauuacauguuugugaaauggaaggucgaguacaucaaaacugaagcaauuguuugcguggagcucacaagccaggagagacaguguucgcugaucgaagcuggaaccagguucaacuuagguuccgugacaauuacucugucugagccccgcaauauccagcaaaagcugccacccgaaauaauuaccuugcacccuaagaucgaggaaggcuuuuucgaccucaugcauguacagaaaguccugagcgccucaacggugugcaagcuacagaguuguacccacgggguuccaggagaccuucagguguaucacauuggcaaccuccugaaaggugaucgggucaaugggcaucuuauccacaagauagagcaacauuucaacacauccuggaugucuugggacggcugcgauuuggacuacuauugcaauaugggagauuggccgagcuguacuuacaccggcgugacacagcacaaccacgcuuccuuuguuaaucuguuaaacaucgagacugacuauaccaaaacguuccauuuucacucaaagagagugacagcccauggggauacuccccagcucgaccugaaagcaaggccuaccuacggagccggcgaaauuacaguacuugucgagguggcugauauggaacugcacaccaagaagaucgagauuagcgguuugaaauucgcggggcucacuugcaccggauguuaugcaugcaguucuggcaucuccuguaaggugcgcauacaugucgacgagccagaugaacugacaguucacgugaaaagcgacgaucccgacguaguggccgcuucgucaucucuaauggcccgaaagcuggaguuugguacggacaguaccuucaaagcauuuuccgccaugccuaagacuagccucugcuucuacauugucgaacgggaguacuguaagucuugcaauaaagaagauacacagaagugugugaacaccaaacuggagcaaccacagagcauccuuaucgagcacaagggcacaauuaucgggaaacagaacaauacuugcaccgcuaaggccuccuguugguuggaaucaguuaagagcuuuuucuauggacugaaaaacauguuaggcgggauuuuuggaaauguguucauaggcaucuuuacguuccucacacccuucauucugcuuauccuguuuuucauguuugguuggcguauucuauucugcuuuaagugcuguagaaggacccgcggacucuucaaauaccggcaucugaaggacgaugaggaaacuggguauagaaaaaucauagagagguugaacaauaagaagggcaaaaaccgacuguuagacggugaacgccucgcagaucggaagaucgcggagcuguuuagcaccaaaacacacauuggc

SEQ ID NO: 10439 - RNA, 3498 nt, Artificial Sequence
  derived and/or modified CDS sequence (opt3) from CCHVF(CCHVF UCCR4413)__KY484038.1__Gn-NSm-Gc
agcgaguccucugccucaggcugcaucaguagaacccagaugauuaagagcgaaacagcugagauacacgacgauaucuacgggggacccggugaaaaacuuacuauuuguaacggcacgaccguggucgaccaaaggcucggguccgagcuuggaugcuauacaaucaaucggauuaagacuuacaaacugugugaaaacucuguuaaggagaaaaccugcgagaucgauucggugccuguaaagugucgccagggcuugugcuuaaagauaacacaggaaggucgagggcaugugaaacugucacguggaagcgagaucguccuagacauuugugauaguuccugcgaacucaugaucccaaagggcaccggcgacauucugguggauuguucugggggacagcaacacuuccuucaggacaaucugguugauuuggguugcccgaacaucccccuccugggcaaaguggcaauauauauuuguagaaugagcaaucauccuaagacuacaauggccuuucuguucugguuuuccuucggguacgucauuaccugcauccucugcaaaaucuuauuuuaucugcuuaucauuacgggaacuuugggcaagaagcugaaacaguacagggagcuaaagccacagaccuguacaauaugcgagucaacucccgugaacgcgaucgacgcugaaaugcacgaucucaauuguaguuauaacauuugcccuuacugugccagccggcugaccucugacggucuuauccgccauguaaaucugugcccaaaaagaaaggagaaaguugaagagacagaauuguaccucaaccuggagaggauacccugguucgugcggaaguuacugcaagucuccgagucaaccgggguggcacucaaacgcagcaguuggcuucugauuuuggugauccuacugacggucucuauguccccuguucagagcgccccaaucaaucagcagcgagcuguggaagcauaucaagccagagagggauacacuggcauuugucucuuuauccugggcucgguacuuuucaugacaucuuggcugaccaagggguugauugauuccauaggagacucauuuuucccgggucucuuugugugcaagacuuguaguaucggcagcauuaacggguucgaaaucgagucccacaggugcuauuguucucuguuaugcugccccuacugucggacaugcagcgcugacaaagauucacaccagcugcaucuaaguaucuguaagaaaaagaaagccggauccaaugucaugcucgcggugugcaagcguauguguuuuaaggcaaccauugaagccagcaaccgcguucugcuuauaagaucuaucauuaauacgaccuucaucauuugcauguugauccugguggucugugugauaucaacaagugcuguagagauggaggaccucccugccggcacuugggaaagggaggaagaucugaccaacuucugccaccaggagugucaaguuacagaaacugagugccuuuguccauaugaggcauuugugcugcggaaacccuuguuccucagcuccaucgucaaggguaaaaagaaccuguuaaauucugcuucgcuggaaaccagccuauccauugaggccccuuggggcgcgaucaacgcccagucaacauuuaaaccaaccauuaguacugcaaauaucgcucucucuuggagcuccguggaacaucgagggaacaagguccuggugucaggacgcagcgagucuauaaugaaacuugaggaaagaacgggcauuuccuggaauuuggggguugaggacgccagugaaagcaggaugcugacagugucuguaauggaucucucccagauguaccugcccgucuucgaguauuuaucaggagaccgccagguggaagaguggccgaaggcuaccugcacuggugauugcccugagcgguguggcugcaccaguagcacaugucugcacaaggaauggccccacucgagaaacuggaggugcaauccaaccugguguuggggaguugggacuggcugcacauguugcggucuugacgugaaagauuuguuuacggacuacauguucgucaaguggaaaguggaguacaucaagaccgaagccauuguauguguggagcucacuucccaagaacgucagugcucucugaucgaggcagggacacgguuuaaccuaggcccuguuaccauaacacugagcgagccccgaaauauccagcagaagcucccaucagaaauugucacucugcaucccaaaaucgaggaaggauucuuugaucuuaugcacgugcaaaagguguugagugccuccaccgucuguaaacugcagucuugcacgcauggcguugcuggggacuuacagguguaucacgugggaaaccuccugaagggugacaaaauuaauggccauagcauccacaagauagagccucaccuuaacaccuccuggaugucaugggaugggugcgaccuggauuacuauuguaauaugggagacuggccaagcugcacauacacuggcguaacccagcauaaccacgcggcauucgucaauuugcucaacauugaaacagauuauacuaaaaguuuucauuuccacucuaagagagugaccgcccacggugacacgccgcaacuggaucuaaaggcuaggcccauguacggggccggcgagaucacaguucugguggaggucgcagacauggaacuccauuccaaaaacaucgagauuagcggacugaaguuugccucgcuuaccuguucaggcugcuaugcuuguucuagugggaucuccugcaaagugcgcauucacguugaugaaccugacgaguuggccgugcauguaaagagcgaugaccuggaugucguggcagcgucuagcuccuuaauggcucggaaaauagaguucggaacugacucaacauucaaggccuuuaguagcaugccaaaggaaucucucuguuucuacaucguggagagagacuuuugcaaauccugugcagccgaagauacccagaagugcgucaaagcuaagcuggagcagccccagucaauucuuaucgaacacaaaggcacuauuaucgguaagcaaaaugacaccuguaguacaaagacgagcugcuggcuggaguccuucaaaucguuuuucuacgggcuaaagaacaugcucucuggaguuuuuggcagcgccauaauggguauccuguuguuccuggcaccuuuuauuuuacucauccuguucuuuuucuuuggcuggaggauucuuuucugccugcgcuguugccgacggacccguggguuguucaaauauaagcauaucaaagaugacgaggaagcuggauacaagaagauaauugagaaacucaauaacaagaaaggcgggacuucaaagcugcuagauggagaaagacuggccgacaggaaaaucgcggagcuguuuuccacaaaggcccacaucggc

SEQ ID NO: 10440 - RNA, 3495 nt, Artificial Sequence
  derived and/or modified CDS sequence (opt3) from CCHVF(CCHVF 66019)__AB069669.1__Gn-NSm-Gc
agcgaggaauccggcgacgauugcaucucuagaacccagcugcucaggacagagacugccgaagugcacggggacaacuacggaggucccggcgauaagauuacgauauguaaugggucaaccaucgucgaccaacggcuuggaagugagcugggcugcuauacaauuaaccgcguuaagagcuucaaguugugugaaaauuccgguacugggaaaucuugcaagaucgauaacaccccugugaaaugucgacagggauuuugcuuaaagauuacacaggagggccguggccauguaaagcugucgagagggucagaggugguccuagacgcuugugauagcaguugcgaaaucaugauaccaaaaggaaccggugacauccucguggauuguuccggcgggcagcaacacuuccugaaggacaaucuuguugaucugggaugcccgaacauucccuugcucggcaaaauggcaaucuacauuuguaggaugucuaaucauccuaagacuacaauggccuuucuguucugguuuagcuucgguuaugugauaaccugcaucuuuugcaaaauuaucuucuaccugcucauugucguggggacguuaggaaagaaguuuaaacaguaucgggagcugaagccacagacuuguaccaucugcgaaacaacucccaccaacgcgaucgacgcugagaugcacgaucuuaaauguuccuacaauauuugcccuuauugugccucacgcuugacaagugacggccuggcaagacauguaacccagugcccaaagaggaaagagaagguugaagagacggaacuauaccucaaccuggagcggauacccuggaucgugcgcaaacuucugcaagucagcgaaucuacuggcguggccuugaagcgauccucauggcucauugugcuguuaguccugcucacaguuagccuuaguccugugcagucugcuccaaucgggcacggaaagaccauagaggcauaccagacuagagaggguuauacauccguaugucuguucauguugggcgggauucuauuuguggucagcugccugaugaaaggacucguggacucgguuucuaauuccuucuuuccgggccugucaaucuguaagaccugcaguaucgguagcgugaacggguucgaaauugagucccacaaauguuacugcucucuucugugcuguuuguauugcaggcauuguagcgccgaucgggaaauccaccagcuccaucugucaauuugcaagaaacgucgcgcuggcggaaaugucauguuagccguguguaagagaaugugccugagggcgacgauggagguaaguaacaagguucuauucauacgguccaucauuaauaccacauuugugaucuguauccucguccuggcagugugcauugucagcacuucugccguggaaauggagucacuucccgcuggcaccugggagcgagaagaggacuugacaaacuucugucaccaagaaugccagguuacugagaccgaaugucugugcccuuacgaggcccucgugcugcgcaaaccacuuuuuagugauagcauaguaaaggggaugaaaaaccugcuuaauuccacaucucucgagaccucgcugagcaucgaagcacccuggggagcuauuaacguccaguccacuuucaagccuacggugucaacagccaauaucgcguuaaguuggucuagcguugagcacagagguaacaaaauucugguguccggcaggucagaaagcaucaugaagcuagaggagcggaccgggauaucuugggaccucggagucgaagaugccuccgagaguaagcugcuuacugugagcguaauggacuugucucaaauguauuccccaguguuugaauaccugucaggcgaucgccagguugaggaauggcccaaagcaaccugcacagguaauuguccggacagaugcggguguaccaguagcacuugccuccauaaggaguggccucacucgaggaacuggcguuguaaucccacauggugcuggggcgucggaacgggcuguaccugcugugggcuggaugugaaagacuuauucacugauuauauguuugugaaguggaaagucgaguacaucaagacagaagcuauuguuugcguggagcugaacucccaggaacggcaguguucucuuaucgaggccggaacccgauucaauuuggguccagugacaauuacucucagcgaaccuagaaacauccaacagaagcugcccucagagauaauuacccuacauccaaggaucgaggaaggcuuuuucgaccugaugcacguacagaaaguccucagugcuuccacggugugcaagcugcagucuugcacccaugggguucccggagaccuucaaauuuaccacaucggcaauuugcugaaaggugaucgcgugaacgggcacuuaauacauaagaucgagccucacuuuaauacaagcuggauguccugggacggcugugaucucgacuauuacugcaacaugggagauuggccaucauguacuuauaccggcgucacacagcauaaucacgccgcauucgugaaccugcuuaacauugaaacugacuacaccaaaaauuuucacuuccauagcaagcggguuacggcccacggggauacaccgcagcuggacuugaaagcuagacccaccuauggagcgggcgagaucacugugcucguagaagucgcagauauggagcugcauacaaagaagauugccaucaguggucuaaaauucgcuucucugaccugcacuggguguuacgccugcuccagcggaauaucguguaaggugaggauucacguggacgagccugaugaacucaccguccauguuaaaucagaggacccagauaucguggcagccucuaguucccugauggcucgcaaguuggaauuuggcacagacagcacguucaaagccuuuucugcaaugcccaagaccagcuugugcuucuauaucguagagcgagaguacugugaauccugcucaaaggaggacacucagaaaugugugaacacaaagcuggaacaaccucagaguauuuuaaucgagcacaaagguaccauuauaggcaagcagaaugauacaugcacugcgaaagcuagcugcuggcucgaaucugucaaguccuuuuucuacgggcugaagaacaugcuuucaggaaucuuuggcaauguguucauugggaucuuucuguuccuagccccauuuauucuccugaucuuguucuuuauguucggauggcggauacuguucuguuuuaaaugcugucguagaaccaggggcuuauucaaguaucgcuaccucaaagacgaugaggagagugguuaucggagaaucauugaaaggcugaacaauaagaaagggaagaacaaacuucuggacggagagcgauuggcagaucgccggaucgccgaacucuuuagcacgaaaacacacauuggc

SEQ ID NO: 10441 - RNA, 3495 nt, Artificial Sequence
  derived and/or modified CDS sequence (opt3) from CCHVF(CCHVF 7001)__AB069670.1__Gn-NSm-Gc
gccgagggcgggagcuccgacugcaucucuagaacccagcuggugaagacagaagucgcugagauucacgaagauucauacggaggucccggcgagaaaauaacuaucuguaacgggaguacgauuguugaccaaaggcucggaagcgaacuuggcugcuauaccaucaaucgggugcgcuccuacaagcugugugagaacucugcaucggguaaaucaugcgagauugauagcaucccuguaaaguguaaacagggguucugcuugaagauaacacaggaaggacgaggccaugugaaguuaagucguggcacugagaucguccuggacgugugugauuccucuugcgaacuaaugauuccaaaagggaccggagacauccucguugauuguagcgguggccagcaacacuuucugcagaauaaccuuauugaccuggggugcccgaaugugcccuugcucggaaagauggccaucuaugucuguagaauguccaaccauccuaaaacaaccauggcguuccuguuuugguucucauuuggcuacgugauaacuugcauugcuugcaggguacuguucuaucucuuaaucgccauugguacaguugggaagaaacugaagcaguaccgggagcuuaagccacagaccuguaucgugugcgagaguguccccgugaaugcaaucgaugccgaaaugcacgaguugaacuguagcuauaauauuugcccuuacugugcuucucgccuguccacggacggacuaauaagacaugugacucaaugcccaaaaaggcgggaaaaggucgaggaaaccgagcucuuucugaaccuugagcgcauccccuggcugguucgaaaauugcuccaggugucagaaagcacaggcauggcacugaagagaaguuguuggaugauuacuuuacugauccuccuucugguaucuauauccccugugcagagcgccccagucggcaaagagagggcuauugaaaccuaccaggcccgggagacauauaccgggaucugcuuguucgugcuaggaucgguucuguuugcggugucuuggcucacgaaggcacugaucgaugguauuggcaauuccuucuuuccggggcuuucagucuguaaaacuugcaguaucggaagcauuaacggcuucgaaauagagucccacaaguguuacugcucucuguuuugcugucccuauugccgugccuguagcucagacaagaauacacaccgcaugcauuugaacgugugcaaaaagagaaaaauggguaguaauguaaugcucgcuguuuguaagaggaugugcuuccgggccaccaucgaggcauccaacaaagcucuguuaauucgaagcaucaucaacucuacuuucgugauuuguauacugauccuaacaauuugcgucgugucaaccagugccgucgauauggaaaaucucccugcggggaucugggagaaggaagaggaccugacgaacuuuugucaccaagaaugccaggugaccgagacagagugucuuugcccauacgaagccaugguuuugcgcaagccccuguuccucgacaauauugcaaaaggcaugaaaagccugcuuaacuccacuucucuggagaccucguugagcaucgaagcuccuuggggagccauaaaugugcaguccacauuuaagccaacuguaucagcugccaacaucgcacucaguuggucuagcgucgagcauagaggcaauaagauucugguguccgggaggucagagagcaucaugaaauuagaggaacggaccggaguuucuuggaaccuggguguggaagaugccuccgagaguaagacacuaaccgucagcgugauggaccucucucaaauguauucccccguauucgaauaccugucaggcgaucgccagguggaggaguggccgaaggcuacuugcacgggggacuguccugaaagaugcggauguacaaguucgaccugccuucacaaagaguggccccacagcaggaauuggcguuguaacccaacuuggugcuggggcguugguaccggguguacaugcuguggcuuggaugucaaggacuuuuucaccgauuauaugcuggugaaauggaagguggaauacauuaaaacugaggcgaucgucugcguugaacucacaucccaggagcggcaguguucucugauagaggcaggaacgcgauuuaauuuaggcccugugaccauuacucugagcgaacccagaaacgugcaacagaggcuuccacccgagaucguaacauugcauccuaagauugaagagggguucuuugaccucaugcacguccagaagauccugucagccaguaccgugugcaaacuacaguccugcacacauggaguuccaggugauuuccaaguguaccacgucggcaaucugcuccgcggggacaaggugaacggacauucuauacacaaaaucgaaccgcacuuuaauacuagcuggauguccugggauggcugugaccuggacuauuucugcaacaugggugauuggcccucauguaccuacacggggguuacccagcauaaccgggcugccuuuauuaauaugcuuaacaucgagacagacuauacuaagaccuuccacuuccauagcaaaagagugacagcacacggcgauacuccucaguuggaccugaaggccaggccagcuuacggagccggcgagguaaccgucuuaguggaaguggcagaucucgagcugcacacgaaaaagcuggaagucagugggcuuaagauugcgucuuugacaugcuccggauguuaugcuugcagcucgggcaucucauguaaaguucgcauacaugugaaugagcccgacgaguuuaccguacacgugcgaucuagugauccugacgucguggccgcagguuccagccucauggcccggaagauugaauuuggggcugauucuacuuuuaaagccuucagcuccaugccaaaggacucacugugcuuuuacaucguugagaaagauuauuguaguagcugcacagacgaugacacccagaagugugugaacacuaagcuagaccauccccaaucuauccugauugaacacaaaggaaccaucauuggcaagcagaaugauacaugcuccacgaaaaccucaugcuggcucgagagugucaaggguuucuuuuacggccugaaaaacaugcuuagcgggauauucggaaauguguuuuugggcaucuuccuguuuuuagcaccguucguucuccugauuuucuucuucuuuuucggguggcgucuucuguuuugucuaaagugcuguagaaggacucgcggacuccugaaguacaaacauuugaaggacgaagaggaggcuggcuauaaaaagaucauugaacggcugaacgguaaaaaggggaagucccaguuauucgauggagagagacucgccgacaggaaaaucgcggaacuguuuucuacaaagauacacaucggc

SEQ ID NO: 10442 - RNA, 3495 nt, Artificial Sequence
  derived and/or modified CDS sequence (opt3) from CCHVF(CCHVF 75024)__AB069671.1__Gn-NSm-Gc
agcgaggaauccggcgacgauugcaucucuagaacccagcugcucaggacagagacugccgaaauucacggggacaacuacggaggucccggcgauaagauaacgaucuguaaugggucaaccauuguggaccaacggcuuggaagugagaugggcugcuauacaaucaaccgcgucaagagcuucaagcugugugaaaauuccgcuacugguaaaucuugcgagauugauucgaucccuguuaagugucgacagggguacugcuugaaaauaacccaggagggacguggccaugugaaguuaucaagaggcagcgaaguagugcuggacgcaugugauaguuccugcgaggucaugaucccaaaggggacaggagacauucuaguggauuguucugguggccagcaacacuuucucaaagacaaccugaucgaucuugggugcccgagcauuccccuguugggaaagauggccaucuauauauguaggauguccaaucauccuaaaaccacuauggcguuccucuuuugguucucauuuggcuacguuauuacaugcauccugugcaaggcuauuuucuaucugcucaucaucguggguaccuuagggaaacgguuuaagcaguaccgcgaacugaagccacagacguguacuauuugcgagaccacacccgccaacgcaauagacgccgagaugcacgaucuuaauuguaguuauaacaucugcccuuacugugcuagcagauugacuucugacggacuggcaaggcaugucacccagugcccaaaacggaaggaaaaaguggaggaaacagagcuauaccucaaucuggaacgcauucccuggguaguucgaaaacuucugcaaguguccgagucaaccggcgucgccuugaaaagaagcaguuggcucaucgugcuguuagugcuguucgcuauaucucucuccccuguccagagcgccccaauuggccacgggaagacgaucgagacuuaucaggcgagggaagaguacacaucgaucugucuuuuuguucugggaucuauuuuguucaucguguccugccuaaugaaaggucugguagacucaauuggcaacauauuuuucccggggcucaguaucuguaagaccugcagcauuggauccaucaauggcuuugaaaucgagucucacaaguguuauugcagccugcuuugcugucccuacugccggcauuguucagcagaucgugaaauucaccagcugcauuugaguauaugcaaaaagcgcaaaacugguuccaacgugaugcucgccgucuguaagagaaugugcuucagggcuacaauggaggugagcaauaaagcccuguuaauccggucuauuaucaacaccacguucguuguguguauucugauccuagcagucugcgugguaucaaccagugcuguugagauggaaagccucccugccgggacaugggagcgagaagaggaccugacuaauuuuugucaccaagaaugccaggugaccgagacagagugucuuugcccauaugaagcguugguccugcgcagaccccucuuccuggauuccauagugaggggcaugaagaaccagcuuaacucuacuucgcuggagaccagcuuguccaucgaagccccuuggggagcaauuaauguccaaucaacauacaagccaaccgugaguacugcuaacaucgcccucucuuggagcuccguugagcaccggggcaauaaaauucuggugucagggcgcagcgagucuaucaugaaguuagaagagagaacgggaauauccugggaccuggguguagaagaugcuagugagagcaaacuacucacagucucugugauggaccugucccagauguauucacccguuuuugaauaccuuaguggcgaucgucagguggaggaguggccgaaggcaaccugcacuggggacuguccugaaaggugcggauguaccacaucgaccugcuugcauaaagaguggccccacagccggaacuggcgauguaauccaacuuggugcuggggcgucgguacaggguguacgugcuguggccuggaugugaaggaccucuucaccgauuacaugauuguaaaguggaaaguggaauauaucaagacugaggccauuguuugcgucgaacugacaucccaggagagacaauguucuuuaaucgaggccggaaccagguuuaaccugggcagcgugacaauaacucuuucagaaccucgcaauauccagcagaaauugcccccagagauuaucacccuccauccccggauugaagagggguucuuugaccugaugcacgugcagaagguccuaagugcuuccacgguuugcaaacugcaaucuugcacccauggagugccuggugaccuccagguguaccacguaggcaaccugcuuaagggggauaaggucaauggacacuugauccauaaaauagaaccacaccugaacacaagcuggauguccugggacggcugugauuuagacuauuacugcaauaugggugauuggccgucauguacuuauaccggggugacacagcauaaccacgcgagcuucguuaaucuccugaacauugagacugacuacaccaagaguuuucacuuccauucuaaaagagugacggcacacggcgauacaccccagcuugaccugaaggccaggccuaccuauggagcuggcgagaucacugucuugguggaaguugccgauauggaguuuacaccaaagaagaucgaaauuuccgggcucaaauucgcaagccugaccugcacuggauguuacgccugcucgucaggcaucucuuguaaggugcgcauucauguagacgagcccgaugagcuaaccguccacgugaagagugacgauccugacguggucgcugccuccagcucucugauggcacgaaaacucgaauuugguacagacagcacguucaaggcguucuccgcuaugccaaaaaccucacugugcuuuuacauaguugagcgggaauauuguaagaguugcagcaaagaggauacucaaaagugugugaauacaaaacuugaacagccccagucuaucuugauugagcauaaagggaccaucauuggaaagcagaacaacacaugcacugccaaagcauccugcuggcuggagucaguaaagaguuucuuuuacggccucaaaaauauguuaagcgguaucuucggcaaccuguuuauggggauauuccuuuuucuggccccguucauccuacucauucuguuuuucauguuuggauggcguaucuuguucuguuuuaagugcuguagaaggacccgcggccuguucaaguaucggcacuuaaaagacgaugaagagacgggguacagaaggauuaucgaacgacucaauaacaagaaaggaaagaauaaacugcuugacggcgagcgccuggcugaucggagaauagccgaauuguucuccacaaagacccacauuggu

SEQ ID NO: 10443 - RNA, 3495 nt, Artificial Sequence
  derived and/or modified CDS sequence (opt3) from CCHVF(CCHVF 7803)__AB069672.1__Gn-NSm-Gc
agcgaggaauccggcgacgauugcaucucuagaacccagcugcucaggacagagacugccgaaauucacggggacaacuacggaggucccggcgauaagauaacgaucuguaaugggucaaccauuguggaccaacggcuuggaagugagaugggcugcuauacaaucaaccgcgucaagagcuucaagcugugugaaaauuccgcuacugguaaaucuugcgagauugauucgaucccuguuaagugucgacagggguacugcuugaaaauaacccaggagggacguggccaugugaaguuaucaagaggcagcgaaguaauccuggacgcaugugauaguuccugcgaggugaugauuccaaaggggacaggagacauccuagucgauuguucugguggccagcaacacuuucucaaagacaaccugauugaucuugggugcccgagcaucccccuguugggaaagauggccauauauauuuguaggauguccaaucauccuaaaaccacuauggcguuccucuuuugguucucauuuggcuacgugaucacaugcauucugugcaaggcuaucuucuaucugcucaucauuguugguaccuuagggaaacgguuuaagcaguaccgcgaacugaagccacagacguguacuauaugcgagaccacacccgccaacgcaaucgacgccgagaugcacgaucuuaauuguaguuauaacauuugcccuuacugugcuagcagauugacuucugacggacuggcaaggcaugugacccagugcccaaaacggaaggaaaaagucgaggaaacagagcuauaccucaaucuggaacgcauccccugggugguacgaaaacuucugcaaguuuccgagucaaccggcguggccuugaaaagaagcaguuggcucauaguccuguuagugcuguucgcuauuucucucuccccugugcagagcgccccaaucucgcacggcaagacgaucgagacuuaucaggcgagggaagaguacacaucuauuugucuuuuuguccugggguccaucuuguucauuguuucaugccuaaugaaaggacugguggacaguauagguaacaucuuuuucccgggccucagcauuuguaagaccugcuccaucgggucuaucaauggauuugaaauugagagccacaaguguuauugcucacugcuuugcugucccuacugccggcauuguagugcagaucgugaaauacaccagcugcauuuguccaucugcaaaaagcgcaaaacuggcagcaacguaaugcucgccgcuuguaagagaaugugcuucagggccacaauggaggugucuaauaaagcacuguuaauucggucaaucauuaacaccacguucgucguguauauccugauacuagcuguuuguguggucaguaccagcgccguggagauggaaucccucccugcggguacaugggagcgagaagaggaccugacuaauuuuugccaccaagaaugucagguaaccgagacagagugccuuuguccauacgaagccuugguucugcgcagaccccucuuccuggauucuaucgugagggggaugaagaacccucuuaacucgacuagccuggagaccuccuugucaauugaagcaccauggggcgcuaucaauguccagaguacauauaagcccaccgugucuacugccaacauugcucucagcugguccucagucgagcaccggggaaauaaaauccuggugagcggccgcucugaguccauaaugaaguuagaagagagaacggggauuaguugggaccugggaguugaagaugccagcgagucuaaacuacucacaguguccguaauggaccugucacaaauguacaguccggucuuugaauaccuuagcggugauagacagguggaggaguggccuaaggcaaccugcacuggcgacugccccgaacguugugggugcaccacaucgaccuguuugcauaaagaguggccacacucccggaacuggcgaugcaauccuacuugguguuggggaguuggcacagguugcacguguugcgggcuggaugugaaggaccucuucaccgauuauaugaucgucaaguggaaaguggaauacauuaagacuagaggcaucguauguguggagcugacaucucaggaaaggcagugcagcuuaauagaggccggaacccgcuuuaaccugggcucaguuacaaucacucuuagugagccccggaauauucaacagaaauugccacccgaaaucauuacccuccauccuagaaucgaggaaggguucuuugaccugaugcacguccagaaggugcuauccgcuucuacgguguguaaacugcagagcugcacccauggagucccaggugaccuccaaguuuaucacgugggcaaccugcuuaagggggauaaggugaauggacacuugauacauaaaauugagccgcaccugaacacauccuggaugucaugggacggcugcgauuuagacuacuauuguaauaugggugauuggcccagcugcacuuacaccgggguaacacagcauaaccacgcgaguuucgucaaucuccugaacaucgaaacugacuauaccaagucuuuucacuuccauuccaaaagggugacggcacacggcgauacaccucagcuugaccugaaggcccgcccaaccuacggagcuggcgagaucacuguuuugguggaggucgccgauauggaauuuacacccaaaaagauugagaucagcgggcucaaauucgcaucgcugaccuguacuggaugcuacgccuguucaucuggcauuaguugcaaggugcgaauacauguugacgaaccugaugagcuaaccgugcacguaaaguccgacgauccagacgucguggcugccagcucuagccugauggcacggaaacucgaguuugguacagacuccacguucaaggcguucucagcuaugcccaaaaccagucuguguuuuuauaucguggaacgugaguacugcaagagcuguucuaaagaagauacucagaagugcgucaauacaaaacuugagcaaccgcaguccauuuugaucgaacauaaagggaccauuaucggaaagcagaacaacacauguacugccaaagcaucaugcuggcuggagaguguuaagagcuucuuuuauggcuuaaagaauaugcucuccgguauauucggcaacuuuuucauggggaucuuucuguuccuugccccuuuuauucugcuaauccucuucuuuauguucggauggaggauucuguuuugcuucaaguguugcaggcgcacccggggcuuguucaaguacagacaccugaaagacgaugaggaaacgggguauaggcgaaucauagagcgcuuaaauaacaagaaaggaaagaauaaacuccuggacggcgaacggcuugcugauagaaggauugccgagcuguuuucuacaaagacccacaucggu

SEQ ID NO: 10444 - RNA, 3495 nt, Artificial Sequence
  derived and/or modified CDS sequence (opt3) from CCHVF(CCHVF 79121)__AB069673.1__Gn-NSm-Gc
gccgagggcgggagcuccgacugcaucucuagaacccagcuggugaagacagaagucgcugagauucacgaagauucauacggaggucccggcgagaaaauaacuaucuguaacgggaguacgauuguugaccaaggacucggcagcgaacuugguugcuauaccaucaauagggugcgguccuacaagcugugugagaacucugcaucggggaaaucaugcgagauugauagcaucccuguaaaguguaaacagggauucugcuugaagauaacacaggaaggccgcggccaugugaaguuaagucgagggacugagaucguccuggacgugugugauuccucuugcgaacuaaugauuccaaaaggaaccggugacauccucguugauuguagcggcgggcagcaacacuuucugcagaauaaccuuauugaccugggaugcccgaaugugcccuugcucggcaagauggccaucuaugucugucguauguccaaccauccuaaaacaaccauggcguuccuguuuugguucucauuugguuacgugauaacuugcauugcuugcagaguacuguucuaucucuuaaucgccauugggacaguuggaaagaaacugaagcaguacagggagcuuaagccacagaccuguaucgugugcgagaguguccccgugaaugcaaucgaugccgaaaugcacgaguugaacuguagcuauaauauuugcccuuacugugcuucucggcuguccacggacggccuaauacgccaugugacucaaugcccaaaaagaagggaaaaggucgaggaaaccgagcucuuucugaaccuugagcggauccccuggcugguucgcaaauugcuccaggugucagaaagcacaggcauggcacugaagcgaaguuguuggaugauuacuuuacugauccuccuucugguaucuauauccccugugcagagcgccccagucgggaaagagagagcuauugaaaccuaccaggccagggagacauauaccggaaucugcuuguucgugcuagguucgguucuguuugcggugucuuggcucacgaaggcacugaucgauggcauuggaaauuccuucucaccggggcuuagugucuguaaaacuugcagcaucggcuccauuaacgguuuugaaauagagucucacaaguguuacugcagccuguucugcugucccuauugccgggccuguucaagugacaagaauacacaccguaugcauuugaacgugugcaaaaagcgcaaaaugggguccaauguaaugcucgcuguuuguaagagaaugugcuuuagggccaccaucgaggcaagcaacaaagcucuguuaauucggucuaucaucaacucaacuuucgugauuuguauacugauccuaacaauuugcgucgugaguaccagcgccgucgauauggaaaaucucccugcgggcaucugggagaaggaagaggaccugacgaacuucugucaccaagaaugccaggugaccgagacagagugucuuugcccauacgaagccaugguuuugcgaaagccccuguuucucgacuccacugcaaaaggaaugaagucucugcuuaauucgaccagccuggagacauccuugucaauugaagcuccuuggggcgccaucaacgugcagaguacuuucaaaccaaccguaucugcugccaauauagcacucagcugguccucagucgagcaucgcgggaacaagauccuggugagcggaagaucugaguccauuaugaaauuagaagagaggacagguguuaguuggaaucugggcguggaagaugccagcgagucuaagacccuaacugucuccgugauggaccucucacaaauguauagucccguauuugaauaccugagcggggaucgccagguggaggaguggccgaaggcuacgugcacaggagacuguccugaacggugcggcuguaccucguccacuugccuucacaaagaguggccccacucuagaaacuggagguguaauccaaccuggugcugggguguugggacaggcuguaccugcuguggauuggaugucaaggacuucuuuacugauuauaugcuggugaaauggaagguggaauacaucaaaacagaggcgauugucugcguugaacucacgagccaggagcgucaguguucacugaucgaggcaggcacccgguucaacuuagggccugugacuauaacacugagugaaccccgaaaugugcaacagagacuuccacccgagauuguaaccuugcauccuaagaucgaagagggauuuuucgaccucaugcacguccagaagauucuguccgccucuacagugugcaaacuacagagcugcacucaugguguuccaggcgauuuucaaaucuaccacguggggaaccugcucaggggagacaaggucaauggccauuccauacacaaaaucgaaccgcacuucaacaccucauggaugagcugggaugguugugaccuggacuauuuuugcaauaugggggauuggcccaguuguacguacaccggcgugacacagcauaaccgcgcugccuucauuaacaugcuuaauaucgagacugacuauaccaagacauuucacuuccauucuaaacggguuacugcacacggagauaccccucaguuggaccugaaggccagaccagcuuacggcgccggggaggugacgguauuagucgaaguggcagaucucgagcugcacaccaaaaaccuugaaguguccggacugaagauugcgagcuugacaugcucgggcuguuaugcuugcucaucugguaucaguuguaaggucaggauacauguuaaugagcccgacgaguucacugugcacguacgcuccagcgauccugacguggucgccgcagggucuagccucauggcccgaaaaauugaauuuggagcugauuccacauucaaggccuuuucaaguaugccaaaagacagccugugcuucuacaucguggagaaggauuauuguucuuccugcaccgacgaugacacucagaaauguguuaacaccaagcuagaccauccccaaucaauccugauugaacacaagggcacaaucauugguaaacagaaugauacgugcaguaccaagacuagcugcuggcucgaguccgugaaaggcuuuuucuacgggcugaagaacaugcuuucuggaauauuuggcaaugucuucuuggggaucuuucuguucuuagcaccguuugugcuccugauuuucuuuuucuucuuuggauggcggcuucuguucugucuaaaaugcugucguagaacaaggggccuccugaaguacaagcauuugaaagacgaagaggaggcugguuauaagaaaaucauugaacgccugaacgggaagaaaggaaagucgcaguuauuugauggcgagcggcucgccgacagaaagaucgcggaacuguucagcaccaaaauacacaucggu

SEQ ID NO: 10445 - RNA, 3495 nt, Artificial Sequence
  derived and/or modified CDS sequence (opt3) from CCHVF(CCHVF 8402)__AB069674.1__Gn-NSm-Gc
agcgaggaauccggcgacgauugcaucucuagaacccagcugcucaggacagagacugccgaaauucacaacgacaauuacgggggacccggugauaagauaacgaucuguaacggcucaaccguggucgaccaacggcuugggagugagcugggaugcuauacaauuaaucgcguuaaaucuuucaaguugugugaaaacuccgcuacuggcaaaucuugcgagaucgauucgaccccugugaagugucgacaggguuuuugcuuaaaaauuacacaggaggggcguggacauguaaagcugucaagaggcagcgaagugguccuagacgcaugugauaguuccugcgagaucaugauaccaaagggcaccggggacauccucguggauuguucuggaggucagcaacacuuccugaaagacaaucuuauugaucugggcugcccgaacauccccuugcucgggaagauggccauuuacaucuguaggaugagcaaucauccuaaaacuacaauggcguuucuguucugguuuuccuucggauauguugugaccugcauacugugcaaggucaucuuuuaccucuuaauugugguaggcacgcuggguaaaaaguucaagcaguaucgggaacuuaaaccacagacuuguaccauuugcgagacaacucccguuaacgcuaucgacgccgagaugcacgauuugaauuguucauacaacaucugcccuuauugugcaagucgccugaccagcgacgggcuagccagacaugugaugcagugcccaaagaggaaagaaaagauugaggaaacagagcucuaccugaaucuugaacggauacccugggucgugcgcaaacuguugcaagugucugaguccaccggagucgcucucaagcgaucaagcuggcugguuguguuacugguacuccuuacggugagucugucuccuguccaguccgcaccaaucggccacggcaaaacuguggagacauaccagaccagagaaggguauacuagcauuuguuuguuuguucuaggaucgauccuguucauagugucuugccucaugaagggucuggucgacuccgugggcaacucauuuuucccggggcuuaguauuuguaagacaugcagcaucggauccguaaauggcuuugagaucgaaucucacaaauguuacugcagccuguucugcugucccuauugcaggcauuguucagccgaucgggagauucaccguuugcaucucaguaucugcaagaaacgcaagaccgguuccaacguuaugcuggcuguguguaaaagaaugugcuucagggccacggucgaagugagcaauaaggcguuacugauucggaacauaaucaacaccacauuuguccuauguauucucauccuggcagugugcguugugucuacuucagccguagagauggagagucuuccugcugggaccugggaacgagaggaagacuugacaaauuucugucaccaggagugccaagucacugaaaccgagugucugugcccauacgaggcccucgugcugcgcaagccccuuuuuagcgauuccaucguuaaaggcaugaagaaccuguugaauagcacaucgcucgaaaccagccuguccauugaggcaccuuggggagcuauaaacgugcagucaacuuucaaaccaacggucagugccgcgaauaucgccuuaucuuggagcuccguggaacacagaggcaacaagauucugguaucagggaggagcgagucuaucaugaaacuagaggaacggacaggaauuuccugggaccucgguguggaggaugcaagugaaagcaagcugcuuaccguuucugucauggacuugucccagauguauucacccguguuugaguaccugaguggcgaucgccaaguggaagaguggccgaaggcuacuugcaccggggacuguccugagagaugcggauguacaagcucgaccugccuccauaaagaauggccccacuccaggaauuggcguuguaacccaacuuggugcuggggcgucgguacaggguguacgugcuguggccuggauguuaaggacuuauucaccgauuauauguuuaucaaauggaagguggaguacauaaaaacugaagccaucgugugcguagagcugacaucucaggaacggcaguguacccuuauugaggcuggaacacgauucaauuugggcccugucacuaucacccucagcgagcccagaaacauucagcaaaagcugccacccgaaaucgugacgcuacauccuaggauagaggaaggguuuuucgaccugaugcacguucagaaggugcucucagccaguaccgucugcaaacugcaguccugcacacauggagugccaggugaccuucagguuuaccacauuggcaauuugcugaagggggauaaagugaacggacacuuaauccauaagauugagccgcacuuuaauacuucuuggaugagcugggacggcugugaucucgacuauuacugcaacaugggugauuggcccuccuguaccuauacagggguaacucaacauaaucacgcagccuucgucaacaugcugaacaucgaaaccgacuacacgaaaaauuuucacuuccauucaaagcgcgugacagcucacggcgauaccccucagcuugaccugaaagcgcggccaacuuauggagcaggcgagauaacaguguuggucgagguugccgauauggaacuccauaccaagaagaucgagauuagcgggcugaaauucgcuagucuaacuugcaccggauguuacgccuguucuuccggcaucagcugcaaggugagaauccacguagacgaacccgaugagcugacagugcaugucaaaucggaggacccugauauuguggcagccucaucuagucucauggcuaggaagcuggaauuugguacggacuccaccuucaaagccuuuagcgcaaugccaaagacuucucuuugcuucuauauaguugagcgcgaauacuguaagagcugcuccaaagaggacacacagaagugugugaacaccaaauuggaacagccccaaucaauucugaucgagcacaaggggacaaucauuggaaaacagaguaauacuugcaccgcgaaggcuagcugcugguuagagucugucaaguccuuuuucuacggccucaaaaacaugcugucagguaucuuuggcaauguguucauugggguuuuucuuuucuuugccccguucauacugcuaauccucuuuuucauguucggauggcggauucuguuuuguuucaagugcugucgacguacgagaggcuuguuuaaauauaggcaccugaaggaugacgaagagacaggguaccgcaaaaucauugaacgguuaaacaauaagaagggcaaaaacaagcuccuggauggagagagacuugcagacaggaaaaucgccgaacuguucaguaccaagacucauauaggu

SEQ ID NO: 10446 - RNA, 3495 nt, Artificial Sequence
  derived and/or modified CDS sequence (opt3) from CCHVF(CCHVF 88166)__AB069675.1__Gn-NSm-Gc
agcgaggaauccggcgacgauugcaucucuagaacccagcugcucaggacagagacugccgaaauucacucagacaacuacgggggacccggugauaagauaacgaucuguaauggcaguaccguggucgaccaacggcuugggagcgagcugggaugcuauacaauuaaccgcguuaaauccuucaaguugugugaaaauucugcuacuggcaaaucgugcgagaucgauucaaccccugugaagugucgacaggguuuuugcuuaaaaauuacacaggaggggcguggacauguaaagcugagcagaggcagugaagugguccuagacgcaugugauuccucuugcgagaucaugauaccaaagggcaccggggacauccucguggauuguagcggaggucagcaacacuuccugaaagacaaccuuauugaucugggcugcccgaauauccccuugcucgggaagauggccauuuacaucuguaggauguccaaccauccuaaaacuacaaugggauuucuguucugguuuucauucggcuauguugugaccugcauacugugcaaggucaucuuuuaccucuuaauugugguagguacgcuggggaaaaaguucaagcaguaucgggaacuuaaaccacagacuuguaccauuugcgagacaacucccguuaaugcgaucgacgcugagaugcacgauuugaacuguaguuacaauaucugcccuuauugugccagccgccugaccucugacggacuagcaagacaugugaugcagugcccaaagaggaaagaaaagauugaggaaacagagcucuaccugaaccuugaacggauacccugggucgugcgcaaacuguugcaaguguccgagucaaccggcgucgcccucaagcgaagcaguuggcugguuguguuacugguacuccuuacggugucucuguccccuguccagagcgcuccaaucggccacgggaaaacuguggagacauaccagaccagagaaggauauacuucgauuuguuuguuuguucuagguucuauccuguucauaguguccugccucaugaagggccuggucgacucaguggggaauaguuucuuuccgggacuuagcauuuguaagacaugcuccaucggcucuguaaacgguuuugagaucgaaagccacaaauguuacugcucacuguucugcugucccuauugcaggcauuguagugcagaucgggagauucaccguuugcaucucuccaucugcaagaaacgcaagaccuggagcaauguuaugcuggccguguguaaaagaaugugcuucagggcuacggucgaagugucuaacaaggccuuacugauucggaauauaaucaacaccacauuuguccuauguauucucauccuggcggugugcguugugucaacuuccgcaguagagauggagagccuuccugccgggaccugggaacgagaggaagacuugacaaacuucugucaccaggagugccaagucacugaaaccgagugucugugcccauacgaggcucucgugcugcgcaagccccuguuuuccgauucuaucguuaaaggcaugaagaaucuuuugaacucgacaagccucgaaaccucccugucaauugaggccccuuggggagcaauaaaugugcagaguacuuucaaaccaacgaugucugcugccaacaucgcguuaagcugguccucagucgaacacagaggcaauaagauucuggugagcgggaggucugaguccaucaugaaacuagaggaacggacaggaauuaguuggaaccucgguguagaggacgccagcgaaucuaagcugcuuaccguguccguuauggauuugucacagauguauagucccgucuuugaguaccugagcggcgaccgccaaguggaagaguggccgaaggcaacuugcaccggggauuguccugagagaugcggauguacaucgaguaccugccuccauaaagaauggccccacucuaggaauuggcguuguaacccaacuuggugcuggggcguggguacaggguguacgugcuguggccuggacgucaaggauuuauucaccgacuauauguuuaucaaauggaagguugaguacauaaaaacugaagcuaucgugugcguggagcugacaagccaggaacggcaguguacccuuauugaggccggaacacgauucaauuugggcccuguaacuaucacccucucagagcccagaaacauucagcaaaagcugccacccgaaaucgucacgcuacauccuaggauagaggaaggguuuuucgaucugaugcacgugcagaagguucucagugcuuccaccgugugcaaacugcagucuugcacacauggagucccaggugaccuucagguguaccacauuggcaauuugcugaagggggacaaaguuaacggacacuuaauccauaagauugagccgcacuuuaauacuagcuggauguccugggauggcugugaccucgauuauuacugcaacaugggugacuggcccucauguaccuauacaggggugacucaacauaaucacgccgcauucguaaacaugcugaacaucgaaaccgauuacacgaaaaauuuucacuuccauagcaagcgcgucacagcccacggcgacaccccucagcuugaucugaaagcucggccaacuuauggagcgggcgagauaacaguguugguggaggucgcagacauggaacuccauaccaagaagaucgagauuagugggcugaaauucgccucucuaacuugcaccggauguuacgcuugcuccagcggcaucucguguaagguuaggauucacguggaugaacccgacgagcugacaguacaugugaaaucagaggauccugaccucgucgccgcaucuaguucccugauggccagaaaacuugaauuugguacggauagcaccuucaaggcuuuuucugccaugccaaagacuagcuugugcuucuauaucguggagcgcgaauacuguaaguccugcucaaaagaggacacacagaaguguguuaacaccaaacuggaacagccccaaaguauauuaauugagcacaaggggacaaucaucggaaaacagaauaacacuugcaccgcaaaggcgagcugcuggcucgagucugugaaguccuuuuucuacggccugaaaaauaugcuuucagguauuuuuggcaacgucuucaucgggguguuucuguucuuugcuccguucauucuacucauacuguuuuucauguucggauggcgaaucuuguuuuguuucaagugcugucggcguacgagaggccuguuuaaauauaggcacuuaaaggacgaugaagagacaggguaccgcaaaauuaucgaacggcucaauaacaagaagggcaaaaauaagcugcuugacggagagagacuggccgauaggaaaauugcagaauuguucaguaccaagacucauaucggu

SEQ ID NO: 10447 - RNA, 3495 nt, Artificial Sequence
  derived and/or modified CDS sequence (opt3) from CCHVF(CCHVF BA88166)__AF338470.1__Gn-NSm-Gc
agcgaggaauccggcgacgauugcaucucuagaacccagcugcucaggacagagacugccgaaauucacucagacaacuacgggggacccggugauaagauaacgaucuguaauggcaguaccguggucgaccaacggcuugggagcgagcugggaugcuauacaauuaaccgcguuaaauccuucaaguugugugaaaauucugcuacuggcaaaucgugcgagaucgauucaaccccugugaagugucgacaggguuuuugcuuaaaaauuacacaggaggggcguggacauguaaagcugagcagaggcagugaagugguccuagacgcaugugauuccucuugcgagaucaugauaccaaagggcaccggggacauccucguggauuguagcggaggucagcaacacuuccugaaagacaaccuuauugaucugggcugcccgaauauccccuugcucgggaagauggccauuuacaucuguaggauguccaaccauccuaaaacuacaaugggauuucuguucugguuuucauucggcuauguugugaccugcauacugugcaaggguauuuucuaccucuuaaucgucguggggacgcugggaaagaaguucaagcaguaucgggaacuuaaaccacagacuuguaccauuugcgagacaacucccguaaaugcgaucgacgcugagaugcacgauuugaacuguaguuacaauaucugcccuuauugugccagccgccugaccucugacggccuagcaagacauguuaugcagugcccaaagaggaaagaaaagauugaggaaacagagcucuaccugaaccuugaacggauacccugggugguccgcaaacuguugcaaguguccgagucaaccggcguggcccucaagcgaagcaguuggcuggucguuuuacuggugcuccuuacgguaucucuguccccugugcagagcgcuccaaucgggcacggaaaaacugucgagacauaccagaccagagaagguuauacuucgauuuguuuguuugugcuaggcucuauccuguucauaguuuccugccucaugaaggggcugguggacucagucggaaauagcuuuuucccgggccuuaguauuuguaagacaugcuccaucgguucugugaacggguuugagaucgaaagccacaaauguuacugcucacuguucugcugucccuauugcaggcauuguagugcagaucgggagauucaccguuugcaucucuccaucugcaagaaacgcaagaccuggagcaauguaaugcuggccguuuguaaaagaaugugcuucagggcuacgguggaagucucuaacaaggccuuacugauucggaauauaaucaacaccacauuugugcuauguauucucauccuggcggucugcgugguuucaaccagugcaguggagauggagagccuuccugccggcacuugggaacgagaggaagacuugacaaacuucugucaccaggagugccaaguaacugaaaccgagugucugugcccauacgaggcucucguccugcgcaagccccuuuaucuggauuccaucgugaaaggaaugaagaauuugcucaacucuacaucgcuggaaaccagcuuauccauugaggccccuuggggcgcaauaaauguucagucaacuuuuaaaccaacgaugagugcugccaacaucgcgcugucuuggagcuccguggaacacagagggaauaagauucuagucucaggaaggagcgagucuaucaugaaacucgaggaacggacagguauuuccuggaaccugggcguggaggacgccagugaaagcaaacuuuugaccguaucugugauggaucugucccagauguacucacccguuuucgaguaucucaguggggaccgccaagucgaagaguggccgaaggcaacuugcaccggagauuguccugagagaugcggcuguacaagcucgaccugccugcauaaagaauggccccacuccaggaauuggcguuguaacccaacuuggugcugggguguggggacaggcuguacgugcuguggauuagacgugaaggaucuguuuaccgacuacauguucaucaaauggaaggucgaguacauaaaaacugaagcuaucguuugcguggagcuuacaucucaggaacggcaguguaccuugauugaggccggcacacgauuuaaucucgggccugugaucauuacucugagcgagcccagaaacauccagcaaaagcuaccacccgaaauaguaacccugcauccuaggauugaggaaggauucuuugaucucaugcacguccagaaggugcugucagcuaguacgguuugcaaacuucaguccugcacccauggugugccaggcgacuugcaggucuaucacaucgggaaucuguuaaagggagacaaagugaacggccaccucauucauaagaucgagccgcacuucaauacaucuuggaugagcugggaugguugugaccuggauuacuauugcaacaugggggacuggcccuccuguacuuacaccggcguuacacaacauaaucacgccgcauuugugaacaugcuuaacauagaaacugauuauaccaaaaauuuccacuuucauucaaagcgcguaacggcccacggagacacaccucagcuggauuugaaagcucggccaaccuacggcgcgggggagaucacuguccucguggagguggcagacauggaacugcauacaaagaagauugagaucagcggacuaaaauucgccagucugaccugcacuggcuguuaugcuuguucuuccgguauuagcugcaaggucagaauccacguugaugaacccgacgagcucaccgugcauguaaaaucggaggauccugacauaguggccgcaucaucuagucugauggccaggaaacuugaauuugggacagauuccacguuuaaggcuuucagcgccaugccaaagaccucuuugugcuuuuacauugucgagcgcgaauacuguaagagcugcuccaaagaggacacucagaagugugugaacacaaaacuggaacagccccaaucaaucuuaaucgagcacaagggaaccauuaucggcaaacagaauaacacaugcacugcaaaggcgaguugcuggcucgagagcguuaagucuuucuuuuauggucugaaaaauaugcuuuccggcauuuucgggaacguguuuauaggagucuuccuguuuuucgcuccguuuauccuacucauucuguucuuuauguucggcuggcgaaucuuguucuguuuuaagugcugucggcguaccagagggcuguucaaauacaggcacuuaaaggacgaugaagagacgggauaucgcaaaauuaucgaacggcucaauaacaagaagggcaaaaauaagcugcuugacggugagagacuggccgauaggaaaauagcagaauuguuuucaacaaagacccauaucggg

SEQ ID NO: 10448 - RNA, 3495 nt, Artificial Sequence
  derived and/or modified CDS sequence (opt3) from CCHVF(CCHVF BA66019)__AF350448.1__Gn-NSm-Gc
agcgaggaauccggcgacgauugcaucucuagaacccagcugcucaggacagagacugccgaagugcacggggacaacuacggaggucccggcgauaagauuacgauauguaaugggucaaccaucgucgaccaacggcuuggaagugagcugggcugcuauacaauuaaccgcguuaagagcuucaaguugugugaaaauuccgguacugggaaaucuugcaagaucgauaaacauccugugaagugucgacagggauuuugcuuaaagauuacccaggagggccguggccacguaaaacugucgagagggucagaggugguccuagacgcuugugauagcaguugcgaaaucaugauaccaaagggaacaggugacauccucguggauuguuccggcgggcagcaacauuuccugaaagacaaccuuguugaucugggaugcccgaauauucccuugcucggcaagauggcaaucuacauuuguaggaugucuaaccacccuaaaaccacuauggccuuucuguucugguuuagcuucgguuaugugaucacaugcauauuuugcaagauuaucuucuaccugcucauugucguggggaccuuaggaaagaaauuuaagcaguaucgggagcugaaaccacagacguguacuaucugcgaaaccacacccacuaaugcgaucgacgcugagaugcaugaucuuaaguguuccuacaacauuugcccuuauugugccucacgcuugaccagugacggccuggcaagacacguaacacagugcccaaaaaggaaggagaaaguugaagagaccgaacuauaccucaaucuggagcggauacccuggaucgugcgcaaacuucugcaagucagcgaaucuacgggcguggccuugaagcgauccucauggcucauugugcuguuaguccugcucacuguuagccuuaguccugugcagucugcuccaaucgggcacggaaaaacaauagaggcauaccagaccagagaggguuauacuuccguaugucuguucauguugggcgggauucuauuuguggucagcugccugaugaagggacucguggacucgguuucuaacuccuucuuuccgggccugucaaucuguaaaacaugcaguaucgguagcgugaauggguucgaaauugagucccauaaguguuacugcucucuucugugcuguuuguauugcaggcacuguagcgccgaucgggaaauccaucagcuccaccugucaauuugcaaaaagcgucgcgcuggcggaaacgucauguuagccguguguaagagaaugugccugagggcgaccauggagguaaguaauaaaguucuauucauacgguccaucauuaacacgaccuuugugaucuguauccucguccuggcagugugcauugucagcacaucugccguggaaauggagucacuucccgcuggcacuugggagcgagaagaggacuugaccaauuucugucaccaagaaugccagguuacagagacugaaugucugugcccuuacgaggcccucgugcugcgcaagccacuuuuuagugauagcauaguaaaagggaugaagaaccuguugaacuccaccucucucgagacaucgcugagcaucgaagcacccuggggagcuauuaauguccaguccaccuucaaaccuacugugucaacggccaacaucgcguuaaguuggucuagcguugagcauagagguaauaagauucugguguccggcaggucagaaagcaucaugaagcuagaggagcggacagggauaucuugggaccucggagucgaagaugccuccgagaguaaacugcuuaccgugagcguaauggacuugucucaaauguauuccccaguguuugaauaccugucaggcgaucgccagguugaggaauggcccaaggcaacuugcaccggugacuguccggauagaugcggguguacaaguucuaccugccuccacaaagaguggccucauucgaggaacuggcguuguaaucccacuuggugcuggggcgucggaacaggcuguacgugcugugggcuggacgugaaggauuuauucaccgacuauauguuugugaaauggaaggucgaguacaucaagacugaagcuauuguuugcguggagcugaacucccaggaacggcaguguucucuuaucgaggccggaacacgauucaauuuggguccagugaccauuacacucagcgaaccuagaaacauccaacagaaacugcccccagagauaauuacucuacaccccaggaucgaggaaggcuuuuucgaccugaugcauguacagaagguccucucagcuaguaccgugugcaaacugcaguccugcacgcacgggguuccuggagaucuucaaauuuaccacaucggcaauuugcugaagggugaccgcgugaacgggcauuuaauacacaaaaucgagccacauuuuaauaccucuuggaugagcugggauggcugugaccucgauuauuacugcaacaugggagacuggccguccuguacauauacuggcgucacccagcacaaucacgccgcauucgugaaccugcuuaauauugaaacagauuacacuaagaacuuucauuuccacucaaaacggguuaccgcccauggggacacgccccagcuggauuugaaggcuagaccuacauauggagcgggcgagaucaccgugcucguagaagucgcagacauggagcugcacacuaagaaaauugccaucagcggucuaaaguucgcuagucugacaugcaccggguguuacgccuguucuuccggaauaagcugcaaagugaggauucauguggaugagccagacgaacucacuguccacguuaagucggaggaucccgacaucguggcagccucaucuagucugauggcucgcaaacuugaauuuggcaccgacuccacauucaaggccuuuagcgcaaugccuaagacgucuuugugcuucuauaucguagagcgagaguacugugaaagcugcuccaaagaggauacccagaagugugugaacacuaaacuggaacaaccacagucaauuuuaaucgagcacaaggguacaauuauaggcaaacagaaugauaccugcacagcgaaggcuaguugcuggcucgaaagcgucaagagcuuuuucuacgggcugaaaaacaugcuuuccggaaucuuuggcaauguguucauugggaucuuucuguuccuagcccccuuuauucuccugaucuuguucuuuauguucggauggcggauacuguucuguuuuaagugcugucguagaacuaggggcuuauucaaauaucgcuaccucaaggacgacgaggagucagguuaucggagaaucauugaaaggcugaacaauaaaaaggggaagaacaaacuucuggauggagagcgauuggcagaccgccggaucgccgaacucuuuaguaccaagacgcauauuggc

SEQ ID NO: 10449 - RNA, 3495 nt, Artificial Sequence
  derived and/or modified CDS sequence (opt3) from CCHVF(CCHVF BA8402)__AF350449.1__Gn-NSm-Gc
agcgaggaauccggcgacgauugcaucucuagaacccagcugcucaggacagagacugccgaaauucacaacgacaauuacgggggacccggugauaagauaacgaucuguaacggcucaaccguggucgaccaacggcuugggagugagcugggaugcuauacaauuaaucgcguuaacagcuucaauuugugugaaaacacugcuaccggcaaauccugcgagaucgauucuacaccugugaagugucgacaggguuuuugcuuaaaaauuacccaggaggggcguggacauguaaagcugucgagaggcucagaagugguccuagacgcaugugagagcaguugcgaaaucaugauaccaaaaggcacuggggauauccucguggacuguuccggaggucagcaacacuuccugaaggauaaucuuauugaccugggcugcccgaacauccccuugcucgggaagauggccauuuacaucuguaggaugucuaaucauccuaaaacaaccauggcguuucuguucugguuuagcuucggauauguugugacgugcauacugugcaaggucaucuuuuaccucuuaauugugguaggcacucuggguaaaaaguucaaacaguaucgggagcuuaagccacagaccuguacaauuugcgagacuacccccguuaacgcuaucgaugccgaaaugcacgacuugaauuguuccuacaacaucugcccuuauugugcaucacgcccaacaagugaugggcuggccagacaugugaugcagugccccaagaggaaagagaagauugaagagaccgcucuauaccucaaucuggaacggauaccuugggucgugcgcaaacuucugcaagugagcgagucuacgggagucgcauugaagcgauccucauggcucguugugcuguuaguacugcucacugugagccuuaguccaguccagucugccccgaucggccacggcaaaacaguggagaccuaccagacuagagaaggguauacauccauuugucuguuuguuuugggaagcauccuauucauagugucgugccugaugaagggucucgucgacucugugggcaacuccuuuuuccccgggcugucaauuuguaaaaccugcaguaucggaagcguaaauggcuuugagaucgaaucccacaaguguuacugcucucuuuucugcuguccuuauugcaggcauuguagcgcugaccgggagauucaccgucugcauuugucaaucugcaagaaacgcaagacggguaguaacguuaugcucgccguguguaaaagaaugugcuucagggcgaccgucgaaguguccaacaaggcacuguuaauucggaauauaaucaacacaacuuuuguccuguguauucuaauccucgccgugugcguugugagcaccucugcuguagagauggagucacugccagccgggacaugggaacgagaggaagaucuuacuaauuucugucaccaggagugccaagucaccgaaacagaguguuugugccccuacgaggcacuggugcuccgcaaaccucuguuuagugacagcaucguuaagggcaugaagaaccuucucaauuccaccucuuuggaaacuucgcucagcauugaggcuccauggggagccauaaacgugcaguccacguucaaacccacagucucagcggccaauaucgcacugaguuggucuagcguggaacacagaggcaacaagauuuuaguauccgggaggucagagagcaucaugaaacuggaggaacggaccggaauuucuugggaucuagguguggaggacgcuuccgaaaguaagcuccugacuguuagcgucauggaucuuucucagauguauuccccgguguuugaguacuugucaggcgaccgccaaguggaagaguggccuaaagcuaccugcacaggggauugucccgagagaugcggauguaccaguagcacuugccugcauaaggaauggccacacucgaggaauuggcguuguaacccuacauggugcuggggcgucgguacgggguguaccugcuguggccucgacguuaaggaucuguucacugacuauauguuuaucaaauggaagguggaguacauaaaaacagaagccaucgugugcguagaguuaaccucccaggaacggcaguguacacugauugaggccggaacucgauucaaucuuggccccgucaccaucacguugucugagccaagaaacauucagcaaaagcugcccccugaaaucgugacccugcauccaaggauagaggaaggguuuuucgaucuaaugcacguucagaaagugcugagcgcaucaacagucugcaagcuccagaguugcacucauggagugccgggugaccugcagguuuaccacauuggcaaucuuuugaagggggacaaagugaacggacaccugauccauaagauugagccccacuuuaauaccuccuggaugucuugggauggcugugacuuacauuauuacugcaacaugggugauuggccuagcuguacauauacugggguaacccaacacaaccacgccgcuuucgucaauaugcucaacaucgaaacggacuacacaaagaauuuucauuuccacuccaagcgcgugaccgcgcauggcgauacuccacagcuggaccuuaaagcacggcccacauauggagccggcgagauaaccgugcuggucgagguugcugauauggaauugcacacuaagaaaaucgagauuucagggcucaaguucgccagccugaccugcacaggauguuacgcaugcaguucuggcaucuccuguaaggugagaauccauguagacgaaccugaugagcuaacggugcacgucaaaagcgaggacccagauauuguggccgcuucgucaucucugauggccaggaagcucgaauuugguaccgacaguacuuucaaagcauuuuccgcgaugcccaagacaagccugugcuucuauauaguugagcgcgaauacugugagucuugcagcaaagaagauacccagaagugugugaacacaaaacuugagcagccgcaauccauuuugaucgagcacaaagggacuaucauuggaaagcagucaaauaccugcacggcuaaagccaguugcuggcuggaaagcgucaaguccuuuuucuacggccucaaaaacauguuaucugguaucuuuggcaauguguucauugggguuuuucuguucuuugcaccuuucauacuucugauccuauuuuucauguucggauggcggauucucuuuuguuucaagugcugucgacguacaagaggccuguuuaaguauaggcauuugaaagacgacgaggaaaccggguaccgcaagaucauugagcggcugaacaauaaaaagggcaaaaacaaguuacucgauggagaaagacuggccgacaggaagaucgcugagcuuuucucaacuaaaacccacauaggu

SEQ ID NO: 10450 - RNA, 3495 nt, Artificial Sequence
  derived and/or modified CDS sequence (opt3) from CCHVF(CCHVF Matin)__AF467769.2__Gn-NSm-Gc
agcgaggaauccggcgacgauugcaucucuagaacccagcugcucaggacagagacugccgaaauucacucagacaguuacgggggacccggugauaagauaacgaucuguaacggcagcaccguggucgaccaacggcuuggguccgagcugggaugcuauacaauuaaucgcguuaaaucuuucaaguugugugaaaacucggcuacuggcaaaucaugcgagaucgauagcaccccugugaagugucgacaggguuuuugcuuaaaaauuacacaggaggggcguggacauguaaagcugaguagaggcuccgaagugguccuagacgcaugugauucuagcugcgagaucaugauaccaaagggcaccggggacauccucguggauuguuccggaggucagcaacacuuccugaaagacaaucuuauugaucugggcugcccgaacauccccuugcucgggaagauggccauuuacaucuguaggaugucaaaucauccuaaaacuacaaugguuuuucuguucugguuuaguuucggauaugugauaaccugcauucugugcaaggucaucuuuuaccucuuaauugugguaggcacgcuggguaaaaaguucaagcaguaucgggaacuuaaaccacagacuuguaccaucugcgagacaacucccguuaacgcgaucgacgcugagaugcacgauuugaauuguagcuacaacauuugcccuuauugugccucucgccugaccuccgacgggcuagcaagacaugugaugcagugcccaaagaggaaagaaaagauagaggaaacagagcucuaccugaaucuugaacggauccccugggucgugcgcaaacuguugcaagugucagagagcaccggagucgcccucaagcgaaguucuuggcugguuguguuacugguacuccuuacggugucccugagcccuguccagucggcuccaauuggccacggcaaaacuguggagacauaccagaucagagaaggguauaccucuguuuguuuguuugugcuaggauccauacuguucauugucucaugccucaugaagggucugguggacagugauggcaacagcuuuuucccggggcuuuccaucuguaagacuugcucuaucggaagcauuaauggcuuugagaucgaaucacacaaauguuacugcagucuguucugcugucccuauugcaggcauuguuccacagaccgggagauucacaaguugcaucucagcauaugcaaaaagcguaaaaccgguucuaacguaaugcuggcaguuuguaagcgcaugugcuucagagccacgguggaagucucaaauaaggcuuuacugaucaggaguauuaucaacaccacauuuguggucuguauccuaauucucgccgugugcguugugagcacuuccgcgguagagauggagucucugccugcagggaccugggaacgggaggaagaucuuauaaauuucugucaccaggagugccaagucacagaaacugaguguuugugcccauacgaggcccuggugcuccgaaaaccccuguuucuugacucgaucauuaagggcaugaaaaaccuguugaacagcaccucccucgaaacaucacugaguaucgaggcuccuuggggagccauuaauguucagucuaccuucaagccaacuaugagcgcagcuaacaucgccuuauccuggucaagcguggaacaccgcggcaauaaaauacuggucucugggagauccgagaguaucaugaagcuagaggaaaggacgggaauuagcugggaucucgguguggaggacgcgucugaauccaagcugcuuacaguaucagugauggauuugagucagauguauagccccguuuuugaguaccugucgggcgaccggcaagucgaagaguggccgaaagcaaccugcacuggggauuguccugagcgcugcggauguaccuccucuacaugccuccauaaggaauggccccacagcagaaacuggagguguaauccaaccuggugcuggggcguggguacuggguguacaugcuguggccuggacgugaaagauuuauucacggacuauauguuugucaaguggaaaguugaguacaucaagaccgaagugauugugugcguagagcugacuucacaggaacgucaguguagucuuaucgaggccggaacacgguucaacuugggcccugucaccauaacacucuccgagccccgaaauauucagcaaaagcugccacccgaaaucgugacucuacauccuagaauugaggaaggguuuuucgaccugaugcacguucagaaagugcucucugcuagcaccgucugcaagcugcaguccugcacgcauggagugccaggugaucuucagguuuaccacaucggcaacuugcugaaaggggacaaggugaauggacacuuaauacauaaaaucgagccgcacuuuaacaccucauggaugagcugggauggcugugaccucgauuauuacugcaauaugggugacuggcccaguuguucuuauacagggguaacucaacauaaccacgccgcuuucgucaauaugcuguccauugaaaccgauuacacaaagaacuuucacuuccauagcaaaagggugacugcccacggcgacaccccucagcuugaucugaaggcacgcccaacguauggagccggcgagaucacaguguuggucgagguugcugacauggaacuccauaccaagaaaauugagaucucggggcugaaguucgcgucacuaacuugcacaggauguuacgcaugcucuaguggcauauccuguaaagugcggauucacguagaugaacccgacgagcugaccgugcaugucaagagcgaggauccugacaucguggccgcuucuagcucccucauggccagaaaacuggaauuugguacugacucaaccuucaaggcauuuagugccaugccaaagacaagccuuugcuucuauaucguugagagggaauacuguaaaucuugcuccaaggaggauacgcagaaaugugugaauaccaaguuggaacagccccaaucaauucugaucgagcacaaagggacuauuauaggaaagcagaacgacacaugcaccgcuaaggccaguugcugguuagagagcgucaaauccuuuuucuacggccucaagaacaugcugucugguaucuuuggcaauguguucauugggaucuuucuuuuccuggcaccguuugcgcuacucauucuguucuuuauguucggauggcgcaucuuguucuguuuuaaaugcugucgacggacacguggccuguucaaguauagacacuuaaaagaugacgaagagacuggguacaggaagauaaucgaacgccucaacaauaagaaaggaaagaacaaacugcuugauggcgagcggcuggcugacagaaagauugccgaauuguuuucgaccaaaacgcauguuggu

SEQ ID NO: 10451 - RNA, 3495 nt, Artificial Sequence
  derived and/or modified CDS sequence (opt3) from CCHVF(CCHVF Baghdad 12)__AJ538197.2__Gn-NSm-Gc
agcgaggaauccggcgacgauugcaucucuagaaccaggcugcuccggacagagacugccgaaauucacggggacucauacggaggucccggcgauaagauaacgaucuguaacgggaguaccauuguggaccagcgccuuggaagcgagaugggcugcuauacaaucaaucgagucaaauccuucaagcugugugaaaacucugcuacugguaaaucgugcaagauugauucaaucccuguuaaaugucgucaaggguacugcuugaagauaacccaggagggaagaggccaugugaaguuaagcaggggcagugagguagugcuggacgcaugugauuccucuugcgaagucaugaucccaaaagggacaggagacauucuaguggauuguagcgguggccagcagcacuuucucaaggacaaucugaucgaucuugggugcccgaacauuccccuguugggaaaaauggccaucuauauaugucggauguccaaucauccuaagaccacuauggcguuccucuuuugguucucauuuggcuacguuauuacaugcauccugugcaaagcuauuuucuaucugcucaucaucguggguaccuuagggaagcgcuuuaagcaauacagagagcugaaaccacagacguguacuauuugcgaaaccacacccgucaacgccauagacgcagagaugcacgaucuuaauuguaguuauaacaucugcccuuacugugccagcagguugacuucugacggacuggcucggcaugugacccagugcccaaagcgcaaagagaagguagaagagacagaacuauaccucaaucuggagcgaauccccuggguugugagaaaacuucugcaggucuccgaaucaaccggcguggcauugaagaggagcaguuggcucauugugcuguuaguccugcucgccguuucuuccagcccugugcaaucggcuccaauaggcuaugggaaaacgauugagacuuaccaggcccgggagggauauacaucuaucugucuuuucguacuggguuccaucuuguuuauugugucaugccuaaccaagggccuggucgacaguaucgggaacauuuucuuuccgggacucagcauauguaagacuugcuccaucggcucuauuaaugguuucgaaguggagagccacaaauguuacugcucacugcuuugcugucccuauugccgucacuguagugcggaucgcgaaauccaucagcugcacuuguccaucugcaagaaaagaaagacagggagcucuguuaugcucgcaguguguaaaaggaugugcuuucgggccaccauggaggucucaaacaaggcucuguuaauucgaaguauaaucaauacgaccuucgugguauguauucugacacuagccguuugcguggucagcacuuccgcaguggaaauggagucucucccugcuggcaccugggagcgcgaagaggaccugacaaacuucugucaucaggaaugccaagucacugagaccgaaugucuuugcccauacgaggccuuggugcugagaaagccccucuuucuggauucgaucguuaaaggaacaaagaaucuucugaacagcaccuccuuggagacuucacucaguauugaagcgccuuggggcgccaucaacgugcagucuacguauaaaccaacaguaagcaccgcaaauauagcucuguccuggucaagcgucgagcacagggggaacaagaucuuagugucuggacgguccgaaaguauuaugaaacuggaggagcgcacugguaucagcugggaccuaggcguugaagaugccucugaguccaagcuccugaccgugucagucauggaccuuagucagauguacagccccguguucgaauacuugucgggggauagacaaguagaggaauggccgaaggcuacaugcaccggagacuguccugagaggugcggcuguacuacauccacgugccugcacaaagaguggccccauucucguaauuggcgguguaacccaaccuggugcugggguguggggacuggcuguacaugcuguggacucgauguuaaggaccuguuuaccgauuauauguucgucaaauggaagguggaauacauuaaaacagacgccaucgugugcgucgaguuaacuagccaggaacgacaguguucacugauagaggcaggcaccagauuuaaucuugggaguguuacgauuaccuuguccgaaccuaggaacauccagcaaaagcugcccccagagauuaucacacugcacccccgcauagaggaaggauucuuugaccuaaugcaugugcagaaggugcugucugccagcacuguaugcaaacuccaguccugcacccacggugucccuggcgaucuccagguguaucauaucgggaaucuuuugaagggagacaaaguuaacggccaccugauucacaagaucgagccacauuucaauacaucauggaugagcugggaugguugugacuuagauuacuauugcaacaugggggacuggccgaguuguacuuacaccggcgugacgcaacacaaucaugcuucuuuugucaaccuccugaauauugaaacagauuauaccaaauccuuccacuuucacagcaagcgggugacugcgcauggagacacaccccagcuugaucugaaaguuagaccuaccuacggcgcaggggagaucacuguguugguagaagucgccgacauggagcuccacaccaagaagauagagauuucgggacugaaauucgcuucacuaacaugcacgggcuguuacgccugcucuagugguaucuccuguaaggugaggauccauguggaugaaccagacgagcugaccguccacguuaaaagcgaugaccccgacgugguagcagccucuagcucccucauggcucgcaagcuggaauuugggacugauucaacauucaaagccuucagugcaaugccuaagaccagccuuugcuuuuauauuguggagcgagaguacuguaagucuugcuccaaagaagacacacagaagugugucaacacuaaauuggagcagccacaaucaauccugauugaacauaagggaaccauaaucggcaaacagaauaacacgugcacagcgaagaccaguugcugguuagagagcgugaaguccuucuuuuauggucucaaaaacaugcugucuggcauuuucgggaacuuuuucaugggaaucuuucuuuuccuggcucccuuuauucuacucauccuguucuuuauguucggcuggcggauauuguuuuguuucaagugcugucguagaacuagggggcuguucaaauaccgccacuuaaaggaugacgaagagaccggauaucggagaaucauugagaggcucaauaauaaaaagggcaagaacaaacugcuugauggugaacgacuggccgaccgccggaucgcagaguuguuuucgacaaagacucacauuggg

SEQ ID NO: 10452 - RNA, 3495 nt, Artificial Sequence
  derived and/or modified CDS sequence (opt3) from CCHVF(CCHVF VLG/TI29414)__AY179961.1__Gn-NSm-Gc
agcgaggaacccggcgacgauugcaucuccagaacccagcugcucagggccgagccugcugaaauucacgacgauaacuacgggggaccaggugacaagauaacaaucuguaauggcucuacuauuguggaucaacggcuugggucagagcugggaugcuauacgaucaaccgcgucaaaaguuucaaguugugugaaaauagcgcaaccggcaaaacaugcgagauugacuccacuccgguuaagugucgacaggguuuuugcuuaaaaaucacccaggaggggcguggacaugugaagcugucuagaggcucggaaguagugcuagaugccugugacucaagcugcgaggucaugauacccaagggcacaggggauauccucguggacuguaguggaggucagcaacacuuccugaaagauaaccuuauugaccugggcugcccucauaucccauugcucgggaagauggcgauuuacaucuguaggauguccaaucacccccggaccacuauggcuuuucuguucugguuuucuuucggauauguuauaacaugcauuuucugcaaagcccuguucuacagccucaucauuaucggcaccuuagguaagaaaaucaagcaguaucgcgaacugaagccucagacguguacuauuugcgagaccgcaccagugaacgccauagaugcugagaugcaugaccuuaauuguuccuacaacaucugccccuauugugcaucaagauugacaagugacgggcuggccaggcacgucccucagugcccaaaacggaaggaaaaaguggaggaaacugagcuauaccucaaucuggaacgcauuccguggaacguacgaaaacuucugcaaguuagcgagucuaccggaguggcuuugaagagauccucauggcucaucguccuguuagugcugcucacagugagccuuagucccguccagucugccccuguuggccacggcaagaccauagagacguaccagacuagggaaggguuuacauccauuugucuguucauguugggaagcauccuauuucuggugucgugccucguaaaaggucugguggauucugucuccgacucauucuuuccaggccuuaguguguguaagaccugcagcaucggguccauuaauggauucgagaucgaaucucauaaguguuauugcagccuguucugcugucccuacugccggcacuguucagcggaucgugagauucaucaguugcaccucaguauaugcaaaaagcgcaaaaugggcuccaacguuaugcuggcaguguguaagagaaugugcuuuagggccacuaucgaagcuagccggcgagccuuacugauucgcucuaucaucaauacaaccuucgucauuuguauacuaacgcucaccaucugcgugguaucaacaagugcaguugagauggagaaccugccuagcgguacuugggaaagagaggaagaccuuaccaauuuuugucaccaagagugccaggugacagaaacugaguguuugugcccauaugaggcucugguccucaggaaaccccuguuccuugauuccauugugaaggggaugaagaaccuguugaacucuaccaaucucgaaacaucgcugagcaucgaggccccguggggcgcgauuaacguccaguccaccuuuaaaccuacugugucaacggccaauaucgcauuaaguuggucuagcguugaacaucggggaaacaagauacuggugacaggccgcuccgagucaaucaugaaacuagaggaaagaaccgggguaagcugggaccucggagucgaggaugcuucugaauccaagcugcuuacugugaguauuauggacuugagccaaauguacucucccguuuucgaguaucuguccggugaucgucagguggaagaguggccaaaagcuaccugcacaggcgacuguccugagaggugcggguguaccucaaguacuugccuccacaaggaauggccccauagccggaauuggcgauguaacccaacauggugcugggaggucggaacgggcuguaccugcugugguuggaaugugaaggaucuguuuacugaccacauguucguaaaauggaagguggaauacaucaaaacagaggccauuguuugcgucgaauuaaccucgcaggagagacaguguucccugaucgaggccgggacaagguuuaaccuuggccccgugacuauaaccuugucugaaccucgcaauauucaacagaagcucccaccggagaucauuacgcugcaucccaaaguggaagagggauucuuugaccuaaugcacguccagaagguucugagcgcaucaaccgugugcaagcuccagaguugcacacacggcaucccuggggaucugcaaguguaucauauaggaaaccuuuugaaaggugaccggguaaauggccaccugauccauaagauugaaccacacuucaacacuuccuggaugucuugggaugggugugacuuagauuacuacugcaauaugggagacuggcccagcuguaccuauacaggcaugacucagcacaaccaugccgcuuuugucaaucuccugaacaucgagaccgauuacacgaaaacauuccacuuccauuccaagagagugaccgcgcacggugacacuccucagcuugaucugaaagcaaggccaacauauggggccggcgagauuaccguuuugguggaagucgcugacauggagcuccauacuaagaaaguggaaaucucaggacugaaguuugccagccuagcaugcaccggcuguuacgccugcaguucugggauauccuguaagguucgcauucacguggaugagcccgacgagcugacaguacacgucaaaagcaacgauccggacgugaucgcugccucgacgucacucauggcacgaaagcuggaauuuggaaccgacucuacuuuuaaagcguucagugcuaugccuaagacaucccuuugcuuuuauaucgccgagcgggaauacuguaaaagcugcucugaggaagauacccagaaguguguggacacaaaguuggagcaaccacagagcauucugaucgagcauaaaggcacuauuauagguaagcagaaugauaccugcacggcaaaagccuccugcugguuagaaucagucaagaguuucuuuuaugggcucaaaaacaugcugggaagcguuuucggcaacuuuuucaucgguauucuucuguuucuagcucccuucgugcuccugguauuguuuuucauguucggcuggaagauccuguuuuguuucaagugcugucguagaacaaggggguuacucaaauaccgccugcuuaaggacgaugaggaaaccggauaccggagaauuaucgagaggcugaauaauaaaaagggcaaaaaccgauugcucgacggggaacgccuggccgaucggaagauagcagagcuauuuucuacuaagacccacaucgga

SEQ ID NO: 10453 - RNA, 3495 nt, Artificial Sequence
  derived and/or modified CDS sequence (opt3) from CCHVF(CCHVF TADJ/HU8966)__AY179962.1__Gn-NSm-Gc
agcgaggaauccggcgacgauugcaucucuagaacccagcugcucaggacagagacugccgaaauucacggggacgauuacggaggucccggcgacaagauaacgaucuguaacgggucaaccauuguggaucaacggcuuggaagugagcugggcugcuauacaaucaaucgcgucaagagcuucaaguugugugaaaacuccgcuacugguaaaaauugcgagauugacucuguuccugugaagugucgacagggguacugcuuaaaaaucacccaggagggacguggccauguaaagcugucgagaggcucagaagugguccuagaugcaugugacagcaguugcgaggugaugauaccaaaggggacaggagauaucuccguugacuguucugguggccagcaacacuuucucaaagauaaccugauugaccuugggugcccgaagaucccccuguugggaaaaauggccauuuauaucuguaggaugagcaaucauccuaagaccacuauggcguuccucuuuugguucuccuuuggcuacgugauaacacggauucugugcaaagcuaucuucuaucugcucauuaucgucgguaccuuagggaagcgcuuuaagcaguacagagaacugaaaccacagacgugcacuaucugugagaccacacccgccaacgcaauugaugccgagaugcacgaccuuaauugcucauauaacauauguccuuacugcgcuaguagguugacuagcgacggacuggcacggcaugugacccaguguccaaagcgcaaagaacgaguagaggaaacagagcuauaccucaaucuggaaagaauccccuggauuguuaggaaacuucugcaagugucugaguccaccggcgucgccuugaaacggucaagcuggcucaucgugcuguuagugcuguucacggucagucucucuccuguucaguccgcuccaauaggcuaugggaacacuauugagacauaccaggcccgugaagaguauaccagcaucugccuuuuugugcugggaucgaucuuguucauuguaucuugucuaaugaagggucugguggauuccaucggcaauauuuucuucccggggcucacuauaugcaaaacauguucaaucggaaguauuaacggcuuugaaaucgagagccacaagugcuacuguucccugcuuugcugccccuauugucgccacugcucugcggacagagaaauccaucagcugcacuugagcauuuguaagaaaaggaagaccgguucaaaugucaugcucgcagugugcaaacggauguguuuccgagccacgauggagguuaguaacaaggcucuguuaauacgcuccaucauuaauaccacauucguggucugcauccugauucuagccguguguaucguaagcacuucugcaguugagauggaaucacucccugcugggaccugggagagagaagaggaucugacaaacuuuugccaucaagaaugucaggugacugagaccgagugccuuuguccauacgaagccuugguccugaggcggccccucuuccuggacaguauagugaaaggcaugaagaacccucuuaauagcacaucccuggagaccucuuugucgaucgaagcgccauggggagccauuaacguccagagcacuuauaagcccacgguguccacagcaaauaucgcucucucauggaguucuauugagcaccgcggcaacaauauccugguuagcgggagauccgagucaauaaugaaauuagaagagaggaccggaauuagcggugaucugggcguggaagacgccucugaguccaagcuacucacuguaagugucauggaucugagccaaauguacucuccgguguuugaauaccuuuccggggaccgucagguugaggaguggccuaaagcuaccugcacaggagauugccccgaacgguguggcugcaccucaaguacuuguuugcacaaggaguggccacauagccgaaacuggagaugcaauccuacaugguguugggguguggggacgggcugcaccuguugcggacuggacgucaaagaucucuucaucgacuauauguuugugaaguggaagguagacuacauuaaaacugaagccaucguguguguugagcugacaucgcaggaaaggcagugcuccuuagucgaggcaggcacccgcuucaaccuggggcccgugacaauaacucuuucugagccacggaauauccaacagaaguugcccccugaaauuaucacccuccacccaagaauugaggaaggauuuuucgaucugaugcaugugcagaaaguccuaagcgccucaacgguuuguaagcugcagaguugcacccacggugugccgggcgaccuccaaguguaucauaucgggaaccugcuuaaaggagauaaggagaauggccacuugauacacaagauugaaccccauuuuaacacauccuggaugucuugggacgguugcgaucuggacuacuauuguaauaugggggauuggccuagcugcacuuacaccggcguaacacagcacaaccaugcuuccuucgucaauuuacucaacaucgagacugacuauaccaaaucauuucacuuccacagcaagagggugacggcgcauggagauacaccacagcuggaccuuaaagcacgccccaccuacggcgccggggagaucacuguucugguggaagucgcugauauggaguugcacacaaagaaaauugaaaucaccggacucaaguuugccagucugacuuguaccggcugcuacgcauguucuuccgguauuagcugcaaagugcgaauacauguugacgagccugaugagcuaacagugcacguaaagucggacgacccagaugucguggccgcuucaucuagucugauggcccggaagcucgaauuugggacggacuccaccuucaaagcauuuagcgcgaugcccaagacuucucuguguuucuauaucguggagcgugaauacagaaaaagcugcuccaaggaggauacacagaaaugugucaacaccaaacuugaacaaccgcagucaauuuugaucgagcauaagggaacaauuaucggcaagcagaauaacacuugcaccgcuaaggccaguuguuggcuggagagcguuaaauccuuuuucuaugguuuaaagaauaugcucucuggcauauuugggaacguguucguaggaaucuuucuguuccuugcaccuuuuauucugcuaauccucuucuuuauguucggcuggaggauucugucaugcuuuaaaugcugucgccggacgagaggguugcugaagcacaggcacuuaaaggacgaugaagagacaggauaccgacgcaucauagaacggcucaauaacaaaaagggcaaaaauaagcugcuugacggugagagacuggccgauaggcguauugcugaauuguucaguaccaaaacucauaucggg

SEQ ID NO: 10454 - RNA, 3495 nt, Artificial Sequence
  derived and/or modified CDS sequence (opt3) from CCHVF(CCHVF Hodzha)__AY223476.1__Gn-NSm-Gc
agcgaggaauccggcgacgauugcaucucuagaacccagcugcucaggacagagacugccgaaauucacggggacgauuacggaggucccggcgacaagauaacgaucuguaacgggucaaccauuguggaucaacggcuuggaagugagcugggcugcuauacaaucaaucgcgucaaaucuuucaaguuguguaaaaacuccgcuacugguaagucuugcgaaauugacucgaccccuguuaaaugucgacagggguacugcuuaaagaucacacaggagggacguggccaugugaagcugucaagaggcagcgagguagugcuagaugcaugugacaguuccugcgaagucaugauaccaaaagggaccggagauauccucguggacuguucugguggccagcaacacuuucugaaggauaaucuuauugaccuggggugcccgaggauccccuugcucggaaaaauggccauuuauaucugucggaugagcaaccauccuaagacuacaauggcguuccuguuuugguucuccuuuggcuacguuauaaccugcauucugugcaaagcuaucuucuaucucuuaauuaucguggguacgcuggggaagcgcuuuaagcaguacagagagcuuaaaccacagacuuguaccaucugcgaaacaacucccgccaaugcaauugaugccgagaugcacgacuugaacuguucauauaauauaugcccuuacugugcuaguaggcugaccagcgacggacuagcacggcaugucacacagugcccaaagcgcaaagagaagguggaagagaccgaacucuaccugaaccuugagcgaauccccuggauuguaagaaaacuguugcaaguuucugaauccacgggcguggcccucaagaggucaagcuggcugaucgucuuacugguccucuucgcugugagucuuucuccugugcaguccgccccaauaggccacgggaaaacuauugagacauaucaggcgcgggaggauuacaccagcaucugucuguuuguuuugggaucgauccuauucauugugucuugccugaugaagggucucguagacuccaucggcaauauuuucuucccggggcugacuauauguaagacaugcucaaucggaaguauuaacggcuuugaaaucgagagccacaaauguuauugcucccuucugugcugucccuacugccgucauuguucugcagaucgcgaaauccaccaguugcaucucagcauuugcaagaaaagaaagaccgguucaaaugugaugcuggccgucuguaaaaggaugugcuuccgggcuacgauggaggugaguaacaaggccuuacugauacgauccaucauuaauaccacauucguuguguguauccuaauucucgcagucugcgugguaagcacuucugcuguugaaauggagucacugccugccgggaccugggagcgcgaagaggaccuuacaaacuuuugucaccaagaaugccaggugacugagaccgaauguuugugcccauaugaggcgcugguccucagaaggccccuguuccuugauaguaucgugaagggcaccaaaaaucuguugaacagcacaucccucgagacuucucugucgauagaagccccuuggggagcaaucaacguccagagcacguacaagccaacaguguccaccgcuaauauugccuuaucauggaguucuguugagcaccggggcaacaaaauccuggugagcgggcgcuccgaaucaauuaugaagcuagaggagagaacuggaaucagcugggaccucgguguagaagaugcuucugaguccaaacugcuuaccgucagugugauggacuugagccaaauguauucucccguuuuugaauaccuguccggcgaucgucagguggaggaauggccgaaggccacaugcaccggggacuguccugagaggugcggauguacuucaaguacaugccuccauaaggaguggccccacagccggaauuggcgauguaacccaacguggugcuggggcgucgguaccggguguacuugcuguggccuggaugugaaagacuuauucacagacuacauguuuguaaaguggaaaguggauuauauaaagaccgaagcaauuguuugcgucgagcugacaucgcaggaaagacaguguucccuuguggaggccggaacuagguucaauuugggcccugugaccaucacgcucucugaaccccgcaacauucaacagaaacugccacccgagaucauaacccuacauccucggaucgaggaaggguuuuucgaccugaugcacguccagaagguucucagcgcuucaacagugugcaagcugcagaguugcacucauggagugccaggugaucuucaaguauaccacauuggcaauuugcugaaaggggacaaggucaacggacacuuaauccauaaaauugagccgcacuuuaauaccuccuggaugucuugggauggcugugaccucgauuauuacugcaacaugggugacuggcccagcuguacauauacuggggugacccagcauaaucacgcguccuucguuaaccugcuuaauaucgaaacggauuacacaaagucauuucacuuccauagcaaaagagugaccgcacacggcgacacuccucagcuggauuugaaggccaggccaacauauggagcuggcgagauaaccguccucguggaaguugccgacauggagcugcauacuaaaaagauugagaucaccgggcuaaaguuugcaagucugacaugcacgggauguuacgccuguucuuccggcaucagcugcaaagugcgcauucacguagaugaacccgacgagcucaccguccaugugaagucggacgauccugacguggucgcugccucaucuagucugauggcacgaaaacuugaauuugguacugauuccacauucaaggcguuuagcgcuaugccaaaaaccucuuugugcuucuacaucguugagcgggaguauuguaagagcugcuccaaggaagacacacagaaaugugugaacacuaagcuggagcaaccccagucaauuuuaauagaacguaaagggaccaucauuggaaagcagaauaacacgugcacagccaaagcaaguugcuggcucgagagcguaaagagcuuuuucuacggccugaagaacaugcuuuccgguaucuuuggcaauguguucgucgggauuuuucuguuccuagccccguuuauccuccugauauuguucuuuauguucggauggagaauccuguuuuguuucaaaugcuguaggcgcacccggggcuuauucaaguauaaacaccucaaggaugacgaagagacuggguacagaaggauuaucgagcgacugaacaauaaaaagggaaagaacaaacuucuggauggcgaacgcuuggcugaccggagaauugccgagcucuuuucaaccaagacacacaucggu

SEQ ID NO: 10455 - RNA, 3495 nt, Artificial Sequence
  derived and/or modified CDS sequence (opt3) from CCHVF(CCHVF Kosovo/9553/2001)__AY675511.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucgcgaggauguccaaucacccaaaaacaaccauggcuuuucuguucugguuuucucugggauauguuauaacguguauucucugcaaggccuuauucuacagccugaucauuaucggcacucuugguaaaaagaucaagcaguaucgggaauugaaaccccagaccugcacaauuugugagacugcaccugugaacgccauagaugcugagaugcaugaccugaauugcuccuacaacaucuguccauauugcgcaucacgccuaaccagugacgggcucgccagacacgucaagcagugucccaaaaggaaggaaaaaguggaggaaacagagcuguaccuuaaucuggaacggauuccuuggguaguucgcaaguugcuccaagugagcgagucuaccggagucgcucugaaacgauccucaugguuaaucgugcugcucgugcuucugacggucagcuugaguccaguucagucugccccggugggccacggcaagacuauagagacauaccagaccagagaaggguuuacuuccauuugccuauucaugcugggaagcauccucuuuaucguaucgugucuggugaagggucuugucgauucuguguccgacucauucuuucccggccugaguguuugcaaaacauguagcauuggguccaucaacggauucgagauugaaucucauaagugcuauuguagcuuguuuugcugcccuuacuguaggcacugcucagcggaucgggagauacaucagcuccaccugaguaucuguaaaaagcguaaaaccggcuccaaugugauguuagcagucugcaagcgcauguguuucagagccacgauugaagcuagcaggcgggcccugcuaauccgaucuaucauuaacaccacauucgugauaugcauccucacucugaccauuuguguagcaucaacaagugcuguugagauggagacucuuccagccgcgaccugggaacgcgaggaagacuugacaaauuuuugccaccaagagugucaggugcccgaaaccgagugccuguguccuuaugaggcccucguccugagaaagccacuuuuccuggauagcaucgugaaagguaugaagaacuugcucaauuccacuucucuggaaacgucguuaagcauugaggcacccuggggcgcuaucaacguccaguccacauuuaaaccgaccgugucaacugccaacauagcucugaguuggucuagcguugaacauagggggaauaagauccuagugaccggacgguccgagucaauuaugaaacucgaggaacgcacaggcguaagcugggaccugggggucgaggaugccucugaauccaagcucuugaccgugaguaucauggaccugagccaaauguacucuccuguuuucgaguaucucuccggagauagacagguggaagaguggcccaaggcaacuugcacaggugacugcccagagagguguggcugcacgucaaguaccugucugcacaaagaauggccucauagccguaacuggcggugcaaucccacuugguguuggggagucgggacaggcugcaccuguugcgguguggauguaaaggacuuauuuacagaccacauguucgugaaauggaagguugaguacauuaaaacugaagccaucgucuguguggagcugaccucgcaggaacgacagugcucccuuauagaggcugggacgagauuuaacuugggcccagugaccauuacacucucugagcccaggaauauccaacagaagcugccuccagaaauuaucacucuacauccgaagauagaggaaggauucuuugaucugaugcacguccagaaaguucucagcgcgucaaccguguguaagcugcagaguugcacacacggcauccccggggaccuucaaguguaucauauuggaaacuugcugaaaggugaucgcguaaauggccacuuaauccauaagauugagccucacuucaacacuuccuggaugucuugggacgggugcgaucucgacuacuacuguaauaugggagauuggccaagcugcaccuauacgggcgucacacagcacaaccaugcagccuuugugaaucugcuuaacaucgaaaccgacuacacuaaaacauuccacuuucauuccaagcggguuaccgcucacggugauacuccccagcuggacuugaaagccagaccuaccuauggggcaggcgagauaacagugcucgucgagguggccgauauggaacugcauacgaagaagguugagauuucaggacuaaaauucgcuagccuggccuguaccggcugcuacgcauguaguucugggaucuccugcaaggugaggauccacguagacgaaccagaugagcucacuguccacgugaaaagcucggaccccgacguggucgcggcuucaacaucucugauggcccgcaaacuugaguucggaaccgauaguacauuuaaggcauucuccgccaugccgaagacuagcuuguguuuuuauauuguugaaaaggaguacugcaaaucuuguagcgaagacgauaccaagaaaugcguggacacgaagcuggagcagccucaauccaucuuaauugaacaucgaggcacaauaaucgguaaaccaaaugauaccugucccgcuaagacuucaugcuggcucgagaguguaaagagcuucuuuuaugggcugaaaaacaugcuuggaucuguguucggcaacuuuuucauugguauccugcuauuucucgccccuuucuuucuguggauguuguccuucauguuuggcuggaagauucuguucugcuucaaauguugccggcguaccagaggguuauuuaaguacaggcaccucaaagacgaugaggaaacaggauaccgccggaucauagagagacugaauaacaagaagggcaaaaauaggcuucuggacggggaacgauuggcagaucgcaagaucgcugagcuuuucucaacuaaaacccauauugga

SEQ ID NO: 10456 - RNA, 3495 nt, Artificial Sequence
  derived and/or modified CDS sequence (opt3) from CCHVF(CCHVF SPU41/84)__AY900142.1__Gn-NSm-Gc
agcgaggaauccucugacgauugcaucucaagaacccagcugcucaggacagagacugccgaaauucacggcgacaacuacgggggacccggugauaagauaacgaucuguaauggcaguaccguggucgaccaacggcuugggagcgagcugggaugcuauacaauuaaccgcguuaaaacuuucaaguugugugaaaauuccgcuaccggcaaaucuugcgagaucgauucggugccuguaaagugucgacaggguuacugcuuaaaaauuacacaggaggggcguggacaugugaagcugucaagaggcagcgaagucgugcuagacgcaugugauaccaguugcgagguuaugaucccaaagggcacuggggacauacucguggauuguuccggaggucagcaacacuuucugaaagacaaccuuaucgaucugggcugcccgaagauucccuugcucgggaaaauggccaucuauauuuguaggaugucuaaucauccuaagacaaccauggcguuccuguuuugguucagcuuuggauacgucaucacgugcauaauuugcaaagugaucuucuaucugcucauuaucguaggcacuuuagguaagcgguuuaagcaguaccgcgaacugaaaccacagaccuguacaaucugcgagacuacccccguuaacgcuauugacgccgagaugcacgaucuuaauuguuccuauaacauaugcccuuacugugcaucaagauugacaagugacgggcuggccaggcaugugacccagugcccaaagcggaaagaaaaggucgaggaaacggagcuauaccucaaucuggaacgcauccccuggguggugcgaaaacuucugcaagucagcgagucuacuggaguugcuuugaagagauccucauggcucgugguacuguuagugcugcucacagucagccuuaguccugugcagucugcaccaauuucccacggcaaaaccguugaggccuauagggcucgggaaggcuacacuagcaugugucuguucguguuggggucgguccuauuucuggugucuugccucaugaagggacugguagacuccguugguaacacauucuuuccgggccuuucaaucuguaagaccugcaguauaagcuccauuaauggguucgagaucgaaucucaccguuguuauugcagccuguuuugcugucccuacugccgccauuguucagccaacaaagagauccaccaguugcaucucaguauuugcaagaaaagaaaggcgggauccaaugugaugcuggcagucuguaaaaggaugugcuuccgggccacgauggaagugagcaaccgagcuuuauucauccgcucuauuauaaauaccacauuuguccuguguauccuaauucucgccgcaugcgugguuucaacuagcgcuguggagauggagagccugccugccggcaccugggaaagagaggaagaucuuacaaacuucugucaccaggagugccaaguagcggacacugaauguuugugcccauaugaggcccugguccucaggcggccccuguuucuugauuccaucgugaaggguaugaagaaccugcucaauucuaccucguuggagacaagccuguccaucgaagcaccuuggggcgcuauuaacguucagucaaccuacaaaccaacugugaguacggccaauauagcuuuaucuuggagcuccgucgagcaccgcgggaacaagauccuggugucaggaagaagcgaaucuauuaugaaacuagaggagaggacaggcaucuccugggaccucgggguagaagaugccagugagagcaagcugcuuaccgugucuguuauggacuugucccagauguauucacccgucuucgaauaccugaguggagaucgucaaguggaggaauggccgaaagcaacuugcaccggugacuguccugagcggugcggcuguacaagcucgaccugccuccauaaggaguggccccacucccgaaauuggagauguaacccaacuuggugcuggggaguggggacaggcuguacgugcuguggucuggaugucaaggacuuauuuaccgauuacauguucguuaaauggaagguggaauauauuaaaacugaggccaucgugugcguagaacugacaucucaggagaggcaguguagccuuauagaagcugggacccgcuuuaauuugggcccugucacaaucacucucucagagccccggaacauucagcaaaagcugccacccgagaucauuacccuacauccuagaaucgaagagggauucuuugaccugaugcacgugcagaaaguucucagugcguccacggugugcaagcugcagucuugcacccauggcgucccaggggaccuucagguguaccacauaggaaauuugcugaagggugauaaaguuaacggccacuuagugcauaagauugaaccgcacuucaauacaagcuggauguccugggacgggugugaucucgacuauuacugcaacaugggagauuggcccucauguacuuauaccggcguaacacaacauaaucacgcaaguuuugucaacaugcugaauaucgagacugacuacaccaaaaacuuccacuuucauaguaagagggugacggcccacggugauacaccucagcuugaccugaaagcucgcccaaccuauggggccggcgaaauuacuguguuggucgagguugcagauauggagcuccauacaaagaaaaucgaaauaucuggacugaaguucaccucccuaacuugcaccggcuguuacgccugcagcucggggaucucauguaaggugcggauucacguagacgagcccgaugaacugacagugcaugucaaaucugaggacccugaugugguugcugccaguuccagccucauggcacgaaagcuggaguucggaacggacucuaccuuuaaagcguucagcgcuaugccaaagacuucccuuugcuuuuacaucguggaacgugaguauuguaaaucaugcagugaagaggacacacagaagugugucaacaccaaguuggaacagccccaaagcauucugaucgagagaaaaggcacaauaauugguaagcagaauaacacuugcaaagccaaggcagggugcugguuagagucugugaaauccuucuuuuacggacucaagaauaugcugucaggcaucuucgguaacguuuuuaucggcauuuuccuuuuucuggccccguucauccuacucauucuguuuuucauguuuggguggaggauauuguucuguuucaagugcugucgccggaccagaggacuguuuaaauauaggcacuuaaaggaugacgaagagacgggcuaccgaaaaaucauugaacgccucaauaacaagaaagggaagaauaagcugcuugauggagagcggcuggcugacagaaggaucgccgaauuguucaguacaaaaacccacauuggc

SEQ ID NO: 10457 - RNA, 3495 nt, Artificial Sequence
  derived and/or modified CDS sequence (opt3) from CCHVF(CCHVF UG3010)__AY900143.1__Gn-NSm-Gc
gccgagggcgugagcaacgacugcgucuccagaacccagcugaucaagacagaaguugcugagauucacgaagauucuuacgggggacccggugagaaaauaacuaucuguaauggcucaacgauuguggaccaaaggcucgggagugaacuuggaugcuauaccaucaaccggguaaagacauacaaacugugugagaauagcgcaacugagaagggcugcgaaauugauuccgugccugucaaauguaagcaggguuucugcuugaaggugacccaggaggggcgcggacauguuaaauuaucucgaggcacagaaaucgugcuggacgucugugauaccucgugcgagcuaaugauaccaaagggcacuggggacauccucguggauuguucaggaggucagcaacacuuucugcaggacaaccuuauugaucugggcugcccgaauguacccuugcucgggaaaauggccaucuauauuugucguaugagcaaccauccuaagacaaccauggcguuccuguuuugguucaguuuuggauacguuaucacgugcauagugugcaaaguccuguucuaucucuuaauugugaucggcacucuguccaagaagcugaaacaguacagagaguugaagccacagaccuguauugugugcgaaucuacacccgucaaugcuaucgacgccgagaugcacgaacugaacuguaauuauaacaucugcccuuacugugcaagcaggcuaacuuccgauggucucguucggcaugugaaucaaugcccaaaacgcaaggagaaaguagaagagaccgagcuguaccuuaaccuggaaaggauucccugguuggugaggcggcuccugcaggucucagagaguacagggauggccuuaaagcgcagcuguuggaugaccacgcugcucauacuucuggugguuucuuuguccccugugcagucagcuccagucggacagggcaaagcaguggaaguauaucgaguuagagagagcuacaccaguaucugccuauuugugcugggcucuguccucuucgccguguccuggcugauuaaggggcuuaucgacggaauagguaauagcuuuuucccgggccugucggucuguaagacaugcucuauuggguccaucaacggauuugaaaucgagucacacaaauguuauugcaguuuguucugcugucccuacugcagggcuuguagcuccgauaagauuacccaccggaugcaucucaaugugugcaaaaagcguaaagccggcucuaacguuaugcuggcgguguguaagcgcaugugcuuuaaggcaacuguagaggccagcaacacagcuuuacugaucagagguauuauaaauucaaccuucgucaucugugugcuaauucucguuaucugcguggucaguacguccgccguggacauggaaaaccugccugcagggaucugggagagggaagaggaccuuaccaauuucugucaccaagaaugccagguaacagagacugaguguuugugcccauaugaagcucugauucuccggaaaccccuguaccuugauagcauagccaagggcaugaaaucucuguugaacucaaccaaucucgagacaagucugagcaucgaagcgccuuggggagccauuaacgugcaguccacuuuuaagccaaccguuucugcagcuaauaucgccuuaucguggagcuccgucgagcaucgaggcaacaaaauucuggugucagggcgcagugagucuaucaugaagcuagaagagagaacaggaauaagcuggucccucgguguggaagacgcuucagagagcaagacccugacugucucuguuauggaucuuucccaaauguauagucccguguucgaauacuugagcggcgacagacagguggaggaguggccgaaagccacgugcacaggggauugucaggaacggugcggauguaccucuuccacuugccugcacaaggaguggccucacucacgcaauuggagauguaaccccaccuggugcuggggcguagguacaggguguaccugcuguggccucgacgucagggaucuguuuacugacuacaugauggugaaauggaagguugaauaugugaaaacagaggcaaucaugugcgucgaauuaacgagucaggagcgucaauguagccugauugaggccggaacccgguucaaucuuggcccagugacuaucacauugucggaaccucgaaacauucagcagagacuccccuccgagaucguuacccugcauccaaagauagaagagggguuuuucgaucuaaugcacgugcagaagguacugucugcuagcacagucugcaaacuccaaucaugcacucauggagugcccggugaccuucagguguaccacgucggcaaucuuuugaagggggauaaaguuaacggacauaguauucacaagaucgaaucccacuuuaauaccucuuggaugagcugggacggcugugaccuggauuauuucugcaacaugggugacuggccuuccuguacguacaccggggugacacagcauaacagggcggcauuuauuaauauguuaaacaucgagacugauuauaccaaaacauuccacuuucauucaaagcgcguaacugcccacggcgacaccccacagcucgaucugaaagcucggccgacguacggagccggcgaggugacaguccuuguggaaguugcagaccuggaguugcacaccaagaagauagaagugagcgggcucaaauucgccagucugacuugcucuggauguuaugcuugcuccagcggcaucucguguaaggucaggauucaugugaaugagcccgaugaguuuacaguucacgugaaaucaucugacccugaugucguagccgcagguaguucccuaauggcgagaaagaucgaauuuggggcugacagcaccuucaaagccuuuucuagcaugccaaagaacucccugugcuucuacauuguggagcgcgauuacuguucaaguugcacuaaugacgauacccaaaaguguguugacacaaaacucgaacauccccagagcauccugauagagcacaagggaacgauuaucggcaaacagaacgacacuugcucuacuaagacauccugcuggcuugaaucagugaaaaguuucuucuaugguuugaagaauaugcugggcgggaucuuuggaaacgucuucuuaggcauuuuucucuuccuggcaccuuuugcccuucugaucuucuuuuucuuuuucggguggcgacuacucuucugucugaagugcugucggcguaccagaggauugcugaaauacaagcaguuaaaagaugaggaggaagcuggcuauaagaaaauuauagagaggcucaaugacaagaaggguaaaagccgccuguuugauggggaacggcuugccgacagaaagaucgcagagcuguucuccacaaaaacucauauugga

SEQ ID NO: 10458 - RNA, 3495 nt, Artificial Sequence
  derived and/or modified CDS sequence (opt3) from CCHVF(CCHVF Hy13)__AY900145.1__Gn-NSm-Gc
agcgaggaauccggcgacgauugcaucucuagaacccagcugucaaggacagagacugccgaaauucacagugacaacuacgggggacccggugauaagauaacgaucuguaauggcagcaccauuguggaccaacggcucggguccgagcuuggaugcuauacaaucaaccgcgucaaaucuuucaagcugugugaaaauucggcuacuggcaaaucaugcgagauugauagcaccccuaucaagugucgacaggguuuuugcuugaaaauaacacaggaggggcguggacauguuaaguuaaguagaggcuccgaagugguacuggacgcaugugauucuagcugcgagaucaugauuccaaagggcaccggggacauccuaguggauuguuccggaggucagcaacacuuccucaaagacaaccugauugaucuuggcugcccgaauaucccccuguuggggaagauggccauauacauuuguaggaugucaaaccauccuaaaacuacaauggcguuucucuucugguuuaguuucggauaugucauuaccugcauucugugcaaggugaucuuuuaccugcucaucguugugggcacguuagguaaaaaguucaagcaguaucgggaacugaaaccacagacuuguaccauuugcgagacaacucccgucaaugcuauagacgccgagaugcacgaucuuaacuguagcuacaauaucugcccuuauugugcaucucgcuugaccuccgacgggcuggccagacaugugaugcagugcccaaagaggaaagaaaagguagaggaaacagagcuauaccucaaccuggaacggauucccuggguugugcgcaaacuucugcaagucucagagagcaccggaguggcuuugaagcgaaguucuuggcucgugguccuguuaguucugcucacggugucccuuagcccuguacagucggcaccaaucggccacggcaaaacuguggagacauaccagaccagagaaggguauacuucuauaugucuguuugucuugggauccauucuauucaucgugucaugccugaugaagggucucguugacagugugggcaauagcuuuuucccgggguccucuaucuguaagacaugcagcauuggaucaaucaacggcuuugagauugaaagucacaaauguuacugcucccuguucugcugucccuauugcaggcauuguagcgccgaucgggagauacacaagcugcaucugucuaucugcaaaaagcguaaaaccgguucaaaugucauguuggcuguguguaagcgcaugugcuucagagccacgguagaaguuaguaacaaggcgcuccugauuaggaauaucaucaacaccacauuuguggucuguauuuuaauacuggcagugugcgucgugagcacuuccgccguugagauggagucucuaccugcugggaccugggaacgggaggaagaccucacaaacuucugucaccaggagugccaagccacugaaaccgagugucugugcccauacgaggcacuuguguugcgaaaaccccuguuuucggauagcaucguaaagggcaugaaaaaucuccugaacuccacaucacuugaaaccagucugucuauugaggcuccuuggggagccaucaauguccagagcacuuucaagccaacgguguccgcggccaacauugcauugucauggagcucuguugaacaccgcggcaauaaaauccucguguccgggagaagugagagcauaaugaagcuggaggaaaggacaggaaucucuugggacuuaggugucgaggaugcuuccgaaucaaagcugcuaaccgugaguauuauggaccucagccagauguauucgcccguauuugaguaccuguccggcgaucggcaaguggaagaguggccgaaagccacuugcaccggggacuguccugagcgcugcggauguacaucuucaaccugccuucauaaggaauggccccacagcagaaacuggagguguaauccaacuuggugcuggggcguugguacaggguguacgugcuguggcuuggaugucaaagaccuguucaccgaucauauguuugugaaguggaaaguggaguauaucaagacugaagcuauugucugcguugagcucacaagucaggaacgucaguguucccugaucgaggccggaacccgguucaacuuaggcccugugacaauaacucugucugagccccgaaauauucagcaaaaacuuccacccgaaaucgugaccuugcacccuagaauugaggaaggguuuuucgaccucaugcauguaaagaagguccugagcgcauccacggugugcaaacuacagucaugcacccacggaguuccaggugaccuucagguguaccacaucggcaaccuccugaagggggauaaagucaauggacaucuuauacacaagaucgagccgcauuuuaacacaagcuggaugaguugggacggcugugauuuggacuacuauugcaauaugggugauuggcccucuuguuccuacacuggggugacccagcacaaccacgccgcuuucguuaauaugcugaacauugaaacagacuauacuaaaaucuuucauuuccacagcaagagggugaccgcgcauggcgauacgccucaauuagaccucaaggcacgcccaacauacggagccggcgagauuaccguacuggucgagguggcugauauggaacuucacacuaaaaagaucgagauaucggggcugaaauucgccucauugacaugcaccggauguuaugcaugcucuaguggcauuuccuguaaggugcggauccaugucgacgaacccgaugagcucacuguucacgugaaaagcgaggacccugauaucguagccgcuucuagcucccugauggccagaaagcuagaauuugguaccgacucaacauucaaggcauuuagugcgaugccaaaaacgagccugugcuucuacauuguggagagggaauauuguaagucuugcuccaaagaggacacccagaagugugucaacacuaaacucgaacagccccagucaauccugauugagcacaaggggacaauaaucggaaagcaaaaugauaccugcacaaguaaagcuggcugcuggcuugagagcgugaaguccuuuuucuacgguuugaaaaacaugcugucuggcauuuuugggaauguuuucaucggaaucuuuuuauuccucgccccguuuauccugcuuauacuguucuuuauguucggcuggcgcauccuauucuguuuuaagugcugucgacggacucguggacucuucaaauacagacaucugaaggacgaugaagagaccggguauaggaagauuaucgaacgcuugaacaauaaaaagggcaaaaacaagcuguuagacggugagcggcucgcagauagaaaaauugccgaacuguuuucgacgaagacacacaucggg

SEQ ID NO: 10459 - RNA, 3495 nt, Artificial Sequence
  derived and/or modified CDS sequence (opt3) from CCHVF(CCHVF Semunya)__DQ094832.1__Gn-NSm-Gc
gccgagggcgugagcaacgacugcgucuccagaacccagcugaucaagacagaaguugcugagauucacgaagauucuuacgggggacccggugagaaaauaacuaucuguaauggcucaacgauuguggaccaaaggcucgggagugaacuuggaugcuauaccaucaaccggguaaagacauacaaacugugugagaauagcgcaacugagaagggcugcgaaauugauuccgugccugucaaauguaagcaggguuucugcuugaaggugacccaggaggggcgcggacauguuaaauuaucucgaggcacagaaaucgugcuggacgucugugauaccucgugcgagcuaaugauaccaaagggcacuggggacauccucguggauuguucaggaggucagcaacacuuucugcaggacaaccuuauugaucugggcugcccgaauguacccuugcucgggaaaauggccaucuauauuugucguaugagcaaccauccuaagacaaccauggcguuccuguuuugguucaguuuuggauacguuaucacgugcguggucugcaaagugcuguucuaucucuuaauagugauuggcacucuggguaagaaacuuaaacaguacagagaguugaagccacagaccuguaucgucugcgaauccauucccguuaaugcuaucgacgccgagaugcacgaacugaacuguaauuauaacaucugcccuuacugugcaucuaggcuaacaagcgaugggcucgugcggcauguaacucaaugcccaaaacgcaaggagaaaguggaagagaccgagcuguaccuuaaucuggaaaggauucccugguuggucagacggcucuuacagguguccgagucaacaggaauggcccugaagcgcaguuguuggaugaccacgcugcucauacuucugguugugagcuugucuccuguccaguccgcuccagugggccaggaaaaagcaaucgagguauaucaaguucgagaaucauacacuagcauuugccuauuugugcugggcaguguccucuucgccgugucuuggcuggucaaggggcuuaucgacggaauagguaacuccuuuuucccgggccugagcguguguaagacaugcucgauugggucuaucaauggauuugagaucgagucccacaaauguuauugcucauuguucugcugucccuacugcagagcuuguaguagcgauaagauuacccacaggaugcaucucaacaucugcaaacggcguaagguuggcuccaaugugaugcuggccguauguaaacgcaugugcuuuaaggcgacugucgaagcaucuaacagcgccuuacugauuagaucaauaaucaacaguacauucgugauuuguguucuaauccucgugaucugcgucguguccaccagcgcuguagacauggagaaucugccugccgguauuugggaaagggaggaagaccuuacgaacuucugucaccaggagugccaggugaccgagacagaauguuugugcccauaugaggcacugauacuccggaagccccuguuucuugauucuaucgcuaaagggaagaaaucacuguugaauaguacuaaccucgaaaccagccuguccauugaggccccuuggggcgcgaucaauguucaaucuacauucaagccaacugucucggccgcaaacauugcuuuaagcugguccucaguggagcaucgaggaaauaaaauccuggugaguggccgcucugaaagcauaaugaagcuagaggaaagaaccgggaucuccuggucacucggagucgaggacgccagcgaaucuaagacacugaccguuuccgugauggaucuuagucagauguacagccccguguuugaguauuugucuggugacaggcagguagaggaauggccgaaagcuacuugcacgggcgauuguccugagcggugcggguguacauccucaaccugccugcacaaggaauggccccacagucgcaacuggagauguaauccaacuuggugcuggggagucggcaccgguuguacaugcugugggcucgacgugagggaucuguucaccgacuacaugaugguuaaauggaagguggaguacgucaaaacugaagccauuaugugcguggaguuaacaagccaggagcgucaauguucgcugaucgaagcaggcacgcgguuuaaccuuggaccuguuaccauuacuuuguccgagccccgaaaugugcagcagagacucccaucugaaaucguaacacugcaucccaagauagaggaaggcuucuuugaucuaaugcacguccagaaggugcuguucugcaaauauagccuccaagccaccucaugcacacauggggugccuggagaccugcaggucuaccacguugguaaccuuuugaagggcgauaaagugaaugggcauaguauucacaagaucgagucccacuuuaacacuucuuggaugagcugggacggaugugaccuggauuauuucugcaauaugggcgacuggccauccuguaccuacacggguguaacccagcauaacagggcugcguuugugaacauguuaaauauugagacagauuauacuaaaaccuuccacuuucauucaaagcgcgucacagcacacggggacacuccgcagcucgaucugaaagcccggcccaccuacggcgcuggagaagugacgguucuuguggaggucgccgaccuggaauugcacacaaagaagaucgaggugagcggccucaaauucgcaagucugaccugcucuggguguuaugccugcuccagcggaauaucguguaagguuagaauccaugugaacgagccugaugaguucacuguccacguaaaaucaaaugacccagaugugguugcugccggcucuagucuaauggcaaggaagauugaauuuggugcggacuccacauucaaggcuuuuagcucuaugcccaagaacagccugugcuucuacaucguggaacgcgauuacuguuccucaugcaccgacgaugacacucaaaagugugucaauauuaaacucgagcauccucagaguauccugauagaacacaaggggaccauuaucggaaaacagaacgacacaugcccaacgaagaccagcugcuggcuugagucugugaaauccuuuuucuauggcuugaagaauaugcuggguggcaucuuugggaacguauucuuaggaauuuuucucuuccuggcccccuuugcacuucugauccuauucuuuuucuucggcuggcgacuccuguuuuguuugaagugcugucggcguacuagagggcuguuaaaauacaagcagcucaaagaugaggaagaggccggauauaagaaaauuauagaaaggcugaaugacaagaagggcaaaucacgccuuuucgauggugagcggcuggcugacagaaagaucgccaaauuguuuaguacaaagacccauauuggg

SEQ ID NO: 10460 - RNA, 3495 nt, Artificial Sequence
  derived and/or modified CDS sequence (opt3) from CCHVF(CCHVF SPU128/81/7)__DQ157174.1__Gn-NSm-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaagagcuucaaauugugugaaaauuccgcuacuggcaaaucuugcgagauugagucgguuccagugaagugucgacaggguuacugcuuacguaucacccaggaagggagaggacauguaaaacugucaaggggcagcgaggugguccuagaugcaugugacacaaguugcgaaauaaugaucccgaagggcaccggggauauucucguggacuguuccggaggucagcaacacuuucugaaggauaaccuuaucgaccugggcugccccaaaauuccuuugcucgggaagauggccaucuauauaugucggaugucuaaucauccaaaaacuacaauggcguuccuguuuugguucagcuuuggauacguuauuaccugcauccugugcaaggcuauuuucuaucucuuaaucaucauuggcacgcuggguaaacgcuuuaagcaguacagagagcuuaagccccagacuuguaccauaugcgagacaacuccugugaacgccaucgaugcagaaaugcacgacuugaauuguuccuauaacauuugcccauacugugccucaaggcugaccagugaugggcuagcucggcaugucacacagugccccaaacgcaaggagaaaguggaagagaccgaacucuaccugaaucuugagcgaaucccuuggguaguuagaaagcuguugcaagugagcgagucuacgggagucgcacucaaaagguccucauggcugauaguguuacugguccucuucacugugagccuuaguccaguucagucugccccgauuggccacggcaagacaaucgaggcuuaucgggcccgugagggguacaccuccaucugucuguuuguguugggaagcauucuauucaucguaucgugccugaugaaaggucucguggacucugucggcaacuccuuuuuccccgggcugucaauuuguaagacuugcaguauaagcuccaucaauggauuugaaauugagucucacaaguguuauugcagccuuuucugcuguccuuacugccgccauuguucagcggacaaagaaauccacaagcugcauuugaguaucugcaaaaagagaaaaacaggcuccaacgugaugcucgcaguuuguaagaggaugugcuuccgggccaccauggaggugagcaaucgagcucuguuuauucgcucuauaaucaacacgaccuucgucuuauguauucugauccuagccgugugcguaguuucaacaagugcaguggagauggaaaaucucccagcugguacuugggagagagaagaggaucugaccaacuuuugucaccaggaaugccaggucacagagacugagugucuuugccccuaugaagccuuggugcugaggaagccucucuuccuggacagcauugucaaagggaugaagaaccuucucaauuccaccucuuuggagacaucgcucagcaucgaagcgccauggggcgccauaaacgugcaauccaccuacaaacccacuguuucaacggcaaauaucgcucugaguuggucuagcguggagcaccggggaaacaagauuuuaguauccggccgcucagagagcaucaugaaacuggaagagagaacagggauuucuugggaucuaggagucgaagacgccuccgagaguaagcuccugaccgugagcguuauggaucuuucucagauguauuccccgguguuugaauacuugucaggugacaggcaggucgaggaguggccuaaggcuacuugcaccggcgauugucccgaacguugcggguguacaaguucgaccugccugcauaaagaguggccacacagccggaauuggcgauguaacccuacuuggugcuggggagugggcacagguuguacgugcugugggcucgacguaaaggaucuguucaccgacuacauguuugugaaauggaagguugaauauaucaaaacugaggccauagucugcguggaauuaacaucccaagagagacaguguucucugauugaggcaggcaccagguucaaucuuggacccgugacaaucacuuugagcgaaccacgcaacauucagcagaagcugcccccugagaucauaacccugcauccacggaucgaagagggcuuuuucgaucuaaugcacguccaaaagguucugucagccaguacggugugcaaacuccaguccugcacccauggggugccgggagaccugcagguauaccacauugguaaucuuuugaagggcgacaaagucaacgggcaccugauccauaagauugaaccccacuuuaauacaucuuggaugagcugggauggaugugacuuagauuauuacugcaacaugggcgacuggccuuccuguacuuauaccggugugacacagcauaaucacgcuucauucguuaaccuccugaauaucgagacugauuacaccaaaaacuuucacuuccauagcaagagagugacggcgcacggggacacaccacaacuugaucugaaagcaaggcccaccuauggcgccggagagauaacugucuugguggaaguugcugacauggagcuccauacaaagaagauugaaaucaguggccugaaauucgccucucuaaccugcacuggguguuacgcaugcuccagcggaaucucguguaaggugcgcauucacguagaugagccugacgagcugaccguccaugugaaaucagaugacccagauguggucgccgcuucuaguucccucauggcccgaaagcuggaauuuggcacagacagcacguucaaagcauuuucugcgaugcccaagaccagccuuugcuucuacaucguugagcgggaacacuguaaguccugcucagaggaagacacuaaaaagugugugaacacaaaauuggagcagccgcagaguauucugauagagcacaaggguaccaucauugggaaacagaauagcacaugcacugcuaaggccucuugcugguuagaauccguaaagucauuuuucuauggacucaaaaacaugcugaguggcaucuuugguaauguguucauuggcaucuuucuuuuccuggggccuuuuauacuacucauccuguucuuuauguucggauggcguauuuuguucuguuuuaagugcuguagaaggacccgcggccuguuaaaauaccggcaucucaaggaggaugaagagacgggguauagaaggaucauugaacgacugaacaauaaaaagggaaagaacaaacuucuggacggcgagcgcuuggcagaucggagaaucgccgaacucuucagcacaaagacccacauaggu

SEQ ID NO: 10461 - RNA, 3495 nt, Artificial Sequence
  derived and/or modified CDS sequence (opt3) from CCHVF(CCHVF ROS/HUVLV-100)__DQ206448.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaagagauccucauggcucauaguccuguuagugcugcucacggugagccuuaguccgguccagucugcucccguuggccacggcaagacuauugagacauaccagaccagggaaggguuuacuuccaucugucuguucauguugggaagcauccuauuucuggugucgugccucguaaaaggucugguggauucugucuccgacucauucuuuccuggccuuaguguguguaagacaugcagcauuggguccaucaacggauucgagauugaaucucauaaguguuauugcagccuguucugcuguccauacugccggcacuguucagccgaucgugagauacaucaguugcaccucaguaucugcaaaaagcgcaaaaccggcuccaauguuaugcuggcgguguguaagagaaugugcuuuagggcaacgauugaagccagccggcgagcuuuacugauccgcucuaucauuaacaccacauucgucauauguauccuaacucucaccauuugcgugguaucaacaagugccguugagauggagaaucugcccagcgguacuugggaaagagaggaagaccuuaccaacuuuugucaccaagagugccaggugacagaaaccgaguguuugugcccuuaugaggcacugguccucaggaaaccacuguuccuugauuccaucgugaaggggaugaagaaucuguugaacucuacuucgcucgaaacgagccuguccauugaggcucccuggggcgccaucaacguccagucaacauuuaaaccgaccgugaguacugcgaauauagccuuaucuuggagcuccguugaacaucggggaaacaagauccuggugaccggccgcucagagagcauuaugaaacuagaggaaagaacagggguaucuugggaccucggagucgaggaugcauccgaaaguaagcugcuuaccgugagcaucauggacuugucucaaauguacuccccuguuuucgaguaucugucaggugaucgucagguggaagaguggcccaaagcuacuugcacaggcgacuguccagagaggugcggguguacgaguucuaccugccuccacaaggaauggccucauucgcggaauuggcgauguaaccccacuuggugcuggggagucggcacagguuguaccugcugugggguggauguaaaggaccuguuuacagaccacauguucgugaaauggaagguugaguacauuaaaacugaagccaucgucugcguggaguuaaccucccaggaaagacaguguucucugauagaggcuggcacgagguuuaaucuuggaccagugaccauuacauugagcgagccccgcaacauccaacagaagcucccuccagaaauuaucacucugcauccgaaagucgaggaaggcuucuuugaucuaaugcacguucagaaggugcugucagccaguaccgugugcaagcuccaguccugcacacacgggauacccggagaccugcaaguauaucauaucgguaaucuuuugaaaggcgaucgggucaacgggcaccugauucauaagaucgagccucacuucaauacuucuuggaugagcugggacggaugugauuuagacuacuacugcaacaugggcgauuggccauccuguaccuauacgggugugacacagcacaaucaugcagccuuuguuaaccuccugaauauugaaaccgacuacacuaaaacauuccacuuccauucaaagagagugaccgcucacggggauacuccccagcuugaccugaaagcgaggccuaccuauggcgcaggagagaucacagucuugguggagguugccgauauggaacuccauacgaagaaaguggagauaagcggccugaaguuugcuagucuagccugcaccggguguuacgcaugcagcuccggaauuagcuguaagguacgcauccacgucgacgaaccagaugagcugacugugcacgugaaaucgucagaccccgacgucguugccgcuucuacaagucucauggcccgaaagcuggaguucggcaccgauuccacauuuaaagcauucagcgcgaugccgaagacuucucuuugcuuuuauaucguggaacgggaguacuguaaaagcugcuccgaagaggacacccagaaguguguagauacgaaguuggaacaaccucagucaauucugaucgagcauaaagguacaauuauagggaagcagaacgauaccugcacugcuaaagccaguugcugguuagagagcgugaagucuuucuuuuauggacucaaaaauaugcugggcuccgucuucgguaacuuuuucaucggcauucuucuguuucuagcaccauucgugcuccugguuuuguuuuucauguucggguggaagauccuguuuuguuucaagugcugucguagaaccaggggauuacucaaauaccgccugcuuaaggacgacgaagagacaggcuaccggagaauuaucgaaaggcugaacaauaaaaaggggaaaaaccgauugcucgauggagagcgccuggccgaccggaagauagcugaacuauuuucaacuaagacccacaucggc

SEQ ID NO: 10462 - RNA, 3495 nt, Artificial Sequence
  derived and/or modified CDS sequence (opt3) from CCHVF(CCHVF AP92)__DQ211625.1__Gn-NSm-Gc
agcgagggcggggacggagguugcaucuccagaacccagcugauuaagacagaaacugccgaggugcacggcgaugacuacgggggacccggcgagaaaauaacgaucuguaacgguucuaccauugucgaucaaaggcucgggucagaacuuggaugcuauacaaucaaucggauuaagaguuucaaacugugugaaaacagcgcucagggcaagaauugcgagaucgacuccgcaccuguucagugucgccagggcuacugcuugaaaauaucucaagaggggcgaggacaugugaaguuaucgcgugguucagaaaucguacuggaugugugugacacuagcugcgagauuaugaucccaaagggcaccggggauauucuagucgacuguaguggaggccagcagcacuuucuccaguccaaccugguggaucuugguugcccgaauaucccccuguuggggaaaauggccauauauauuuguagaaugucuaaccauccuaagacaaccauggcguuccucuuuugguucagcuuuggauacguuaucacuugcauucugugcaaaacacuguucuauauccucaucauuauaggcaccuuaggcaagaaacugaagcaauacagggaacuuaagccacagacguguacuaucugcgaguccgugcccgucaaugcuauugacgccgagaugcacgauuugaacuguucauauaauaucugcccuuacugugcaagucggcugaccagcgaagggcuaacacgccaugugaaccagugcccaaaaagaaaggagaaaguagaagagacugaacucuaccugaaucuugagaggauacccuggauuguucggaagcugcuccaggugucugaguccaccggagucgcccucaaacgcucaagcuggaugaucgugcuguuaauccugcucauugugaguaugucuccuguccaauccgcuccaaucagccaggaacgaacaguugcacuuuaucagucgagagaggacuacauggguauuugucuggugauaaugggcucuguauugcuagccgugucccugcucgucagggggcugaucgauucaauuaguagcaccuuuuucccgggacuuuccgugugccggacgugucacaucggcucuaucaacgguuuugaaauugagagccacaagugcuauugugggcuguugugcugccccuacugucgugcuugcucaacugaccaagacgcccaucaguuccaccucaguguuuguaaaaagcgcaaggcgggcuccaaugugaugcuggcagucugcaaaagaauguguuuuaaggccauaaucgaagcuagcaacaaaguguuauucauuaggaauguaaucaacacaaccuuuguugugugcauucuggucaugguggccuguaucgcaucuucagcugccgucgagauggagaaccuaccugcgggaacuugggaacgggaggaagaguugacaaauuucugccaucaggaaugucaggugaccgagacggagugccuguguccauaugaaaguuucauacuucgaaagcccuuguuucuggauagcaucgccaaaggcguuaagaaccuccugaauaguaccucucuugagacaucgcugagcauugaagcaccuuggggagcuaucaacgcccaauccacuuacaagccaaccgcuucaagugccaauauugcauugacauggucuagcguggagcaccgcgggaacaaaauccucguauccgguagaucagagagcauaaugaagcuggaagagaggacuggcauuucuuggaauuuaggggucgaagacgccuccgagagucggacccugacaaucagcgugauggaucuaucucagauguauucccccguuuucgaauaccucucaggagaccgccagguggaggaguggccgaaagcuaccugcacuggcaacugcccugaaagaugugguugcacgaguagcacaugucuguacaaggaguggccccacucgaggaauuggcguugcaacccaaccugguguuggggcgucgggacuggaugcaccuguugcggccuugaugugaaagaauuguuuacagaccauaugcugguaaaguggaagguggaguauauuaaaaccgaagcgaucguuugugucgagcucacuucccaggagcggcaaugcucucugauagaagcagggacacgauucagcuuaggaccugugacgaucacccugucagagcccagaaauauucagcagaaacuuccacccgaauugaucacucuccacccuaaaauugaggaugguuacuuugaccugaugcaugugcagaaggucaugagugccuccacaguuuguaaacuacaaucuugcacccacggcgugccaggggaucugcagaucuaucaugugggaaaccuccugaagggcgacaggguaaauggucaccuuauacacaaggucgaaccgcauuugaacacaagcuggauguccugggaugggugcgaccuggacuacuucuguaauaugggcgauuggcccucaugcacuuauaccggagugacgcagcacaaccaugcugccuuugcaaacuuacucaauauugagaccgacuacacaaaaacuuuccacuuucacagcaagcgcguuaccgcccauggcgauacaccucagcuggaccuuaaagcucggccaagauauggggccggagagaucacugugcuggucgaaguggcagauauggaguugcacaccaagaaaguugaagugacgggccucaaguucgcgagucugacauguucugguugcuacgcuuguuccagcgggaucucgugcaaaguaaggauucaugucgacgagcccgaugagcuaaccgugcacgugaagucaucugacccugauaucgucgccgcaaguuccagccugauggcccgcaagauugaauuuggaguugacucuacuuucaaggcuuuuagcuccaugccaaaggauucacucuguuucuacauaguggagcgagacuauugcaacaguuguaaaaaugaagagacacaacggugcguaaacgccaagcuggaacagccccagagcauccuuauugagcauaccggcacuaucauugguaaacaaaaugauaccuguggcucucguacauccugcugguuggacucauucaaguccuuuuucuacgggcuuaagagcauguuauccggaaucuuuggcaacguguuccucgggauauuucuguuccuugcaccguuugcucugcuacucuucuuuuucuuuuucggauggagaauccuguuuugcuucaaauguugcaggcgcacgcggggcuuguucaaguauagacacauuaaagacgaugaggaagucgguuacaagaaaaucauugagaggcugaauaacaagaaggggaaacaccgauuacucgacggagaacgccuggccgaucggaagaucgcggagcuguuuucuaccaaaacucauauaggc

SEQ ID NO: 10463 - RNA, 3495 nt, Artificial Sequence
  derived and/or modified CDS sequence (opt3) from CCHVF(CCHVF ArD8194)__DQ211626.1__Gn-NSm-Gc
gccgagggcgggagcaacgacugcguguccagaacccagcuggucaagacagaaguugcugagauccacgaagauucuuacggaggucccggcgagaaaauuacuauauguaaugggucaacgaucguggaccaaaggcucggaagugaacuuggcugcuauaccauuaaccggguacgcacauacaagcugugugagaauagcgcaacugagaaauccugcgaaaucgauucugugccugucaaguguaaacaggguuucugcuugaagauuacccaggaggggcgaggacaugugaaguuaucgcguggcacagaaaucguucuggacgugugugauaccucaugcgagcuaaugauaccaaaaggcacuggggacauccucgucgauuguagcggaggucagcaacacuuucugcaggacaaccuuauugaucugggcugcccgaauauccccuugcucgggagaacagccauuuauguguguaggaugaguaaccauccuaagaccacgauggcguuccuguuuugguucuccuuuggauacguaaucacuugcguugugugcaaaguccuguucuaucucuuaauagugauuggcacccuggguaagcggcuuaaacaguaccgcgaguugaagccacagacauguaucgugugcgaaucuauucccgucaaugcuaucgacgccgagaugcacgaucugaacuguaauuauaacaucugcccuuacugugcaagcagacuaacuuccgacgggcucguuaggcaugugacccaaugcccaaagcggaaagaaaagguagaggaaacagagcuguaccuuaaucuggagcgcauucccugguuggugcgaaaacuccugcaggucucagaaaguaccggaguggccuuaaagagaagcuguuggaugauaacgcugcucauccuucugacuguuucuauguccccugugcagucagcuccagucggccacaaaagggcaguggagguauaucagaugcgggaaagcuacacaggcauuugcuuguuuguucuagggagugugcuguucgccgucucuuggcucgugaaggcucugaucgauuccauaggaaacagcuuuuucccgggucuuucgauuuguaaaaccugcucuaucggcuccaucaauggguuugagauugaaucacacaaguguuauugcagucuguucugcugucccuacugccgugccuguagcuccgacaagaucacucaucgcaugcacuugaacgucugcaaaaagagaaaagugggaucuaauguuaugcucgcgguguguaagaggaugugcuuuaaagcaacaauugaggccagcaaccgggcuaccuucauacgaaacaucauuaauucaacguucguaaucuguauccugauuuuagucauaugcgugguuaguaccuccgccguggacauggagaaccugccugcaggcaucugggaaaaggaggaagaucuaacaaauuuuugucaucaagagugccaggucacugaaaccgagugucucugcccauaugaggcucugaugcuucgcaagcccuuguuccuggacagaauugccaaagguaugaagagucuccugaacucuacaucacuugaaacuagccugagcaucgaggcgccuuggggcgccauuaaugugcaguccaccuuuaaaccaacaguaucugcagcuaacaucgccuugucguggagcuccguggaacacaaggggaauaaaauacucguuucaggaaggagugagucuaucaugaagcuggaggaacggaccggcauuagcuggugcuuaggggucgaggaugcuuccgaaucaaagacucugacggugagcgugauggaccuaucucaaauguacucccccgucuucgaguaucucaguggagaucgccagguugaagaguggccgaaagccacauguaccggugacugcccugagagauguggcugcacuagcucuaccugucugcacaaggaauggccccauuccaggaacuggcguugcaauccaacaugguguuggggaguggggaccggcugcacuuguugcggucuugaugugaaagacuuguuuacagauuacaugcugguaaaguggaaagucgaguacaucaagacggaagcaauuaucuguguggagcucaccucacaggaacggcagugcagucugauagaggccgggacucgauucaacuuaggcccuguuacaauuacccugagcgagcccagaaaugugcaacagaggcuuccacccgaaaucauuacauugcacccuaagaucgaggaaggauuuuucgaccucaugcauguccagaaagugaugucggcuuccacuguuugcaagcugcagucuuguacccacggcgugccaggggaucuacaaguauaucaugucggaaaccugcucaaaggugacaaggugaauggccacagcauacacaaaaucgagucacaucugaacacgaguuggauguccugggacgggugcgaucuugacuacuuuuguaauaugggagauuggccgucuugcaccuauacaggcgugacucagcacaaccaugcggcauucauuaacauguugaauaucgaaaccgacuacacaaagacuuuucacuuccacagcaaacgcgucaccgcccauggugauacgccccagcuggacuuaaaggcucggccugccuauggggcaggcgagauuacaguucucguggagguagccgaucuggaacuucacaccaagaaaaucgagguguccggacugaaguuugcuucauugagcuguaguggcugcuacgccuguucuuccgggauaagcugcaaagucaggauucaugugaacgaaccagacgaguucacuguucacgugaagucgaaugaucccgacgucguggcagcgggaucaucucucauggcuagaaaaaucgagaguggcgccgauuccacauucaaggcauuuagcucuaugccuaagaacagccuguguuucuauaucguugaacgcgacuacugcuccucauguaccgaugacgacacucagaaaugcguggauauuaagcuagagcauccacaaaguauccugauugaacacaaagguaccauaaucgggaagcagaaugacacaugccccacgaaaaccagcuguuggcucgagucuauuaaguccuuuuucuacggacugaagaacaugcuuucaggcaucuuugguaaugucuucuugggcaugcuguuauuucucgccccguucauucugcuuauccuguuuuucuuuuucggguggcgacuacucuuuugccugaaauguugccggcguacuagaaaguugcugaaauauaagcacuuaagggaugaagaggagaguggauacaaaaagauaaucgaacgccucaacgacaagaaaggcaagagccggcuguucgauggggagagacuugcugacaggaaaauugccgaacuguucuccacaaagacccauaucgga

SEQ ID NO: 10464 - RNA, 3495 nt, Artificial Sequence
  derived and/or modified CDS sequence (opt3) from CCHVF(CCHVF ArD15786)__DQ211627.1__Gn-NSm-Gc
gccgagggcgggagcaacgacugcguguccagaacccagcuggucaagacagaaguuacugagauccacgaagauucuuacggaggucccggcgagaaaauuacgauauguaaugggucaaccaucguggaccaaaggcucggaagugaacuuggcugcuauacaauuaaccggguacgcacuuacaagcugugugagaauagcgcuaccgagaaauccugcgaaaucgauucugugccugucaaguguaaacaggguuucugcuugaagauuacacaggaggggcgaggacaugugaaguuaucgcguggcaccgaaaucguucuggacgugugugauacuucaugcgagcuaaugauaccaaaaggcacaggggacauccucgucgauuguagcggaggucagcaacacuuucugcaggacaaccuuauugaucugggcugcccgaauauccccuugcucgggcagaccgcaauuuauguguguagaaugaguaaccauccuaagacgacuauggccuuccuguuuugguucuccuuuggauacguaauaaccugcguugugugcaaaguccuguucuaucucuuaaucgugauuggcacacuggguaagaggcuuaaacaguaccgggaguugaagccacaaacuuguaucgugugcgaaucuauucccgucaaugcgaucgacgcugagaugcacgaucugaacuguaauuauaacaucugcccuuacugugccagccgccuaaccuccgacgggcucguuagacaugugacacagugcccaaagaggaaagaaaagguagaggaaaccgagcuguaccuuaaucuggagcggauucccugguuggugcgcaaacuccugcaggucucagaaaguacgggaguggcauuaaagcgaagcuguuggauaaucacucugcucauucuucugacaguuucuauguccccugugcagucagccccagucggccacaaaagagcuguggagguauaucaaaucagggaaagcuacaccggcauaugcuuguuuguucuagggggagugcuguucgcagucaguuggcucgugaaggcccugauugauucuaucgguaacuccuuuuucccgggccuuagcaucuguaaaacuugcucgauugggucuaucaauggauuugagauugaaucccacaaguguuauugcucacuguugugcugucccuacugccgggcuuguaguagcgacaagauaacacaucguaugcaccucaacgucugcaaaaagcgcaaagugggcuccaauguuaugcuggccguguguaagagaaugugcuucaaagcgaccaucgaggcaaacaacagggccacguuuauucggaauaucaucaacucuaccuucguaauuuguauauuaauccuggucauuugcgugguuagcacaucagcuguggacauggagaaucuaccugccgguaucugggaaaaggaggaagaucucacuaacuucugucaucaggagugccaggucaccgaaacagagugucugugcccauaugaggcacuuauguugcgaaagccccugagucucgacuccauugcuaaagggaugaagucucugcuuaauucuacuucacuggaaaccaguuugagcaucgaggccccuuggggcgcgauaaacgugcaauccacauuuaaaccaaccaucucugccgcaaauauugcucucucguggagcuccguagaacacaagggaaacaaaauccuggugucaggccgcagugagucuauuaugaaguuagaggaaagaacugggaucagcuggugccugggaguugaggaugccuccgaaucaaagacgcuaacagucagcgugauggaccucucucagauguacucccccguguucgaguaucugaguggugauaggcaggucgaagaguggccgaaagcuaccuguacuggcgacugcccugagcggugugggugcaccagcucuacaugucuucacaaggaauggccccauucccgcaauuggagaugcaacccaaccugguguuggggaguuggcacugguugcacauguugcggguuggaugugaaagaccuguuuacggauuacaugcucgugaaguggaaaguagaguacauaaagaccgaagccauuaucugugucgagcugacuucacaggaaaggcaaugcaguuuaauugaggcaggcacacguuucaaucugggaccugugaccaucacacuuagcgagccccggaacguucagcagcgauugccacccgaaauaaucacucuccacccuaagauugaggaaggcuuuuucgaccugaugcaugugcagaaagucaugucggccuccaccgugugcaagcuacaaucuuguacgcacgggguuccaggagaucuccagguguaucauguagguaaucugcugaaaggcgacaaggucaacgggcacagcauccacaaaauugagucacaucuuaauaccaguuggauguccugggacggaugcgauuuggacuacuuuuguaacaugggcgauuggccgucuugcacauauacuggugugacccagcacaacagagcugcguucaucaauaugcugaacauagaaacagacuacacuaagaccuuucauuuccacagcaaaagggugacggcacacggggauacaccccaguuagaccucaaggcccgcccuaccuauggcgcuggagagauuacuguccugguugagguggccgaucuugaacugcauacaaagaaaaucgagguauccggcuugaaguuugcaucacucaccuguagcgggugcuacgccuguaguucuggaaucuccugcaaagugcggauucacgucaaugaaccagacgaguucacugugcauguuaagagcaacgaucccgacguggucgcugccggcucgucacugauggcaagaaaaaucgagucuggugcggauaguaccuuuaaggcuuucuccagcaugccuaaaaauucucuauguuucuauauuguggaaagggacuacugcagcuccuguacagaugacgacacgcaaaagugcguugauauaaagcuggagcacccacagucaauccucauugaacauaaagggaccaucauuggaaagcagaacgacacuugccccacaaaaaccaguuguuggcuggagagcaucaagagcuuuuucuacggccuuaagaauauguuguccgguauauuuggcaacaucuuccuggggauguuacucuuucuggccccguucgugcuucugauucuauuuuucuuuuucggauggcgccuccuguuuugcuugaaauguugccgacggacacguaagcuguuaaaauauaagcaccucagagaugaagaggagucaggcuacaaaaagaucauugaaaggcugaaugacaagaaagggaagagucgccuuuucgauggagagcggcuggcagacagaaaaaucgccgaauuguuuagcacuaagacccacgucggc

SEQ ID NO: 10465 - RNA, 3495 nt, Artificial Sequence
  derived and/or modified CDS sequence (opt3) from CCHVF(CCHVF ArD39554)__DQ211628.1__Gn-NSm-Gc
agcgaguccaacaauaacgacugcgugucuagaacccagcugaucaagacagaaaaugccgagauucacggcgaugacuacgggggacccggugagaaaauaacuaucuguaacggcucaacgauugucgaacaaaggcucgggagugaacuuggaugcuauaccaucaaucggauuaagagcuucaaacugugugagaacuccgcuucuggcaaggguugcgagaucgauucgacaccuguuaaauguaagcagggguuuugcuugaagauaacucaggaaggacgcggccaugugaaauuaucacgaggcagcgagaucauucuggacguaugugauaguuccugcgaaaugaugaucccaaaggggucuggagacauucuaguggauuguagcgguggccagcaacacuuccuccaggacaaucuggucgaucuugggugcccgaacgugccccuguugggaaaaauggcaaucuacauaugucguauguccaaucauccuaagaccacaauggccuuucucuucugguuuucauucggcuauguuauuaccugcaucuuuugcaaagugauuuucuacguccugaucaucauugguacucuggggaagagaauaaagcaguauagggagcucaaaccacagacauguaccaucugcgaggcgacgcccgugaacgcuauugacgccgaaaugcacgauuuaaauuguaguuacaacaucugcccuuauugugcaagccggcugacuucugagggacuuguacgccauguuacccaaugcccaaagagaaaagaaaagauagaggaaacagaguuguaccugaaucuagagaggauucccugguuugugcggaaacuccugcaggucuccgaaucaacuggcguggcccuuaagcgcagcaguuggcuggugaccuugcucguccuguuaacaguuucucuguccccugugcagagcgcuccaaucggccaggagcgaaccguagugacguaccaagucagagaaucguauacugggaugugucucuucauccuuggaucugugcuguuugcaauuuccugguugacaaaaggucuaguugacucagugggcaacaucuucuuuccggggcugagugucugcaagaccuguagcauuggauccauaaauggcuucgagaucgaaucucacaagugcuacuguagccucuucugcugccccuauuguagguacugcucagccgaucggggugcucaccagagucaucuguccguguguaaaaagcguaaaacugggagcaacguaaugcuugccguuugcaagcgcauguguuuuagagcgacacugaaagugucuucagaggcauugauuaucaggaguaucauuaacaccacguucgucgugugcauacucauccuggucguguguguugugagcaccuccgccguagagauggaaaauuuaccugcuggcacaugggagaaggaagaggaccugacuaacuuuugccaccaggaaugucaagucaccgagacagagugccuauguccauaugaagccuucgugcuccggaagccccuguuucuugacucuacugcaaaaucgaugaaguccuugcuuaauagcaccucacucgagacaagucugucuauugaagcuccuuggggagccaucaacguucagagcaccuucaaaccaacugcguccacggccaauauugcacuuucauggagcucuguggagcaucgaggcaacaagauccuggucacagggcgcuccgagaguauaaugaaauuggaagagagaaccggaaucagcuggaaucucgguguggaagaugcuucugaguccaagacucugaccguaucagugauggacuuaagucagauguacagcacaguuuuugaauaucugucgggcgauaggcaggucgaggaguggcccaaggcuaccugcacuggggacugcccggaacgguguggaugcacauccucuacgugucuacacaaagccuggccucacagccgcaacuggagaugcaaucccaccugguguuggggcguggguacugggugcacauguugcggccucgaugugaagaaccuguucaccgacuacaugcuuauuaaauggaaggucgaguuuaucaaaacagaagccauuguuuguguggaguugacuucacaagaaaggcagugcagucugaucgaggcaggaacccguuucaaucucggcccagugacgauaacccuguccgagccucggaacauucagcagaaguuacccccagaacugguaacacuucauccccgagucgaggaaggguuuuucgauuugaugcacgugcaaaagguucucucugccagcacuguguguaaacugcaguccugcacccauggagucccuggugaccuacagguguaccacguuggcaaucugcucaagggggauaaaaucaacggaaauucauuucauaagauugagccaaaccugaacacaagcuggaugaguugggacggcugcgaucuugacuauuacuguaauaugggugacuggccgucuugcacuuauaccggggugacgcagcacaaccacgcugcguucguaaauuugcugaacaucgaaacagauuacaccaaaaauuuccauuuucacuccaagagagucacugcacauggcgagacaccccaauuagaccucaaagccaggccuaaguauggagcuggcgaggugaccgugcuggucgaaguugccgauauggagcuucacacuaagaaaauagaaaucagcgggcugaaguucgcaucguugaccuguacaggaugcuacgccuguucaucuggcauuaguugcaaagugcgccuccacguagacgagccagaugagcugacggugcaugucaaguccgacgaucccgacgugguugcugccagcucuagccuaauggcacggaaaaucgaauuugguaccgauuccacuuucaaggcguuuucaaguaugccuaaggacaaacuguguuucuauauuguggagagagauuacugcagcucuuguuccaaggaagacacacagaaaugcgucaacgcuaagcucgagcagccacagucaauccugauagaacacaaagggaccauuaucggaaagcaaaaugauacauguacugugaaggccaguugcuggcuugagagcguuaaauccuuuuucuacggcuugaagaacaugcuggguggcaucuuugggaaugugauuuuaggaaucauuauguuccucgcacccuuugcccugcuucugcuauucuuucucuucggcuggaggauacuguucugcuugcgcuguugccgacggacccgugggcuguuuaaauauaagcauaucaaagacgacgaggaaucuggauacaagagaauuaucgagagguuaaacaauaagaaaggcaagaacaaacucuucgauggugaacgccuggcugacaagaaaauugccgagcuguuuucgacgaagacacacaucggg

SEQ ID NO: 10466 - RNA, 3495 nt, Artificial Sequence
  derived and/or modified CDS sequence (opt3) from CCHVF(CCHVF C-68031)__DQ211629.1__Gn-NSm-Gc
agcgaggaauccggcgacgauugcaucucuagaacccagcugucaaggacagagacugccgaaauucacagugacaacuacgggggacccggugauaagauaacgaucuguaauggcagcaccauuguggaccaacggcucggguccgagcuuggaugcuauacaaucaaccgcgucaaaucuuucaagcugugugaaaauucggcuacuggcaaaucaugcgagauugauagcaccccuaucaagugucgacaggguuuuugcuugaaaauaacacaggaggggcguggacauguuaaguuaaguagaggcuccgaagugguacuggacgcaugugauucuagcugcgagaucaugauuccaaagggcaccggggacauccuaguggauuguuccggaggucagcaacacuuccucaaagacaaccugauugaucuuggcugcccgaauaucccccuguuggggaagauggccauauacauuuguaggaugucaaaccauccuaaaacuacaauggcguuucucuucugguuuaguuucggauaugucaucacaugcauucugugcaaggugaucuuuuaccugcucaucguugugggcacguuagguaaaaaguucaagcaguaucgggaacugaaaccacagacuuguaccauuugcgagacaacucccgucaaugcuauagacgccgagaugcacgaucuuaacuguagcuacaauaucugcccuuauugugcaucucgcuugaccuccgacgggcuggccagacaugugaugcagugcccaaagaggaaagaaaagguagaggaaacagagcuauaccucaaccuggaacggauucccuggguugugcgcaaacuucugcaagucucagagagcaccggaguggcuuugaagcgaaguucuuggcucgugguccuguuaguucugcucacggugucccuuagcccuguacagucggcaccaaucggccacggcaaaacuguggagacauaccagaccagagaaggguauacuucuauaugucuguuugucuugggauccauucuauucaucgugucaugccugaugaagggucucguugacagugugggcaauagcuuuuucccggggcuguccaucuguaagacaugcucuauuggaagcaucaacggcuuugagaccgaaucacacaaauguuacugcagucuuuucugcugucccuauugcaggcauuguuccgccgaucgggagauucacaagcugcauuugagcauaugcaaaaagcguaaaacggguucuaaugucaugcucgcuguguguaagcgcaugugcuucagagccaccguagaaguuucaaacaaggcgcuguuaaucaggaauauuaucaacacaacuuuuguggucuguauccugauucuagcagugugcgucgugaguaccagcgccguugagauggagucccucccugcugggacaugggaacgggaggaagaccugacuaacuucugucaccaggagugccaagugaccgaaacagagugucuuugcccauacgaggccuugguacugcgaaaaccccucuuuucugauucgauagucaagggcaugaaaaaucugcuuaacagcaccucccuggaaacuucauugaguaucgaggcaccuuggggagcuauuaaugugcagucuacguucaagccaacaguuagcgccgcgaacaucgcccucuccuggucaagcguggaacaccgcggcaauaaaauucuggucucugggagauccgagaguaucaugaaguuagaggaaaggaccggaauaagcugggaccuggguguggaggaugcaucugaauccaagcuacucacuguaucaaucauggaccugagucagauguauagccccguguuugaguaccuuucgggcgaucggcaaguugaagaguggccgaaagcuaccugcacaggggacuguccugagcgcugcggauguaccuccucuacuugcuugcauaaggaauggccccacagcagaaacuggagguguaauccaacauggugcuggggcgucgguacgggguguaccugcuguggccuggaugugaaagaccucuucacugauuauauguuugugaaguggaaagucgaguacauuaagacagaagccaucguuugcguggagcugaccucacaggaacgucaguguaguuuaauugaggcuggaacacgguucaaccugggcccugugacuaucacccuuuccgagccccgaaauauacagcaaaaguugccacccgaaauuguaacgcuccauccuagaaucgaggaaggguuuuucgaccugaugcacgucaaaaaggugcuaucugccagcaccguuugcaaacugcaguccugcacacauggagugccaggugaccuccaggucuaccacauuggcaaccugcuuaagggggauaaagugaauggacacuugauccauaagauagagccgcacuuuaacacuucauggaugagcugggacggcugugaucuggacuauuacugcaauaugggugauuggcccaguuguucuuauaccgggguuacacagcauaaccacgcagccuucgugaauauguuaaacaucgaaacugacuacaccaaaauuuuucacuuccauuccaagaggguaacggcucacggcgauacaccucaacucgaccugaaggcgcgcccaaccuauggagcaggcgagaucacuguccuuguggagguggccgauauggaacugcauaccaaaaagauugagaucagcggguugaaauucgcuucgcuuaccugcacuggauguuacgccugcucaucuggcauaaguuguaagguccggauucacguugacgaacccgaugagcugaccgugcauguaaaauccgaggacccugauaucguggcagccagcucuagccuaauggcuagaaagcuggaauuugguacagacuccacguucaaggccuuuucagcaaugccaaaaaccagucucugcuucuauaucgucgagagggaauacuguaagagcugcucuaaagaggacacucagaagugugugaacacaaaacuggaacagccccaguccauucuuaucgagcacaaggggaccauuauaggaaagcaaaaugauacaugcacuucaaaagcgggcugcugguuggagaguguuaagagcuuuuucuacggucugaaaaacauguuauccggcaucuuugggaauguguucauuggaaucuuucucuuccuggcuccguuuauucuucugauccuauucuuuauguucggcuggcgcauacucuucuguuuuaagugcugucgacggacccgugggcuguucaaauauagacacuugaaggacgaugaagagacgggauacaggaagaucauugaacgccugaacaauaaaaagggcaaaaacaaguuacucgacggugagcggcuggccgauagaaaaaucgcagaacucuuuucuacaaagacccauauuggg

SEQ ID NO: 10467 - RNA, 3495 nt, Artificial Sequence
  derived and/or modified CDS sequence (opt3) from CCHVF(CCHVF Drosdov)__DQ211630.1__Gn-NSm-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgaggucaugauaccgaaaggcacuggggauauccucguggacuguaguggaggucagcaacacuuccugaaggauaaccuuauugaccugggcugcccccauaucccuuugcucgggaaaauggccauuuacaucuguagaauguccaaucacccaaggacaaccauggcguuucuguucugguuuucuuucggauauguuauaacgugcaucuuuugcaaggcucuguucuacagccucauuauuaucggcacuuuagguaaaaagaucaagcaguaucgggaacugaaaccccagaccuguacaauuugcgagacugccccugugaacgcaauagaugccgagaugcaugaccuuaaguguuccuacaauaucugcccauauugugcuucacgcuugaccagugacgggcuggcaagacacgucacacagugccccaaaaggaaggaaaaaguggaggaaaccgagcuauaccucaaccuggaacggauuccuuggaucguacgcaagcugcugcaaguuagcgagucuacgggaguggccuugaaacgauccucauggcucauaguccuguuagugcugcucacugugagccuuaguccaguccagucugcuccgguuggccacggcaagacaauugagaccuaccagacuagagaaggguuuacauccaucugucuguucauguugggaagcauccuauuuauugugucgugccugguaaagggucucguggauucugucuccgacucauucuuucccggccugaguguguguaaaaccugcagcaucggguccauuaauggauucgagauagaaucucauaaguguuauugcagccuuuucugcuguccuuacugcaggcacuauucagccgaucgggagauccaucagcugcacuugaguauuuguaaaaagcguaaaacgggcuccaacguuaugcucgcggugugcaagcgcauguguuuuaaggcaaccaucgaagccagcagaagggcucuguuaauccggucuauuauaaauacaacuuucgucaucugcauucugauccuagccauuugugugguaucaaccagugcaguugagauggagaaccucccagcugguacaugggaacgagaggaagaccugacuaauuuuugccaccaagagugucaggugaccgaaacagagugccuuugucccuacgaggccuugguccugcgcaaaccucucuuccuggauagcaccgugaaggggaugaaaaaccuucuuaauuccacuucuuuggaaacgucgcucagcaucgaggcgccauggggcgccauaaacguccaguccacauuuaagcccaccgugucaacugcaaacaucgcucugaguuggucuagcguugaacauagaggaaauaaaauuuuagugaccggcagguccgagucaaucaugaagcuggaggaacggacagggguaagcugggaccuaggagucgaggaugccucugaauccaagcuccugaccgugaguauuauggaccuuagccaaauguauucuccgguuuucgaguacuuguccggugaucgccagguggaagaguggccuaaagcuacuugcacaggcgacugccccgagagaugugggugcacgucaaguaccugucugcacaaggaauggccacauagcaggaacuggcguugcaauccuacuugguguuggggagucggcacagguugcaccuguugcgggguggauguaaaagaccucuuuacagaccacauguucgugaaguggaaaguugaguauaugaagacugaagccaucgucuguguggagcugaccucgcaggaacggcagugcuccuuaauagaggcaggcacgcgauuuaaccugggacccgugaccauuacacuuucugagccaagaaauauccaacagaaguugcccccugaaauuaucacucuccauccaaaaauagaggaaggcuucuuugaucugaugcacguccagaagguucuaagcgccucaaccguguguaaacugcagaguugcacacacgggaucccgggagaccuccaaauuuaccauaucgguaaccugcuuaagggcgauagggugaaugggcacuugauucauaaaaucgagccccacuucaacacuuccuggaugucuugggacggaugcgaucuggacuacuauuguaauaugggcaacuggccuagcugcaccuacacggguguaacacagcacaaucaugcugcguuugucaacuuacucaauauagaaaccgauuauacuaagacauuccacuuccauuccaaacgcgugaccgcacacggggacacuccacagcuggaucuuaaggcccggcccaccuacggcgcuggagagauuacaguucugguggaggucgccgacauggaauugcauacgaagaaaguggagaucucaggccucaaguuugcaagccugguuuguaccgggugcuaugccuguaguucuggaaucuccugcaaagugaggauucacguagaugaaccugacgagcuaacuguccacgucaagagcucggauccagacgugguggcugccucaacaucucugauggcaagaaaacucgaguucggcaccgacaguaucuuuaaggcguucuccgcuaugcccaagacaagccuguguuuuuacauuguugaacgcgaguauugcaaaucuuguagcgaagaugacacuaagaaaugcguggauaccaaacuugagcagccgcaauccauauugaucgaacauaaagguacgauuaucgggaagcagaacgacacauguaccgccaaggcaucaugcuggcuggagaguguaaagagcuucuuuuacggauuaaagaauaugcucggcucuguguucgguaacuuuuucgucggcauucugcuuuuucuggccccuuucgugcuacucguucuguuuuucauguucggguggaaaaucuuguuuugcuucaaguguugccgacggacucguggacuguuuaaauacagacacuuaaaggaugacgaggaaaccggcuauaggcgcauaaucgagcggcucaacuccaagaaagggaagaauagacugcuugauggagaaaggcuggcugaccgaaaaauugccgaguuguucucaacaaagacucauaucggc

SEQ ID NO: 10468 - RNA, 3495 nt, Artificial Sequence
  derived and/or modified CDS sequence (opt3) from CCHVF(CCHVF Kashmanov)__DQ211631.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaaaagauccucauggcucauaguccuguuagugcugcucacggugagccuuaguccgguccagucugcucccguuggccacggcaagacuauugagacauaccagaccagggaaggguuuacuuccaucugucuguucauguugggaagcauccuauuucuggugucgugccucguaaaaggucugguggauucugucuccgacucauucuuuccuggccuuaguguguguaagacaugcaccauugggagcaucaacggauucgagauugaaucccauaaguguuauugcucucuguucugcuguccauacugccggcacuguagcgccgaucgugagauacaucaguugcaccucucaaucugcaaaaagcgcaaaacgggcaguaauguuaugcuggcgguguguaagagaaugugcuuuagggcaaccauugaagccucccggcgagcuuuacugauccgcagcaucauuaacacaacuuucgucauauguauccuaacccucacaauuugcgugguaucuacuucagccguugagauggagaaucugcccagugguaccugggaaagagaggaagaccuuacaaacuuuugucaccaagagugccaggugaccgaaacugaguguuugugcccuuaugaggcacugguccucaggaaaccacuguuccuugauagcaucgugaaggggaugaaaaauucccugaacucuacgucguuggaaacaagccucuccauugaggcucccuggggcgccaucaacguccagucaaccuuuaagccgacugugaguaccgcgaauauagcccugucuuggagcuccguugaacaucggggaaacaagaucuuagugacaggccgcucagagagcauuaugaaacuggaggaaagaaccgggguaucuugggaccuaggagucgaggaugcauccgaaaguaagcuccugacugugagcaucauggaccuuucucaaauguacuccccuguuuucgaguauuugucaggugaucgucagguggaagaguggcccaaagcuacaugcacgggcgacuguccagagaggugcggguguaccaguagcacuugccugcacaaggaauggccucauucgcggaauuggcgauguaaccccacauggugcuggggagucggcaccgguuguacaugcugugggguggauguaaaggaccucuuuacugaccacauguucgugaaauggaagguugaguacauuaaaaccgaagccaucgucugcguggagcugacgucccaggaaagacaguguucuuuaauagaggcuggcaccagguuuaaucugggaccagugacaauuacucuuagcgagccccgcaacauccaacagaaguugccuccagaaauuaucacccuccauccgaaagucgaggaaggcuucuuugaucugaugcacguucagaaggugcuaucagccaguacagugugcaagcugcaguccugcacucacgggauacccggagaccuccaaguauaucauaucgguaaucugcuuaaaggcgaucggauuaacgggcacuugauccauaagauugagccucacuucaauaccucuuggaugagcugggacggaugugaucuggacuacuacugcaacaugggcgauuggccauccuguacguauacaggugucacccagcacaaucaugcagccuuugugaacuuacucaauaucgaaacugacuacacaaaaaccuuccacuuccauucaaagagaguuacugcucacggggauacaccccagcuggaccuuaaagcgaggccuaccuauggcgcaggagagauaacggugcuggucgagguggccgauauggaauugcauaccaagaaaguugagauuagcggccucaaguuugcuagucuggccugcacuggguguuacgcauguucuuccggaaucagcugcaaggugcgcauccacguagacgaaccagaugagcuaacaguccacgugaaaucgucagaccccgacguggucgccgcuucuaccagucugauggcccgaaagcucgaguucggcacagauuccacuuuuaaagcauucagcgcgaugccgaagaccucucugugcuuuuauauuguugaacgggaguacuguaaaagcugcuccgaagaggacacgcagaaguguguggauacaaaacuugaacaaccucagucaaucuugauugagcauaaggguaccauaaucgggaagcagaacgacacuugcaccgcuaaagccaguugcuggcuggagagcguaaagucuuucuuuuauggauuaaagaauaugcucggcuccguguucgguaacuuuuucauuggcauccugcuuuuucuggcaccauucguccuacucgugcuguuuuucauguucggguggaagauuuuguuuuguuucaagugcugucguagaacaaggggacuguuaaaauaccgccaccucaaggaugacgaagagacuggcuaccggagaaucauagaaaggcugaacaauaaaaaggggaaaaaccgacuucuggauggagagcgcuuggccgaccggaagaucgcugaacucuuuucaaccaagacacauauuggc

SEQ ID NO: 10469 - RNA, 3495 nt, Artificial Sequence
  derived and/or modified CDS sequence (opt3) from CCHVF(CCHVF Oman)__DQ211632.1__Gn-NSm-Gc
agcgaggaauccggcgaggacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaagagcuucaaguugugugaaaauuccgcuacugguaaaucuugcgagauugacaacaccccuguuaaguguaaacagggguuuugcuuaaagaucacacaggaaggacgaggccaugugaagcugucgcgugauucagagguagugcuagacgcaugugauagcaguugcgaaauaaugaucccaaaaggcaccggggacauucucgucgauuguuccggaggucagcaacacuuccugaaggacaaucuuaucgaucugggcugcccgaacauucccuugcucgggaaaauggccaucuacauauguagaaugucuaaucauccuaagacuacaauggcguuucuguucugguuuagcuucggauaugugauuaccugcauccugugcaaaguuauuuucuaccucuuaaucguggucggcacgcuggguaagaaguucaaacaguauagggagcuuaagccacagacuuguaccaucugcgagacaacucccgugaacgcuauugacgccgaaaugcacgauuugaauuguuccuacaacauaugcccuuauugugcaucacggcugaccagugacgggcuagcccgccauguaaugcagugcccaaaaagaaaggagaaaaucgaagagacagaacucuaccugaaucuugagaggauucccuggguugugcggaagcuguugcaagucagcgagucuaccggaguggcucucaaacgcuccucauggcugaucguguuacugguccuccuuacgguuagccugaguccugugcagucugcaccaauaggccacggcaagacuauugaaacauaccagacccgagagggguauacuuccaucuguuuguuuguacuaggaagcauccuguucauugugucgcaccucaugaagggucuggucgacucugugggcaacuccuuuuucccggggcuuucaaucugcaaaacauguaguauuggaagcauaaauggcuuugaaaucgagucccauaagugcuucuguucucuguucugcugccccuacuguagacacugcagcgccgauaaagaaauucauaaguugcaccucucaaucuguaaaaagaggaaggcugguaguaacguuaugcuggccgugugcaaacggauguguuuucgugcgaccauggaggucuccaauaaggcauuacugauccgcagcgugauuaacacgaccuucguaguuugcauacuaauccucgccgugugugucgugucuacaucagcugucgagauggaaagucugccugccgggacuugggagagagaagaggaccuuaccaacuuuugccaccaggaaugucaagugacagagacugagugcuuguguccauaugaagcacugguucucaggaaaccccuguuccuugauagcauugcuaagggcaugaaaaaucuguugaacuccaccucucucgagacaucgcugagcaucgaagccccuuggggagcgauuaaugugcaguccaccuuuaagccaacuguaucaacggccaacaucgcauuaaguuggucuagcgucgagcaucggggcaauaagauacugguguccgggcgaucagagagcaucaugaaacuagaggagcgcacaggaauuucuugggaccucgguguugaagaugcuuccgagaguaagcugcuuaccgugagcgucauggacuugucucagauguacucccccguguucgaauaucugucaggcgauagacaaguagaggaguggccgaaagccacuugcaccggggacugcccugaaagguguggaugcacaaguagcaccugucuccacaaggaguggccccauucgcggaacuggcgcugcaauccaacuugguguuggggcguggguacagggugcacguguugcggccuggauguuaaagacuuauuuaccgauuacauguucgucaaguggaagguggaauauaucaaaacugaggcuauugugugugucgaacugacaucccaggagagacagugcucucuuaucgaggccggaaccagguuuaacuugggcccuguuacaauaacucucagcgaaccccguaauauucagcaaaagcugccacccgagaucgugacccuacacccucggauugaagagggguucuuugaccugaugcaugugcagaaaguacucucagcaaguacggucuguaagcugcaguccugcacccacggagugccaggugaccuucagguuuaccacaucggcaacuugcugaaaggggauaaggugaauggacauuuaauacacaaagucgaaccgcauuucaacacaucuuggaugagcugggacggcugcgaucucgacuacuauuguaauaugggugauuggcccuccugcacuuacaccggggugacacaacacaaccacgccgcuuuuguuaaucugcuuaacaucgagacugacuauaccaagaacuuccauuuccacucaaagcgagugacggcgcauggcgauacaccucagcuggacuugaaagcaagaccaaauuacggagccggcgagguaaccguccucguggaaguggcugauauggagcugcacacuaagaaaauugaaaucagcgggcuaaaguuugccagucugacauguaccggaugcuaugcauguucuuccggcauuagcugcaaagucaggauccauguugacgagcccgaugagcucacugugcacguaaagucggaagacccugauauaguggccgcuucaucuagucugauggcccgcaaacuugaguucgguaccgacuccacauuuaaagcauucagcgcgaugccaaagacgucuuuguguuuuuacauugucgaacgggaguauugcaaaagcuguuccaaggaagacacccagaaaugcgugaacgcuaagcuggagagaccccagucaaucuuaaucgagcacaaggggacuauuaucggaaaacaaaaugauacauguaccgccaaggcaaguugcuggcucgaaagcguuaaaucuuucuuuuacggccugaagaacaugcuuuccgguauuuucggcaauguguuuauagggaucuuccuguuucuagccccguucauucuccugaucuuguuuuucauguucggauggaggauucuguuuugcuucaaauguugccgccgaacacggggcuuauuuaaguaccgucaucucaaggacgaugaggaaacuggguauagaaaaaucauagagaggcugaacaauaagaaaggaaagaacaaacuucuggacggcgaacgcuuggcugaucggaagaucgccgagcucuuuucaaccaaaacgcacauuggu

SEQ ID NO: 10470 - RNA, 3495 nt, Artificial Sequence
  derived and/or modified CDS sequence (opt3) from CCHVF(CCHVF SPU97/85)__DQ211633.1__Gn-NSm-Gc
agcgaggaauccgacggcgauugcaucucuagaacccagcugcucaggacagagacugccgaaauucacucagacaacuacgggggacccggugauaagauaacgaucuguaauggcaguaccauuguggaccaacggcuugggagcgagcugggaugcuauacaaucaaccgcgucaaauccuucaaguugugugaaaauucugcuacuggcaaaucgugcgagauugauucaaccccuguuaagugucgacaggguuuuugcuuaaaaaucacacaggaggggcguggacaugugaagcugagcagaggcagugaaauaguacuagacgcaugugauuccucuugcgagaucaugauuccaaagggcaccggggacauccucguggauuguagcggaggucagcaacacuuccugaaagacaaccuuauugaucugggcugcccgaauauccccuugcucgggaggauggccauauacauuugucggauguccaaccauccuaagacuacaauggcguuucuguucugguuuucauucggauaugucaucacaugcauucugugcaaagugaucuuuuaccucuuaaucguugcuggcacgguggguaagaaauucaagcaguaucgcgaacugagaccacagacuuguaccauuugcgagacaacucccgucaaugccauagacgcagagaugcacgaucuuaacuguaguuacaauaucugcccuuauugugccagcagguugaccucugacgggcuggcucggcaugugaugcagugcccaaagcgcaaagaaaagauugaggaaacagagcuauaccucaaccuggaacgaauccccuggguaguuagaaaacuucugcaaguguccgagucaaccggagucgcauugaagaggagcaguuggcucacggugcuguuagugcugcucauagucucucuuuccccuguucagagcgccccaauuggccacggcaaaacuaucgagacauaccaggcucgggaaggguauaccucguuuugucuguucaucuugggaucuauucuauuuaucguguccugccugguaaagggucucauugacucagugggcaauaguuucuuuccggggcugagcauauguaaaacuugcuccaucggaucugucaacggcuucgagauugaaagccacaaguguuacugcucacuuuucugcugucccuauugccgucauuguagugccgaucgcgagauccacaagcugcauuuguccaucugcaaaaagagaaaaacagguagcaaugugaugcucgcgguuuguaagaggaugugcuuucgggcaaccauugaagugucuaaccgagcccuguuaauacgcucaaucauuaauacgaccuucgcugucuguauccugacacuagccgugugcguaguuaguacuagcgcaguggagauggagucccucccugcugggaccugggaaagagaggaagaccugacaaacuuuugucaccaggagugccaagucacugaaaccgagugucuuugcccauacgaggccuuggugcugaggaaaccccucuuccuggauucuauugucaagggcaagaaaaaccuucugaauagcacaucguuggaaaccucccucucaaucgaggcgccuuggggagccauaaacgugcagaguacuuuuaagccaacgguuucugcagcuaauaucgcccugagcugguccucaguggaacaccggggcaacaaaauuuuaguaagcgggcgcucugaguccaucaugaagcuggaggaaagaacaggaauuaguugggaccuaggugucgaggaugcuagcgaaucuaaacuccugaccguguccguuauggaccuuucacagauguauagucccguguucgaguacuugagcggcgauaggcaagucgaagaguggccgaaggccacuugcaccggggacuguccugagcguugcggauguacaucgucuaccugccugcauaaggaauggccccacucccggaauuggcgauguaacccaacuuggugcuggggcguggguacaggguguacgugcuguggccucgauguaaaagaccuguuuaccgauuauauguucgugaaguggaaaguugaguacaucaagacugaagcaauagucugcguggaguuaacaagccaggaaagacaguguucacugauugaggccggaaccagguuuaaucuuggcccugugacaaucacuuugagugagccccgcaacauucagcaaaaacucccacccgaaaucauaacccugcauccucggaucgaggaaggguucuuugaccuaaugcacguccagaagguucuguccgcuucuacggugugcaagcuccagagcugcacccauggagugccaggugaccugcagguauaccacauuggcaaucuuuugaaaggggauaaggucaacggacaccugauccauaaaauugagccgcacuucaauacauccuggaugucaugggacggcugugauuuagacuauuacugcaacaugggugauuggcccagcuguacuuauaccggggugacacaacauaaucacgcggcauuuguuaaccuccugaauaucgaaacugacuacaccaagaacuuccacuuccauaguaaaagagugacggcccacggcgauacaccucagcuugaccugaaggcuaggccaaccuauggagccggcgaggucacuguguugguugagguggcagauauggaacuccauaccaaaaagauagagauuucugggcugaaguuugccucccuaagcugcaccggauguuacgcuugcucgucaggcaucucuuguaaaguacgcauccacgucgacgaacccgaugagcugacugugcaugugaagagugaggacccugauauugucgccgcagguuccagccucauggcgcgaaaacuggaguucggggcugacucuaccuuuaaggccuucagcgcaaugccaaaaacaucccuuugcuuuuauaucguugaacgggaauacuguaagucaugcagucgugaggacacgcagaagugugugaacaccaaauuggaaagaccccagagcauucugauagagcacaagggaacuaucauuggcaaacaaaaugauacaugcaccgccaaggcuucuugcugguuagaguccguaaaaucauucuuuuacggucucaagaguaugcugagcggcaucuucgggaacguguuuauuggaaucuuccuuuuuauagccccguucguccugcuaauccucuuuuucauguucggcuggaggauucuguuuuguuucaagugcugucgccggacaagaggguuguuuaaauauaggcaccugaaggacgaugaagagacuggauaccgaaaaaucauugaacgcuuaaauaacaagaaaggcaagaauaagcuccuggacggugagcggcuugcagauagaaaaaucgcugaacuguucuccaccaagucucauauaggg

SEQ ID NO: 10471 - RNA, 3495 nt, Artificial Sequence
  derived and/or modified CDS sequence (opt3) from CCHVF(CCHVF SPU103/87)__DQ211634.1__Gn-NSm-Gc
agcgaggaauccucugacgauugcaucucaagaacccagcugcucaggacagagacugccgaaauucacggcgacaacuacgggggacccggugauaagauaacgaucuguaauggcaguaccauuguggaccaacggcuugggagcgagcugggaugcuauacaaucaaccgcgucaaaacuuucaaguugugugaaaauuccgcuaccggcaaaucuugcgagauugauucgguuccugugaagugucgacaggguuacugcuuaaaaaucacacaggaggggcguggacauguaaagcugucaagaggcagcgaagugguccuagacgcaugugauaccaguugcgaggugaugauaccaaagggcacuggggacauccucguugauuguuccggaggucagcaacacuuucugaaagacaaccuuauugaucugggcugcccgaagauccccuugcucgggaaaauggccauuuauaucuguaggaugucuaaucauccuaagacaaccauggcguuccuguuuugguucagcuuuggauacgugauaacgugcguccugugcaaagcuauuuucuaucucuuaaucauugugggcacucuggguaagcggcuuaagcaguaccgcgaauugaaaccacagaccuguacaaucugcgagacuacccccguaaacgccaucgacgcagagaugcacgaucugaauuguuccuauaacauuugcccuuacugugccucaagacuaacaagugacgggcucgcuaggcauguuacccagugcccaaagcggaaagaaaagguggaggaaacggagcuguaccuuaaucuggaacgcauacccugggucgugcgaagauugcuccaagugagcgagucuacuggagucgcacugaaaagguccucaugguuaaucguucugcucgugcuuuuuacaguaagccugaguccugugcagucugccccaauuucccacggcaagaccgucgaggcuuaucaggcccgggaaggcuacacugggauguguuuguucgugcuaggaagcauccuguuucucguuucgugccugaugaaaggucuuguggacucugucggcaacacauucuuuccggggcuguccauauguaagaccugcucaauuaguagcaucaauggauucgagaucgaaucccaccguuguuauugcucuuuguuuugcugucccuacugccgccauuguagcgcgaacaaggagauucaccagcuccaucugucaaucugcaaaaagagaaaaacgggcaguaaugugauguuagcaguauguaagaggaugugcuuccgggccaccauggaaguuuccaaccgagcucuguucauucgcagcauaaucaauacaacuuuugugcuauguauucucauccuggccgucugcguggucucuaccucagcaguggagauggagagucuuccugcugguacaugggaaagagaggaagauuugacuaacuucugucaccaagagugccagguuaccgacacagaaugucugugcccauaugaggcccucgugcugaggcggccccuuuuucuggauaacaucguaaaagggaugaagaauuugcucaacagcaccucccuggagacuucuuuaucgauugaagcgccuuggggcgccauaaauguccagagcacguacaagccaacaguguccaccgcaaacaucgcucugucauggaguucuguugagcaccgcggaaauaaaauucuagugagcggcagauccgaaucaaucaugaagcucgaggagaggacugggauuagcugggaccugggagucgaagaugccucugaguccaaacuuuugaccgugaguguaauggaccugagccaaauguauucucccguguucgaauaccucuccggugaucgucagguugaggaauggccgaaggcuacaugcaccggcgacuguccugagcggugcggguguacuucaaguacaugccugcauaaagaguggccccacagccgaaacuggagauguaauccaacguggugcuggggagucggcaccgguuguacuugcuguggguuagaugugaaggaccuguuuacagauuacauguucgugaaguggaaaaucgaauauauaaagaccgaggccaucgucugcguugaacuuacaucgcaggagaggcaguguuccuugauugaagcaggcacucgcuuuaaccucggaccugugaccaucacgcugucugagccccggaauauucaacagaaacuaccaagcgagaucauaacccugcaucccagaauugaagagggcuucuuugaccucaugcacgugcagaagguacugucagccaguacagucugcaaacuucaguccugcacucauggggugccuggagacuugcaaguuuaccacaucgguaaccuguuaaagggcgauaaggugaaugggcaccucguccauaaaauugaaccacacuucaacaccucuuggaugagcugggacggaugugaucuggacuauuacugcaauaugggcgauuggccguccuguacauauacuggugugacccagcauaaccacgcuucauuuguuaaucuucugaacaucgagacggacuacacaaagaacuuccacuuucauagcaaaagggugaccgcgcacggggauacuccccaguuggaccucaaggcacgcccuacauauggcgccggagaaauaaccguacuggucgagguggcugauauggagcuacauacuaaaaagaucgaaauuaguggccugaaauucaccucucucacaugcacgggguguuacgccugcuccagcggaaucucguguaaggugcggauucacgucgacgagccagaugaacugaccguucaugugaagucagacgaucccgacguaguggcagccucuaguucccuuauggcucgaaaauuggaguucggcacugacagcacauuuaaggccuucucugcaaugccuaaaaccagccugugcuuuuacaucgucgagcgugaauauuguaaguccugcucagaggaagauacacagaaaugugugaauacuaaguuagagcaaccacagaguauacucauugaacacaaggguaccaucaucgggaaacagaacaauacgugcaaggcgagagcuggaugcuggcuggagagcguuaaaucuuucuuuuacggccuuaagaacaugcuguccgguauuuucggcaauguguuuaucgggauuuuccuauuucucgcccccuucauacuguugauccuguuuuucauguuuggauggaggauuuuauucuguuucaaaugcugucgccggacaagaggccucuuuaaguauaggcaccugaaggacgaugaggaaaccggguaccgaaaaaucauugagcgccuuaacaauaagaaaggaaagaacaaacuguuggacggcgaacggcucgcagauagaaggaucgccgagcuguucucaacuaagacccauauaggu

SEQ ID NO: 10472 - RNA, 3495 nt, Artificial Sequence
  derived and/or modified CDS sequence (opt3) from CCHVF(CCHVF SPU415/85)__DQ211635.1__Gn-NSm-Gc
agcgaggaauccgacggcgauugcaucucuagaacccagcugcucaggacagagacuacggaaauucacucagacaacuacgggggacccggugauaagauaaccaucuguaauggcaguacaauuguggaccaacggcuugggagcgagcugggaugcuauacuaucaaccgcgucaaauccuucaaguugugugaaaauucugccaccggcaaaucgugcgagauugauucaacaccuguuaagugucgacaggguuuuugcuuaaaaaucacccaggaggggcguggacaugugaagcugagcagaggcagugaaauaguacuagacgcuugugauuccaacugcgagaucaugauuccaaagggcacuggggacauccucguggauuguucuggaggucagcaacacuuccugaaagacaaucuuauugaucugggcugcccgaacauccccuugcucgggaagauggcaauauacauuuguaggaugagcaaucauccuaaaacaaccauggccuuucuguucugguuuuccuucggauaugucaucacgugcauucugugcaaggugaucuuuuaccucuuaaucguugcgggcacuguggguaaaaaguucaagcaguaucgggaacugcgcccacagaccuguacaauuugcgagacuauacccgucaacgcuaucgacgccgagaugcacgaucuuaauuguucauacaacauuugcccuuauugugcaaguagauugaccagcgacgggcuggccaggcaugugaugcagugcccaaaacggaaggaaaaaguagaggaaacagagcuauaccucaaucuggaacgcauccccuggguugugcgaaaacuucugcaagucucugaguccaccggaguggcuuugaaaagaucaagcuggcucacggugcuguuaguccugcucauaguuagucuuucuccugugcaguccgcaccaauuggccacggcaagacuaucgagacauaccaggccagggaaggguauaccagcuuuugucuguucaucuugggaucgauucuauuuguagugucuugccuggucaaaggucucaucgacuccgugggcaacucauucuuuccggggcugaguauuuguaagacuugcagcauaggauccaucaauggcuucgagauugaaucucacaaguguuacugcagccuuuucugcugucccuauugccggcauuguucagcugaucgugagauccacaaacugcauuugaguaucugcaagaaacgcaagacagguuccaacguuaugcucgccguguguaaaagaaugugcuuuagggcgaccauugaagucagcaaucgggcacuguuaauacgaaacaucauuaacacgaccuucgugguauguauccugacacuagccguuugcguggucucuacuucagcuguggagauggagagucucccugccgggaccugggaaaaggaggaagaccugacaaauuuuugucaccaggagugccaagucacugaaaccgagugucuuugcccauacgaggcauuggugcugcgcaagccccucuuccuggauagcauuguuaaaggcaugaagaaccuucugaacuccacaucuuuggaaaccucgcucagcaucgaggcuccuuggggagccauaaacgugcaguccacuuuuaaaccaacgguaucagcggccaauaucgcacugaguuggucuagcgucgaacacagaggcaacaagauuuuaguguccgggaggucagagagcaucaugaaacuggaggaacggacaggaauuucuugggaccuagguguugaggaugcuuccgaaaguaagcuccugaccgugagcgucauggaccuuucucagauguauucccccguguucgaguacuugucaggcgaucgccaaguagaagaguggccgaaggccacuugcaccggggacuguccugagagaugcggauguacaaguucuaccugccugcauaaagaauggccccacucgaggaauuggcguuguaacccaacuuggugcuggggcguggguacaggguguacgugcuguggccucgauguuaaggaccuguuuaccgauuauauguucgucaaauggaagguggaguacaucaaaacugaagcuauagugugcgucgaguuaacaucccaggaacggcaguguucucugauugaggccggaacccgauuuaaucuuggcccuguuacaaucacuuugagcgagcccagaaacauucagcaaaagcucccacccgaaaucauaacccugcauccuaggaucgaggaaggguucuuugaccuaaugcacgugcagcgcgugcugucagcaaguacgguaugcaagcuccaguccugcacccauggagucccaggugaccuucagguguaccacauuggcaaucuguugaaaggggauaagguuaacggacaccugauccauaaaauugagccgcacuucaauacaucuuggaugagcugggacggcugugauuuagacuauuacugcaacaugggugauuggcccuccuguacuuauaccggggugacacaacauaaucacgccgcuuuugucaaccuccugaacaucgaaacugacuacaccaagaauuuccacuuccauucaaaacgggugacggcgcacggcgauacaccucagcuugaccugaaggcaagaccaaccuauggagccggcgagguuacuguguugguagaggucgcugauauggaacuccauacaaagaagauagagauuagcgggcugaaguuugccagucuaaccugcacuggauguuacgcaugcagcuccggcaucagcuguaaagugaagauccacguggacgaacccgaugagcugaccguccauguuaaaucggaggacccugauauuguggccgcugguucaucucucauggccaggaagcuggaguucggggcagacaguacauuuaaagcguucuccgcuaugccaaagacgagccuuugcuuuuauaucguagaacgcgaauacuguaagucuugcagccgagaggacacccggaaaugugugaacacuaaguuggaucguccccaguccauucugauagaacacaaaggaacaaucauuggcaagcagaauaauaccugcacagccaaagcaucaugcugguuagagagugucaagagcuucuuuuacggucucaagaauaugcugucuggcaucuucgggaacguguuuauuggaaucuuccuuuuuauagccccguucguucugcuaauccucuuuuucauguucggcuggaggauucuguuuuguuucaaaugcuguagacgcacucggggguuguuuaaguauagacaccugaaagacgaugaggaaaccggauacaggaagaucauugagcgauuaaauaacaaaaagggcaagaauaaacuccuggacggugaacgccuugcugaucggaagaucgccgagcuguucuccacgaaaucacauauaggg

SEQ ID NO: 10473 - RNA, 3495 nt, Artificial Sequence
  derived and/or modified CDS sequence (opt3) from CCHVF(CCHVF Turkey200310849)__DQ211636.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagguugacuccacaccagugaagugucgacaggguuuuugcuuaaaaauuacccaggaggggcguggacauguaaagcugucuagaggcucggaagugguccuagaugcaugugacucaagcugcgaggugaugaucccgaagggcacuggggauauacucguugacuguaguggaggucagcaacacuuccugaaagauaaccuuaucgaccugggcugcccccauauuccuuugcucgggaagauggccaucuacauuuguaggauguccaaucacccacggacaaccauggcguuucuguucugguuuucuuucggauaugugaucacgugcauaagcugcaaagcucuguuuuacucccucauuaucauuggcacuuuagguaagaaaaucaagcaguaucgcgaacugaagccccagaccuguacaaucugcgagacugccccugucaacgcaauugaugccgagaugcaugaccuuaauuguucauacaacauaugcccauauugugcuaguagauugaccagcgacgggcuggcaaggcacgugacacagugccccaaacggaaggaaaaaguagaggaaaccgagcuauaccucaaucuggaacgcaucccuuggauuguucgaaaacuucugcaagugucugaguccacgggagucgccuugaagagaucaagcuggcucaucgugcuguuagugcugcucacugucagucuuucuccaguucaguccgcuccggugggccacggcaagacaauagagauuuaccagaccagggaaggguucgccagcaucugucuguuuauguugggaucgauccuauucauuguaucuugccuggugaaaggucucgucgauuccgugucagacaguuucuuucccggccugagcguuuguaagacuugcuccaucgggucugugaacggauuugagauugaaagccauaaguguuauugcucacuuuucugcuguccuuacugccggcacuguagugcggaucgugagauacaucagcugcacuuguccaucugcaaaaagcgcaaaacaggcagcaaugucaugcucgcaguguguaagagaaugugcuucagggccaccauugaagcuagucggcgagcccuguuaauccgcucaaucauuaacacgaccuuuguaauauguauccugacacuaacuauuugcguugugaguaccagcgcagucgagauggagaaucucccagcugguacaugggaaagagaggaagaccugacuaacuucugucaccaagagugccaggugaccgaaacagagugucuuugccccuaugaggccuugguccugaggaaaccucucuuucuggauuccaucgugaaggggaugaagaaucuucugaacucuaccucguuggaaacuagccucuccauugaggcgccauggggcgccaucaacguucagucaacguucaaacccgcagugaguacagcuaauauagcccugucuuggagcuccguagaacaucggggaaacaagaucuuagucaccggccgcucagagagcauuaugaaacuggaggaaagaacuggggugucuugggaccuaggaguugaggaugcuuccgaaaguaagcuccugaccgugagcaucauggaccuuucucaaauguacuccccggucuuugaguauuugucaggugaucgucagguggaagaguggccuaaagccacaugcaccggcgacugucccgagaggugcggguguacuucuagcacaugccugcacaaggaauggccacauucgcggaauuggcgauguaacccuacguggugcuggggaguaggcaccgguuguacuugcugugggguggauguuaaggaccucuucacagaccacauguuugucaaauggaagguggaguacauuaaaaccgaagcaaucgugugcgucgagcugacaucccaggaaagacaguguucuuuaauagaggccggcacuagguucaaucugggacccguuaccauuacgcuuagcgagccacgcaacauccaacagaaguugcccccugaaauuaucacccuccauccaaaaauagaggaaggcuuuuucgaucugaugcacgugcagaaggugcuaucagcuaguacaguaugcaagcugcaguccugcacucacgggaucccgggagaccuccaagucuaucauauugguaaucugcuuaaaggcgaucgggugaacgggcacuugauccauaagauugagucucacuuuaauaccagcuggauguccugggacggaugugaucuggacuacuacugcaacaugggcgauuggcccucauguacauauacugguguuacccagcacaaucaugcggcauucgugaacuuacucaauaucgaaacggacuacacaaaaaccuuucacuuccauagcaagagagucacugcccacggggauacaccucagcuggaccuuaaagcuaggccaaccuauggcgccggagagauaacugugcugguugagguggcagauauggaauugcauaccaagaaaguagagauuaguggccucaaguucgccucucuggcuugcacaggguguuacgccugcuccagcggaaucucguguaagguccgcauccacguggacgaacccgaugagcuaacggugcacgucaaaucaucugacccugacguuguggcagcgaguaccucccugauggcucgaaagcucgaguuuggcacugauagcacauucaaagccuuuucugcaaugccaaagaccagccugugcuucuauauuguagaacgggaguacuguaaauccugcucagaagacgauacacagaaguguguggacacucgucuugagcaaccccagaguaucuugauugaacauaaggguaccauaaucgggaaacagaacgauacgugcacagccaaggcuagcugcuggcuggagucugucaaauccuuuuucuauggauuaaagaauaugcucggcucaguguuugguaaccuguucauuggcauccuucuguuucuagccccguucguucuccugguguuguuuuucauguuuggguggaaaauucuguucuguuucaagugcuguagaaggacccgcggauuauuuaaguaccggcaccucaaagacgaugaggaaacuggcuacagaaggaucauagagcgacugaacaguaagaaagggaagaaucgccuucuggacggagaucgguuggcagacagaaaaaucgcugaacucuucagcaccaagacacauauuggc

SEQ ID NO: 10474 - RNA, 3495 nt, Artificial Sequence
  derived and/or modified CDS sequence (opt3) from CCHVF(CCHVF Iran-52)__DQ446215.1__Gn-NSm-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugcguagcuucaaauugugugaaaauuccgcuacugguaagucuugcgagauugauucgaucccuguaaaauguaagcagggguacugcuuaaaaauuacccaggagggacgaggccaugugaagcugucaagaggcagcgaagucgugcuagacguuugugauaguuccugcgaggugaugaucccaaaggggacaggagacauacucgucgauuguucugguggccagcaacacuuucugaaagacaaccuuguggaucuggggugcccgaagauccccuugcucggaaaaauggcaauuuauaucuguaggaugagcaaucauccuaagaccacuauggccuuccuguuuugguucuccuuuggcuacguaauuacaugcauccugugcaaagcgauauucuuucucuuaauuaucuucgguacccuggggaagcgguuuaagcaguaucgcgaacuuaaaccacagacguguacuauuugcgagaccacacccguuaacgcuaucgacgccgagaugcacgauuugaauuguucauacaacaucugcccuuauugugcaaguagacugacuagcgacggacuagccaggcaugugacccagugcccacggcgcaaggaaaaagucgaggaaacagagcucuaccugaaucuugaacgaauacccuggguggugagaaagcuguugcaagucucugaguccaccggcacgguucucaaaaggucaagcuggcugauuguguuacugguacucuucacugugagucuuucuccuguccaguccgcuccaaucggccacgggaagacaauugagaccuaccgggugcgugaagaguauacuagcaucugucuguuuguuuugggaucgauacuauucauugugucuuuucugaugaaaggucucgucgacggcguggggaacaucuucuucccgggacuguccguaugcaagacauguucaaucggcaguauuaaugguuuugaaaucgagagccacaagugcuacuguucccuuuucugcugccccuauugucgccauugcucugcagauggggaaauucaccagcugcauuugagcauauguaaaaagagaaaaaccggcucaaacguuaugcucgccgugugcaagaggauguguuuucgggcuacgauggaggucaguaauaaagcccuguucauccgauccauuaucaacaccacauuuguggucugcaucuuaauucuggcgguguguguugugagcacuucugcaguagagauggaaucacuaccugccggaaccugggagcgcgaagaggaccucacaaauuucugccaccaggaaugucaagucacugagaccgagugccuguguccauacgaagcucuuguguugagaaggccccuguuucucgauaguauaguuaagggcaugaagaaccugcuuaacagcacaucccuggagaccucuuugucgaucgaagccccuuggggagcaauuaaugugcagagcacuuauaaaccaacggucuccacagcuaacaucgcccucucauggaguucuguggagcaccgggggaauaagguacuggugagcggucgcuccgagucaauuaugaaauuagaagagagaaccggcaucagcugggaccuggggguugaagaugcgucugaguccaagcuacucacugucagugugauggaccugagccagauguacucucccguguucgaauaucuuuccggagauaggcaagucgaggaguggccgaaagcaaccugcacaggcgacugcccugaacguugugguugcaccucaaguacuuguuugcauaaggaguggccccacagccggaacuggcgaugcaauccaacaugguguuggggcguugggacgggaugcaccuguugcggccuggaugugaaggaccucuuuacugauuacauguucgugaaauggaagguagaauacauaaaaacagaggccaucgucuguguggaacugaccucgcaggagagacagugcuccuuaauugaggcugggacaagguuuaaccugggaucuguuacuaucacccuuagcgaaccucgcaauauucagcaaaaguugcccccagagaucauaacgcuccaucccaaaauugaagaggguuucuuugaccugaugcacgugcagaagguccuaucagccaguaccguguguaagcugcaguccugcacacauggcguuccuggggaccuccagguguaucacaucggaaaccugcuuaaaggcgaucggguaaauggucacuugauucauaagaucgaacaacacuucaacacuucuuggaugagcugggacgggugcgaucuggacuacuauuguaauaugggcgauuggccauccugcaccuacacaggagucacucagcauaaccacgcuucauucgugaauuuacucaacauagagaccgacuauacgaaaacauuucacuuccauagcaagagagugaccgcccacggcgauacuccgcagcuggaccuuaaagcaaggcccacauacggggccggagagaucaccguccugguugaaguggcugauauggaguugcauacuaagaaaauugaaaucaguggccucaaguuugcgggucugaccuguacagggugcuaugcauguucuuccggaauuagcugcaagguacgcauccacguggaggagccugacgaacuaacgguccaugugaaaucggaugacccagauguuguggccgcuucaucuagucugauggcccgaaagcucgaguucggcaccgacuccacuuuuaaagcauucagcgccaugcccaagacaucucuguguuuuuacauagucgaacgggaguacugcaaaagcuguuccaaggaagacacccagaagugcgugaauacaaaacuugagcaaccucagucaauuuugaucgagcacaaggguacuaucauuggcaaacagaacaacaccuguacggcuaaggccaguugcuggcuggaaagcguuaaaucuuucuuuuauggguuaaagaauaugcucggaggcaucuucgggaacguguuuauuggaauauucacauuucugaccccauucauccuucugauucuauucuuuauguucggcuggcguauccucuuuugcuucaaguguugcagaaggacucgcggucuguuuaaauaccggcacuugaaggaugacgaggaaaccggguauagaaaaauuaucgagaggcugaauaacaagaaaggaaagaaucgauuacucgauggcgaacgccuggcagaccggaagauagcggagcuuuucuccacaaaaacucauaucggu

SEQ ID NO: 10475 - RNA, 3495 nt, Artificial Sequence
  derived and/or modified CDS sequence (opt3) from CCHVF(CCHVF Iran-53)__DQ446216.1__Gn-NSm-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugcguagcuucaaauugugugaaaauuccgcuacugguaagucuugcgagauugauucgaucccuguaaaauguaagcagggguacugcuuaaaaauuacccaggagggacgaggccaugugaagcugucaagaggcagcgaagucgugcuagacguuugugauaguuccugcgaggugaugaucccaaaggggacaggagacauacucgucgauuguucugguggccagcaacacuuucugaaagacaaccuuguggaucuggggugcccgaagauccccuugcucggaaaaauggcaauuuauaucuguaggaugagcaaucauccuaagaccacuauggccuuccuguuuugguucuccuuuggcuacguaauuacaugcauccugugcaaagcgauauucuuucucuuaauuaucuucgguacccuggggaagcgguuuaagcaguaucgcgaacuuaaaccacagacguguacuauuugcgagaccacacccguuaacgcuaucgacgccgagaugcacgauuugaauuguucauacaacaucugcccuuauugugcaaguagacugacuagcgacggacuagccaggcaugugacccagugcccacggcgcaaggaaaaagucgaggaaacagagcucuaccugaaucuugaacgaauacccuggguggugagaaagcuguugcaagucucugaguccaccggcacgguucucaaaaggucaagcuggcugauuguguuacugguacucuucacugugagucuuucuccuguccaguccgcuccaaucggccacgggaagacaauugagaccuaccgggugcgugaagaguauacuagcaucugucuguuuguuuugggaucgauacuauucauugugucuuuucugaugaaaggucucgucgacggcguggggaacaucuucuucccgggacuguccguaugcaagacauguucaaucggcaguauuaaugguuuugaaaucgagagccacaagugcuacuguucccuuuucugcugccccuauugucgccauugcucugcagauggggaaauucaccagcugcauuugagcauauguaaaaagagaaaaaccggcucaaacguuaugcucgccgugugcaagaggauguguuuucgggcuacgauggaggucaguaauaaagcccuguucauccgauccauuaucaacaccacauuuguggucugcaucuuaauucuggcgguguguguugugagcacuucugcaguagagauggaaucacuaccugccggaaccugggagcgcgaagaggaccucacaaauuucugccaccaggaaugucaagucacugagaccgagugccuguguccauacgaagcucuuguguugagaaggccccuguuucucgauaguauaguuaagggcaugaagaaccugcuuaacagcacaucccuggagaccucuuugucgaucgaagccccuuggggagcaauuaaugugcagagcacuuauaaaccaacggucuccacagcuaacaucgcccucucauggaguucuguggagcaccgggggaauaagguacuggugagcggucgcuccgagucaauuaugaaauuagaagagagaaccggcaucagcugggaccuggggguugaagaugcgucugaguccaagcuacucacugucagugugauggaccugagccagauguacucucccguguucgaauaucuuuccggagauaggcaagucgaggaguggccgaaagcaaccugcacaggcgacugcccugaacguugugguugcaccucaaguacuuguuugcauaaggaguggccccacagccggaacuggcgaugcaauccaacaugguguuggggcguugggacgggaugcaccuguugcggccuggaugugaaggaccucuuuacugauuacauguucgugaaauggaagguagaauacauaaaaacagaggccaucgucuguguggaacugaccucgcaggagagacagugcuccuuaauugaggcugggacaagguuuaaccugggaucuguuacuaucacccuuagcgaaccucgcaauauucagcaaaaguugcccccagagaucauaacgcuccaucccaaaauugaagaggguuucuuugaccugaugcacgugcagaagguccuaucagccaguaccguguguaagcugcaguccugcacacauggcguuccuggggaccuccagguguaucacaucggaaaccugcuuaaaggcgaucggguaaauggucacuugauucauaagaucgaacaacacuucaacacuucuuggaugagcugggacgggugcgaucuggacuacuauuguaauaugggcgauuggccauccugcaccuacacaggagucacucagcauaaccacgcuucauucgugaauuuacucaacauagagaccgacuauacgaaaacauuucacuuccauagcaagagagugaccgcccacggcgauacuccgcagcuggaccuuaaagcaaggcccacauacggggccggagaggucaccguucugguggaaguagcugauauggaguugcauacuaagaaaaucgaaauuaguggccucaaguuugcgggucugaccuguacagggugcuaugcauguucuuccggaaucagcugcaaggugcgcauucacgucgacgagccugaugagcuaacggugcauguuaaaucggacgauccagacguggucgccgcuucaucuagucugauggcccgaaagcucgaguucggcaccgacuccacuuuuaaagcauucagcgccaugcccaagacaucucuguguuuuuacaucguggaacgggaauacugcaaaagcuguuccaaggaggauacccagaagugcguuaauacaaaacuugaacaaccucagucaauauugauugagcacaaggguacuaucaucggcaaacagaacaacaccuguacggcuaaggccaguugcuggcuggagagcgugaaaucuuucuuuuauggguuaaagaauaugcucggaggcauuuucgggaacgucuuuaucggaauuuucacauuucugaccccauucauacuucugauccuauucuuuauguucggcuggcguauucucuuuugcuucaaguguugcagaaggacucgcggucuguuuaaauaccggcacuugaaggacgaugaagagaccggguauagaaaaaucauugaaaggcugaauaacaagaaaggaaagaaucgauuacucgacggcgagcgccuggcagaucggaagaucgcggaacuuuucuccacaaaaacucauauaggu

SEQ ID NO: 10476 - RNA, 3495 nt, Artificial Sequence
  derived and/or modified CDS sequence (opt3) from CCHVF(CCHVF Kosova Hoti)__EU037902.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccagaaggggcguggacaugugaagcugucuagaggcucggagguagugcuagaugcaugugacucaaacugcgaagucaugauaccgaaaggcacuggggauauccucguggacuguagcggaggucagcaacacuuccugaaggauaaucuuauugaccugggcugcccccauaucccuuugcucgggaaaauggccauuuacaucuguaggaugaguaaccacccaaagacaaccauggcguuucuguucugguuuuccuucggauauguuauaacgugcauuuucugcaaagcucuguucuacucucucaucauuaucggcacuuuagguaagaagaucaaacaguaucgggagcugaagccccagaccuguacaauuugcgaaacugccccugugaaugcaauagaugccgagaugcaugaccuuaacuguagcuacaauaucugcccauauugugcuucccgcuugaccucagacgggcuggcaagacacgucaaacagugccccaagaggaaagagaagguggaagagacagaacuauaccucaaccuggagcggauuccuuggguaguucgcaaacuucugcaagugagugaaagcaccggagucgccuugaagcgaucuuccuggcucaucgugcuguuagugcugcucacggucucacuuagcccaguucagagugcuccggugggccacggcaagacuauagagacauaccagaccagagagggguuuacuucuauuugucuguucauguugggauccauccuauuuaucguaagcugccuggugaaaggucucgucgauucggugucugacuccuucuuucccggccugucaguuuguaagacaugcaguauugggagcaucaauggauucgaaauugagucccauaaauguuauugcucucuuuucugcuguccuuacugcaggcacuguagcgccgaucgggaaauacaucagcugcacuugaacaucugcaagaaacguaagaccggcucaaaugugaugcucgcggucuguaagcgcaugugcuuuagagcaacgauugaggccaguaggcgggcucuguuaauccgauccaucauuaacaccacauucgugauauguauccugacucuaaccauuugcguaguuagcacaucugccguggaaauggagaaucucccagcagguacuugggagcgcgaagaggaccugaccaacuuuugucaccaagaaugccaggucacagagaccgaaugucuuugccccuaugaggcuuuggugcugagaaaaccucucuuccuggauucaaucgucaaggggaugaaaaaccuucugaauaguacuagcuuggagacgucccucucuauugaagccccauggggcgcgaucaacgugcagucgacauuuaagcccaccguuagcacugccaauauagcacuguccuggucaaguguggagcauaggggaaacaaaaucuuaguaaccggccggucugaaagcauuaugaagcuggaggagcgcacagggaucuccugggaccuaggagucgaagaugcuucagagagcaagcuccugaccgugucuauuauggaccuuucccaaauguacaguccgguuuucgaauauuugagcggugauagacagguggaggaauggccuaaagccacuugcacaggcgacuguccccagaggugcggguguacgucuucaaccugccugcacaaggaguggccacauucccguaauuggcgguguaacccuacuuggugcuggggagucggcacagguuguaccugcugugggguggauguaaaagaccucuuuacagaccacauguucgugaaguggaaaguugaguacaucaagacugaagcuauagucugcguggagcugaccagucaggaacgacaauguagcuuaauugaggccggcacgagauuuaaucugggacccgugaccaucacacuuucggaaccaaggaacauucagcagaaguugcccccugagaucauaacucuccauccaaaaaucgaggaaggcuucuuugaucugaugcacguccagaagguucuauccgcaucuaccgugugcaaacugcaaagcugcacacacgggauuccgggagaccuccagguguaucauaucgguaaucugcuuaagggcgaucgcguaaacgggcacuugauucauaaaaucgagccccacuucaauacuucauggaugaguugggacggaugugaucuggacuacuacugcaacaugggcgauuggccuuccuguaccuauacgggugucacacagcacaaucaugccgcuuuugugaacuuacucaauauagaaaccgacuacacuaagacauuccacuuccauucuaaacggguuaccgcgcacggggauacuccacagcuggaccuuaaggcaagacccaccuauggcgccggagagauuacagugcuggucgaaguggcugauauggaguugcauacgaagaaaguugagaucagcggccucaaguuugccucccuggcaugcaccggguguuacgccugcucaagcggaaucaguuguaaagugaggauucacguagacgaaccugaugagcuaacuguccacgugaagucuuccgacccagacguggucgcugccggcacaagccugauggcacgcaaacucgaauuugguaccgauucgacauuuaaggcguucucagcuaugcccaagacuucucugugcuuuuauaucguugagaaagaguacuguaagaguugcuccgaagacgauaccaaaaaguguguggacacgaaacuugagcaaccgcagagcauuuugauagaacaucgagggacaaucauuggaaagcagaacgauaccugcacugccaaggcaucuugcuggcuggagagcguaaaauccuucuuuuauggcuuaaagaacaugcucgguucaguguucggcaacuuuuucaucgggauucugcuuuuucuggccccuuucguccuacucgugcuguuuuucauguucggauggaaaaucuuguuuuguuucaagugcugucggcguaccagaggccuguuuaaauacaggcacuuaaaggacgaugaagagacaggguaccgccggauaaucgagagacucaauaauaagaaaggaaagaacaggcugcuugacggcgaacgacuggcugaucgcaaaauugccgaguuguucaguacuaagacccauaucggu

SEQ ID NO: 10477 - RNA, 3495 nt, Artificial Sequence
  derived and/or modified CDS sequence (opt3) from CCHVF(CCHVF YL04057)__FJ562094.1__Gn-NSm-Gc
gccgagggcgggagcuccgacugcaucucuagaacccagcuggugaagacagaagucgcugagauucacgaagauucauacggaggucccggcgagaaaauaacuaucuguaacgggaguacgauuguugaccaaaggcucggacgggaacuuggcugcuauaccaucaaucgcgugcgaagcuacaagcugugugagaacuccgcaucugguaaaucgugcgagauugauucaaucccuguaaaguguaaacagggguucugcuugaagauaacacaggaaggacguggccaugugaaguuaagcagaggcacugagaucguccuggacgugugugauaguuccugcgaacuaaugauuccaaaagggaccggagacauccucguugauuguucugguggccagcaacacuuucugcagaauaaccuuauugaccuggggugcccgaaugugcccuugcucggaaagauggccaucuaugucuguaggaugagcaaccauccuaaaacaaccauggcguuccuguuuugguucuccuuuggcuacgugauaacuugcauugcuugccggguacuguucuaucucuuaaucgccauugguacaguugggaagaaacugaagcaguaccgcgagcuuaagccacagaccuguaucgugugcgagucaguccccgugaaugcaaucgaugccgaaaugcacgaguugaacuguaguuauaauauuugcccuuacugugcuagcagacugucuacggacggacuaauaaggcaugugacucaaugcccaaaacggcgcgaaaaggucgaggaaaccgagcucuuucugaaccuugagcgaauccccuggcugguuagaaaauugcuccagguguccgaaucaacaggcauggcacugaagaggagcuguuggaugauuacuuuacugauccuccuucugguaaguauaucuccugugcaguccgccccagucggcaaagagcgggcuauugaaaccuaccaggcccgugagacauauaccgggaucugcuuguucgugcuaggaagcguucuguuugcggugucguggcucacgaaggcacugaucgaugguauuggcaauucuuucuuuccggggcuuuccgucuguaaaacuugcucaaucggaaguauuaacggcuucgaaauagagagccacaaguguuacugcucccuguuuugcugucccuauugccgcgccuguucuagcgacaagaauacacacagaaugcauuugaacgugugcaaaaagaggaaaauggguucaaauguaaugcucgcuguuuguaagcggaugugcuuccgagccaccaucgaggcaaguaacaaagcucuguuaauucgcuccaucaucaacagcacuuucgugauuuguauacugauccuaacaauuugcgucgugucuaccucagccgucgauauggaaaaucucccugcggggaucugggagaaggaagaggaccugacgaacuuuugucaccaagaaugccaggugaccgagacagagugucuuugcccauacgaagccaugguuuugagaaagccccuguuccucgacaguauugcaaaaggcaagaaaagccugcuuaauuccacuucucuggagaccucguugagcaucgaagcuccuuggggagccauaaacgugcaguccacauuuaagccaacuguaucagcugccaauaucgcacucaguuggucuagcgucgagcauaggggcaacaaaauucugguguccgggcggucagagagcaucaugaaguuagaagaacgcaccggaguuucuuggaaucuggguguggaagaugccuccgagaguaagacacuaaccgucagcgugauggaccucucucaaauguauucccccguauucgaauaccugucaggcgauagacagguggaggaguggccgaaagcuacuugcacgggggacuguccugaaaggugcggauguacaaguucgaccugccuucacaaggaguggccccacagccguaacuggcgguguuccccaacuuggugcuggggcguugguaccggguguacaugcuguggcuuggaugucaaagacuuuuucaccgauuauaugcuggugaaguggaaaguggaauacauuaagacugaggcgaucgucugcguugaacucacaucucaggagcgacaguguagccugauagaggcaggaacgagauuuaauuuaggcccugugaccauuacucugucagaacccaggaacgugcaacagcgccuuccacccgagaucguaacauugcauccuaagauugaagagggguucuuugaccucaugcacguccagaaaauccugagugccuccaccgugugcaagcuacagucuugcacacauggaguuccaggugauuuccaaguguaccacgucggcaaucugcucagaggggacaaagugaacggacauagcauacacaagaucgaaccgcacuuuaauacuuccuggaugucaugggauggcugugaccuggacuauuucugcaacaugggugauuggcccagcuguaccuacacggggguuacccagcauaaucgggcugccuuuauuaacaugcuuaacaucgagacagacuauacuaaaaccuuccacuuccauaguaagagggugacagcacacggcgauacuccucaguuggaccugaaagcccgcccagcuuacggagccggcgagguaaccgucuuaguggaaguggcagaucucgagcugcacacgaagaaacuugaagucucugggcugaagauugcguccuugacaugcagcggauguuaugcuugcucgucaggcaucucuuguaagguucgaauacaugugaaugagcccgacgaguuuaccguacacgugcggaguuccgauccugacgucguggccgcagguagcucucucauggcccguaaaauugaguucggggcugauagcacuuuuaaggccuucuccucaaugccaaaagacagucugugcuuuuacaucguugagaaggauuauuguagcucuugcacagacgaugacacccagaagugugugaacacuaaacuagaccauccccaauccauccugauugaacacaagggaaccaucauuggcaaacagaaugauacaugcucaacgaagaccaguugcuggcucgagagcgucaaagguuucuuuuacggccugaagaacaugcuuuccgggauauucggaaauguguuuuugggcauccuguuauuccucgcaccguuuguucugcuuauuuucuuuuucuucuuuggguggagacugcuauucugucucaagugcuguaggcgcacucggggacuguugaaauacaagcaucugaaagacgaagaggaggcuggcuauaagaaaaucauugaaagauuaaacgguaagaaggggaaaucucagcucuuugauggagagaggcuggccgaccgaaagaucgcggaacuuuucucgacaaaaauacacaucggc

SEQ ID NO: 10478 - RNA, 3495 nt, Artificial Sequence
  derived and/or modified CDS sequence (opt3) from CCHVF(CCHVF V42/81)__GU477490.1__Gn-NSm-Gc
agcaaggagcccggcgacgauugcaucuccagaacccagcugaugaggacagaaacugccgagauucacgacgauaacuacgggggaccuggugacaaaauaacgaucuguaauggcucuaccauuguggaucaacggcucgggucagaacuuggaugcuauacaaucaaccgcgucaagaguuucaaacugugugagaauagcgcuacuggcaaggcaugcgaaguugacuccaccccagugaaaugucgacaggguuuuugcuugaagauuacacaggaggggcguggacauguaaaguuaucuagaggcucggaggugguccuggaugccugugacucaagcugcgaagugaugaucccgaaaggcaccggggauauccuaguugacuguaguggaggucagcaacacuuccucaaggauaaccugaucgaccuugagugcccccauauuccucuguugggcaaacucgcgaucuacauuuguaggauguccaaucacccacggacuacaauggcuuuucuguucugguuuggguucggauaugugauaaccugcauacugugcaaggcccucuuuuacucuuuaauuaucauuggcacgcuggguaaaaagaucaagcaguaucgcgaacuuaaaccccagacuuguaccaucugcgagacagcaccugucaacgccauugaugcugagaugcaugacuugaauuguagcuacaacauaugcccauauugugcauccagacugacuucagacgggcuagccaggcacgugacccagugccccaagcggaaagaaaagguagaggaaacagagcucuaccugaaucuugaacgcaucccuuggauuguucgaaaacuguugcaagugagugagagcaccggagucgugcucaagagaucuuccuggcugaucguguuacugguccuccuuacgguuucacugagcccagugcagagugcuccgguaggccacggcaaaacuauagagacauaccagaccagggaaggguucacuucuauuuguuuguuuaugcuaggauccauccuguucaucgugagcugcauugucaagggucucguggauucgguuucugacuccuuuuuccccggccugucaguguguaagacaugcaguaucagcuccauuaacggguuugagauagaaucucauaaauguuauugcagccuuuucugcuguccuuacugccggcacuguucagccgaucgugagauccaucagcugcacuugaguauuugccgcaagagaaggaccggauccaaugucaugcucgcgguguguaaacggaugugcuuccgagcaacgaucgaaguaagccgcagagcccuguuaaucaggucuauuauaaacaccacauuuguuaucuguauucugacucuaaccaucugcguggucucaacaagugcuguggagauggagaaucucccagccggcacuugggaacgggaggaagaccugaccaacuucugucaccaagagugccaggucacagaaaccgagugucuuugccccuaugaggcauuggugcugcgcaagccucucuuucuggauagcauuguuaaagguaagaagaaucuucugaacuccacuucuuuggaaacgucgcucagcaucgaggcuccauggggcgccauaaacauccaguccacauucaaacccaccgugucagcggccaauauugcacugaguuggucuagcguagaacauagagggaacaagaucuuagucuccggaaggucagagagcauuaugaaacuggaggaacguacuggcgugucuuggaaucuagggguugaggacgcuuccgaaaguaagcuccugaccgugagcaucauggaucuuucucaaauguacuccccggucuuugaguauuugucaggagaccgacagguggaagaguggccuaaagccacaugcaccggugauugucccgagcggugcggcuguacuucaagcacaugccugcacaaggaauggccacauucgagaaacuggagguguaauccuacguggugcuggggaguagggaccggcuguacuugcugugguguggacguuaaggaucucuucauagaccacauguuugucaaauggaagguggaguacauuaaaacagaagcuaucgugugcgucgagcugaccucccaggaacgccaguguucuuuaauugaggccgggacacgguucaaccugggccccguuacuaucacccuuagcgagccaagaaauauacaacagaaguugcccccugaaaucauuacgcuccauccaaaaaucgaggaaggauuuuucgaccugaugcacgugcagaaggugcuaucagcaaguaccguaugcaagcugcaguccugcacacacggcauuccgggggaucuccaagucuaucauaucggaaaccugcuuaaaggugacagggugaauggccacuugauacauaagauugagccccacuuuaacacuucuuggaugagcugggaugggugugaccuggauuacuacugcaauaugggagacuggccuuccuguaccuauacaggcguuacucagcacaaccaugccgcuuucgugaauuuacucaacaucgaaaccgauuacacgaaaacauuucacuuccauucaaagcgcgucaccgcgcacggugagacuccacagcuggaccuuaaagcacgacccgccuauggggcuggcgagaucacagugcugguugaaguggccgauauggaguugcauaccaagaaaguagaaauuagcggacucaaguucgcaagucuggccugcacuggcuguuacgcuuguucuuccgggaucagcugcaagguccggauucacguggacgagccugaugagcuaaccgugcacgucaaaucgaaugacccagauguuguggccgcaucaacaucucugauggcgcguaagcucgaaaguggaacggacuccaccuuuaaggcuuucagcgccaugcccaagacuucucugugcuuuuauauaguagagagagaauacuguaaaagcugcuccgaggacgauacacagaaguguguggaaaccaaacuugagcaaccgcagucaaucuugauugagcauaaaggcacaaucauugguaagcagaacgacacuugcaccgcaaaagccaguugcuggcuggaaagcgucaagucuuucuuuuaugggcucaaaaacauguuaggauccguguucggcaacuuuuucaucgguauacugcuuuuucuggcuccuuucguucuacucgugcuguuuuucauguuuggcuggaagaucuuguucuguuucaagugcuguaggcgcacgcgggggcuguuuaaauacagacacuuaaaggaggaugaagagacaggauacaggcgaauuaucgaacgccucaauaguaaaaagggcaaaaaucggcugcuugacggggagagacuggccgauaggaagauugcagaguuguucaguaccaagacucauaucgga

SEQ ID NO: 10479 - RNA, 3495 nt, Artificial Sequence
  derived and/or modified CDS sequence (opt3) from CCHVF(CCHVF 79121M18)__GU477493.1__Gn-NSm-Gc
gccgagggcgggagcuccgacugcaucucuagaacccagcuggugaagacagaagucgcugagauucacgaagauucauacggaggucccggcgagaaaauaacuaucuguaacgggaguacgauuguugaccaaggacucggcagcgaacuugguugcuauaccaucaauagggugcgguccuacaagcugugugagaacucugcaucggggaaaucaugcgagauugauagcaucccuguaaaguguaaacagggauucugcuugaagauaacacaggaaggccgcggccaugugaaguuaagucgagggacugagaucguccuggacgugugugauuccucuugcgaacuaaugauuccaaaaggaaccggugacauccucguugauuguagcggcgggcagcaacacuuucugcagaauaaccuuauugaccugggaugcccgaaugugcccuugcucggcaagauggccaucuaugucugucguauguccaaccauccuaaaacaaccauggcguuccuguuuugguucucauuugguuacgugauaacuugcauugcuugcagaguacuguucuaucucuuaaucgccauugggacaguuggaaagaaacugaagcaguacagggagcuuaagccacagaccuguaucgugugcgagaguguccccgugaaugcaaucgaugccgaaaugcacgaguugaacuguagcuauaauauuugcccuuacugugcuucucggcuguccacggacggccuaauacgccaugugacucaaugcccaaaaagaagggaaaaggucgaggaaaccgagcucuuucugaaccuugagcggauccccuggcugguucgcaaauugcuccaggugucagaaagcacaggcauggcacugaagcgaaguuguuggaugauuacuuuacugauccuccuucugguaucuauauccccugugcagagcgccccagucgggaaagagagagcuauugaaaccuaccaggccagggagacauauaccggaaucugcuuguucgugcuagguucgguucuguuugcggugucuuggcucacgaaggcacugaucgauggcauuggaaauuccuucucaccggggcuuagugucuguaaaacuugcagcaucggcuccauuaacgguuuugaaauagagucucacaaguguuacugcagccuguucugcugucccuauugccgggccuguucaagugacaagaauacacaccguaugcauuugaacgugugcaaaaagcgcaaaaugggguccaauguaaugcucgcuguuuguaagagaaugugcuuuagggccaccaucgaggcaagcaacaaagcucuguuaauucggucuaucaucaacucaacuuucgugauuuguauacugauccuaacaauuugcgucgugaguaccagcgccgucgauauggaaaaucucccugcgggcaucugggagaaggaagaggaccugacgaacuucugucaccaagaaugccaggugaccgagacagagugucuuugcccauacgaagccaugguuuugcgaaagccccuguuucucgacuccacugcaaaaggaaugaagucucugcuuaauucgaccagccuggagacauccuugucaauugaagcuccuuggggcgccaucaacgugcagaguacuuucaaaccaaccguaucugcugccaauauagcacucagcugguccucagucgagcaucgcgggaacaagauccuggugagcggaagaucugaguccauuaugaaauuagaagagaggacagguguuaguuggaaucugggcguggaagaugccagcgagucuaagacccuaacugucuccgugauggaccucucacaaauguauagucccguauuugaauaccugagcggggaucgccagguggaggaguggccgaaggcuacgugcacaggagacuguccugaacggugcggcuguaccucguccacuugccuucacaaagaguggccccacucuagaaacuggagguguaauccaaccuggugcugggguguugggacaggcuguaccugcuguggauuggaugucaaggacuucuuuacugauuauaugcuggugaaauggaagguggaauacaucaaaacagaggcgauugucugcguugaacucacgagccaggagcgucaguguucacugaucgaggcaggcacccgguucaacuuagggccugugacuauaacacugagugaaccccgaaaugugcaacagagacuuccacccgagauuguaaccuugcauccuaagaucgaagagggauuuuucgaccucaugcacguccagaagauucuguccgccucuacagugugcaaacuacagagcugcacucaugguguuccaggcgauuuucaaaucuaccacguggggaaccugcucaggggagacaaggucaauggccauuccauacacaaaaucgaaccgcacuucaacaccucauggaugagcugggaugguugugaccuggacuauuuuugcaauaugggggauuggcccaguuguacguacaccggcgugacacagcauaaccgcgcugccuucauuaacaugcuuaauaucgagacugacuauaccaagacauuucacuuccauucuaaacggguuacugcacacggagauaccccucaguuggaccugaaggccagaccagcuuacggcgccggggaggugacgguauuagucgaaguggcagaucucgagcugcacacaaagaaacuugaaguguccggacugaagauugcgagcuugaccugcucgggcuguuaugcuugcucaucugguaucaguuguaaagucaggauacauguuaacgagcccgacgaguucacugugcacguacgcuccagcgauccugacguggucgccgcagggucuagccucauggcccgaaagauugaauuuggagcugauuccacauucaaagccuuuucaaguaugccaaaggacagccugugcuucuacaucguggagaaagauuauuguucuuccugcaccgacgaugacacucagaaguguguuaauaccaagcuagaccauccccaaucaauccugauugaacacaaaggcacaaucauugguaagcagaacgauacgugcaguaccaaaacuagcugcuggcucgaguccgugaagggcuuuuucuacgggcugaaaaauaugcuuucuggaauauuuggcaacgucuucuuggggaucuuucuguucuuagcaccguuugugcuccugauuuucuuuuucuucuuuggauggcggcuucuguucugucuaaagugcugucguagaacaaggggccuccugaaguacaaacauuugaaggacgaagaggaggcugguuauaaaaagaucauugaacgccugaaugggaaaaagggaaagucgcaguuauuugauggcgagcggcucgccgacagaaaaaucgcggaacuguucagcaccaagauacacaucggu

SEQ ID NO: 10480 - RNA, 3495 nt, Artificial Sequence
  derived and/or modified CDS sequence (opt3) from CCHVF(CCHVF Afg09-2990)__HM452306.1__Gn-NSm-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugcgauccuucaaauugugugaaaauuccgcuacugguaagucuugcgagauugauucgaucccuguaaaauguaagcagggguacugcuuaaaaauuacccaggagggacguggccaugugaagcugucaagaggcagcgaagucgugcuagacguuugugauaguuccugcgaggugaugaucccaaaggggacaggagacauacucgucgauuguucugguggccagcaacacuaucugaaagacaaccuuguggaucuggggugcccgaagauccccuugcucggaaaaauggcaauuuacaucuguaggaugagcaaucauccuaagaccacuauggccuuucuguucugguuuuccuucggcuauguaauuacaugcauccugugcaaagcgauauuuuuccucuuaauuaucuuugguacccuggggaagcgguucaagcaguaccgcgaacuuaaaccacagacguguacuauuugcgagaccacacccguuaacgcuaucgacgccgagaugcacgauuugaauuguucauauaacaucugcccuuacugugcaaguagacugacuagcgacggacuagccaggcaugugacccagugcccacggcgcaaggaaaaagucgaggaaacagagcucuaccugaaucuugaacgaauacccuggguggugagaaagcuguugcaagucucugaguccaccggcacgguucucaaaaggucaagcuggcugauuguguuacugguacucuuuacugugagucuuucuccuguccaguccgcuccaaucggccacgggaagacaauugagaccuaucgggugcgugaagaguacacuagcaucugucuguucguuuugggaucgauacuauuuauugugucuuuccugaugaaaggucucgucgacggcguggggaacaucuuuuucccgggacuguccguaugcaagacauguucaaucggcaguauuaaugguuucgaaaucgagagccacaagugcuauuguucccuguuuugcugccccuacugucgccauugcucugcagauggggaaauucaccagcuucauuugagcauauguaaaaagagaaaaaccggcucaaacguuaugcucgccgugugcaagaggauguguuuccgggcuacgauggaggucaguaauaaagcccuguuuauccgauccauuaucaacaccacauucguggucugcaucuuaauucuggcgguguguguugugagcacuucugcaguagagauggaaucacuaccugccggaaccugggagcgcgaagaggaccucacaaauuuuugccaccaggaaugucaagucacugagaccgagugccuguguccauaugaagcucuuguguugagaaggccccuguuccucgauaguauaguuaagggcaugaagaaccugcuuaacagcacaucccuggagaccucuuugucgaucgaagccccuuggggugcaauuaaugugcagagcacuuacaaaccaacggucuccacagcuaacaucgcccucucauggaguucuguggagcaccggggaaauaagguacuggugagcggucgcuccgagucaauuaugaaauuagaagagagaaccggcaucagcugggaccuggggguugaagaugcgucugaguccaagcuacucacugucagugugauggaccugagccagauguauucucccguguuugaauaccuuuccggagauaggcaagucgaggaguggccgaaagcaaccugcacaggcgacugcccugaacguugugguugcaccucaaguacuuguuugcauaaggaguggccccacagccggaacuggcgaugcaauccaacaugguguuggggcguugggacgggaugcaccuguugcggccuggaugugaaggaccucuucacugauuacauguuugugaaauggaagguagaauauauaaaaacagaggccaucgucuguguggaacugaccucgcaggagagacagugcuccuuaauugaggcugggacaagguucaaccugggaucuguuacuaucacccuuagcgaaccucgcaauauucagcaaaaguugcccccagagaucauaacgcuccaucccaaaauugaagagggguuuuucgaccugaugcacgugcagaagguccuaucagccaguaccguguguaagcugcaguccugcacacauggcguuccuggggaccuccagguguaccacaucggaaaccugcuuaaaggcgaucggguaaauggucacuugauucauaagaucgaacaacacuuuaacacuucuuggaugagcugggacgggugcgaucuggacuauuacuguaauaugggcgauuggccauccugcaccuauacaggagucacucagcauaaccacgcuucauucgugaauuuacucaacauagagaccgacuacacgaaaacauuccacuuucauagcaagagagugaccgcccacggcgauacuccgcagcuggaccuuaaagcaaggcccacauauggggccggagagaucaccguccugguugaaguggcugauauggaguugcauacuaagaaaauugaaaucaguggccucaaguucgcgggucugaccuguacagggugcuacgcauguucuuccggaauuagcugcaagguacgcauccacguggacgagccugaugagcuaacgguccaugugaaaucggacgauccagacguuguggccgcuucaucuagucugauggcccgaaagcucgaauuuggcaccgacuccacuuucaaagcauuuagcgccaugcccaagacaucucuguguuucuacauagucgagcgggaauauugcaaaagcuguuccaaggaggauacccagaagugcgugaauacaaaacuugaacaaccucagucaauuuugaucgagcacaaggguacuaucauuggcaaacagaacaacaccuguacggcuaaggccaguugcuggcuggagagcguuaaaucuuucuuuuacggguuaaagaauaugcucggaggcaucuuugggaacguguucauuggaauauuuacauuccugaccccauuuauccuucugauucuauucuucauguuuggcuggcguauccucuucugcuuuaaguguugcagaaggacucgcggucuguucaaauaucggcacuugaaggacgaugaagagaccggguacagaaaaauuaucgaaaggcugaauaacaagaaaggaaagaaucgauuacucgacggcgagcgccuggcagaucggaagauagcggaacuuuuuagcacaaaaacucauaucggu

SEQ ID NO: 10481 - RNA, 3495 nt, Artificial Sequence
  derived and/or modified CDS sequence (opt3) from CCHVF(CCHVF Sudan Al-Fulah 3-2008)__HQ378184.1__Gn-NSm-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaagagcuucaaguugugugaaaauuccgcuacuggcaaaucuugcguuauugauucggugccaguaaagugucgacaggguuacugcuuacguaucacccaggaggggagaggacaugugaaacugucaaggggcagcgaggucgugcuagacgcaugugauacaaguugcgaaauaaugaucccgaagggcaccggggacauucucguugauuguuccggaggucagcaacacuuucugaaggacaaccuuguggaucugggcugccccaaaaucccuuugcucgggaagauggccauuuauaucugucggaugucuaaucauccaaaaacuacaauggcguuccuguuuugguucagcuuuggauacgucauaaccugcauucugugcaaggcuaucuucuaucucuuaauuaucaucggcacgcuggguaaacgcuuuagacaguacagggagcuuaagccccagacuuguaccauuugcgaaacaacuccugugaacgccauagacgcagagaugcacgauuugaauuguuccuauaacaucugcccauacugugccucacggcugaccagugacgggcuagcucgccauguaacacagugccccaagcgaaaagagaagguugaagagaccgaacucuaccugaaucuugagaggauuccuuggguggucagaaaacuguugcaagugagcgaaucuacgggaguggcacucaagcgguccucauggcugaucgucuuacugguucucuucacugugagccuuaguccaguacagucugccccgauaggccacggcaaaacaauugaggcuuaucgugcccgcgagggguacaccuccaucugucuguuuguguugggaagcauccuauucauugucucgugccugaugaagggucucguggacucuguuggcaacuccuuuuuccccgggcugucaaucuguaaaacuugcaguauuagcuccauaaauggauuugaaaucgagucucacaaguguuauugcagccuuuucugcuguccuuacugcagacauuguucagcggauaaggaaauucacaaacugcauuugaguaucugcaagaaaaggaagacaggcuccaacgugaugcucgcagucuguaaacggaugugcuuccgagccaccauggaggugagcaaucgcgcucuguuuaucagaucuauuauaaacacgaccuucguauuauguauccugauucuagccguuugcguggucucaacaagugcaguggaaauggagaaucucccagcugguacuugggagagggaagaggaccugaccaacuuuugucaccaggaaugccaggucacagagacugaaugucuuugccccuaugaggccuuggugcugcggcgcccucucuuccuggauagcaucguuaaggggaugaagaaccuucucaauuccaccucuuuggagacaucgcucagcauugaagcgccauggggcgccaucaacgugcaauccaccuacaaacccacuguaucaacggcaaauauagcucugaguuggucuagcgucgagcacagaggaaacaagaucuuaguguccggcaggucagaaagcauuaugaaacuggaggagcguacagggaucucuugggaccuaggaguugaagaugccuccgagaguaagcuccugaccgugagcgucauggaccuuucucagauguauuccccgguguuugaauacuugucaggugaucggcagguagaggaauggccuaaagcuacuugcaccggcgacugucccgagcgaugcggguguacaaguucgaccugccugcauaaggaguggccacacagcagaaauuggagguguaacccuacuuggugcuggggagugggcacagguuguacgugcugugggcucgauguuaaggaccuguucaccgauuacauguuugucaaauggaagguggaauauauuaaaacugaggccaucgugugcgucgaauuaacaucccaagagcgccaguguucucugauagaagcaggcacccgguucaaucuuggacccguuacaauuacuuugagcgagccaagaaacauccagcagaagcugcccccugagauuaucacccugcauccaaggauagaagagggcuuuuucgaccuaaugcacgugcaaaaagugcugucagccaguacgguaugcaagcuccaguccugcacccauggggucccgggagaccuccagguguaccacaucgguaaucuuuugaagggcgauaaaguuaacgggcaccugauucauaagaucgaaccccacuuuaauacaucuuggaugagcugggacggaugugauuuagacuauuacugcaacaugggcgauuggccuuccuguacuuauaccggugugacacagcauaaucacgcuucauucgucaaccuccugaauauugagacugacuacaccaaaaacuuucacuuccauagcaagcgcgugacggcgcacggggauacaccacaacuugaccugaaagcacgacccaccuauggcgccggagaaaucacuguuuugguggagguagcugauauggagcuccauacaaagaaaauagaaauuaguggccugaaguucgccucucuaaccugcacuggguguuacgcaugcuccagcggaaucucguguaagguccggauccacguggacgagccugaugaacugaccgugcaugucaaaucagacgauccagacguuguggccgcuucuaguucccucauggcccguaagcuggaguuuggcacagacagcacguucaaagcauuuucugcgaugcccaagaccagccuuugcuucuacauuguagagaaagaauauuguaaguccugcucagaggaagauacuaagaaaugugugaacacaaaguuggagcagccgcagaguauccugauugaacacaaagguaccauaaucgggaagcagaauagcacaugcacugcuaaagucucuugcugguuagaguccgccaagucauuuuucuacggacucaaggacaugcugaguggcauuuuugguaacguguucaucggcauuuuucuuuuccuggcaccuuuuguucuacucgugcuguucuuuauguucggguggagaaucuugcuguguuucaggugcugucgccggaccagaggauuauuuaaauauaggcaccucaaggaugacgaggaaacgggcuaccgacgcauaaucgagcggcugaauaacaaaaaggggaaaaauaaacuucuggauggagaaagauuggccgacaggaagauugcugagcuguucagcacaaaaacccauaucggc

SEQ ID NO: 10482 - RNA, 3495 nt, Artificial Sequence
  derived and/or modified CDS sequence (opt3) from CCHVF(CCHVF Sudan AB1-2009)__HQ378187.1__Gn-NSm-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaagagcuucaaguugugugaaaauuccgcuacuggcaaaaacugcgagauugauucuguuccagugaagugucgacaggguuacugcuuacguaucacccaggaggggagaggacauguaaaacugucgaggggcucagaagugguccuagacgcaugugauacaagcugcgagauaaugaucccgaagggcaccggggacauucucguggauuguaguggaggucagcaacacuuucugaaggacaaucuuaucgaucugggcugccccaaaauuccuuugcucgggaagauggccaucuauauaugucggauguccaaccauccaaaaacuacaauggcguuccuguuuugguucucuuuuggauaccugauuaccugcauccucugcaaggcuauuuucuauuuacugaucaucauuggcacgcuugguaaacgcuugaagcaguacagagaacugaagccccagacuuguaccauaugcgagacaacuccuguuaaugccaucgacgcagagaugcacgaucuaaacuguagcuauaauauuugcccauacugugccuccaggcucaccucagacgggcuggcucggcaugugauccagugccccaaacgcaaggaaaaagucgaggaaacagagcuuuaccugaacuuggaacgaauaccuugggugguaagaaagcuccugcaaguuagugagagcaccggaguggcauuaaaaaggucuuccuggcugauuguccuccuugugcuguuuacggugucauugagcccaguccagagugccccgaucggccagggcaagacuaucgaggcuuaucgggcccgugaaggguacacaucuauuugucuauucguucugggauccauccucuuuauugugagcugccugaugaaaggucuuguagacucggugggcaauucuuucuuucccgggcuguccauauguaagaccugcucaaucaguagcauuaacggauucgagaucgaaucccacaaguguuauugcucuuuguuuugcuguccuuacugccgccacuguagcacugauaaagagauccauaagcuccaccugucaauuugcaaaaagagaaaaacaggcaguaaugucauguuagcgguguguaagaggaugugcuuccgggcaaccauggaaguuuccaaccgagcccuguucauacgcagcaucauuaauacgaccuuugugcuauguauccucauucuggcugucugcgugguaucuacaucagccguugagauggagaaccuuccagcagguacuugggaaagagaggaagacuugaccaacuucugucaucaggagugccaagugacagaaacugagugucugugccccuaugaggcucucguccugaggaagccucuuuuucuggauaguaucgccaaagggaugaagaauuugcucaacagcaccucccuggaaacaucuuuaucgauagaggcgccauggggcgccaucaaugugcagagcaccuacaaacccacugucuccacggcaaacauugcucugucauggaguucuguggaacaccggggaaauaagauccuaguuagcggccgcuccgagucaauuaugaaacucgaggaaagaacagggaucagcugggaccugggaguggaggaugccucugaauccaaacuuuugaccguaagugucauggaccugagccagauguauucuccgguguucgaguaccucuccggugauaggcaaguugaagaguggccuaaggcuacuugcaccggcgacugucccgagcguugcggguguacaucaaguaccugccugcacaaagaauggccacauagccggaacuggcgauguaauccuacuuggugcuggggagugggcacagguuguacgugcuguggguuagaugucaaggaccuguuuaccgauuacauguucgugaaauggaagguagaguauauaaaaacugaagccauugugugcguugagcuuacaucgcaggaaagacaguguuccuugaucgaggcaggcaccagguuuaaccucggacccgucacaauuacucugucugagccacgcaauauccagcaaaagcuacccccugaaauaaucacccugcacccacggauugaggaaggcuucuuugaccucaugcaugugcagaaggugcugagcgccucaacggucugcaaacuucagaguugcacccacgggguuccgggagaccuccagguguaccauaucgguaaccuguuaaagggcgauaaagugaaugggcaccucauucacaagaucgagccccauuucaacacauccuggaugucuugggacggaugugaucuggacuauuacugcaauaugggcgauuggccuagcuguacuuauaccgguguaacacaacacaaccaugcuuccuuugucaaucuucugaacauagaaacugacuacaccaaaaacuuccacuuucacucaaagagagugacggcgcauggggauacaccacaguuggaccucaaagcaaggcccaccuauggcgccggagagauuacuguucugguggaggucgcugauauggaacuacacacaaagaagaucgagaucagcggccugaaauucgccaguuugaccugcacuggguguuacgcauguucuuccggaauuagcugcaaggugcgcauccauguugacgaaccugaugagcugaccgugcacguaaaaucggacgauccagacgucguggccgcuucaucuagucuuauggcccgaaaguuggaguucggcacagacuccacguuuaaagcauucagcgcgaugcccaagaccucucugugcuuuuacauuguggaacgggagcauuguaagagcugcaaugaagaggauacuaaaaagugugucaacacaaaauuagaacagccgcaguccauacucaucgagcacaaggguaccauuaucgggaaacaaaauucaacaugcacugcucgugccaguugcuggcuggagagcguuaagucuuucuuuuauggacuuaagaacaugcuguccggcauuuucgguaauguguuuaugggcaucuuccuauuucucgcaccuuucauacuguugauccuguuuuucauguuuggguggagaauuuuauucuguuucaaaugcuguaggcgcacccggggacucuuuaaguacagacaccugaaagacgaugaagagacgggcuauaggcgaaucauugaacgccuuaacaauaagaaagggaagaacaagcuguuggacggagagcggcucgccgauagaaggaucgcugaacuguucucaacaaaaacccauauaggc

SEQ ID NO: 10483 - RNA, 3495 nt, Artificial Sequence
  derived and/or modified CDS sequence (opt3) from CCHVF(CCHVF NIVA 118595)__JN572083.1__Gn-NSm-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugaaauccuucaaguugugugaaaauagcgcuacugguaaaucuugcgagauugauucgaucccuguaaagugucgacagggguacugcuuaaaaauuacccaggagggacguggccaugugaagcugucaagaggcagcgaagucgugcuagacgcaugugauaguuccugcgagguuaugaucccaaaggggacaggagacauacucguggauuguucugguggccagcaacacuuucugaaagacaaccuuaucgaucuggggugcccgaagauucccuugcucggaaaaauggccaucuauauuuguaggaugagcaaucauccuaagaccacuauggcguuccuguuuugguucuccuuuggcuacgucaucacaugcauacugugcaaagugauuuucuaucucuuaaucauuuuugguacccuggggaagcgguucaagcaguaccgcgaacuuaaaccacagacguguacuaucugcgagaccacacccguaaacgcuaucgacgccgagaugcacgauuugaauuguucauauaacauuugcccuuacugugcaaguagacugacuagcgacggacuagccaggcauguuacccagugcccaaagcggaaagaaaagguggaggaaacagagcucuaccugaaucuugaacgcauacccugggucgugcgaaaacuguugcaagugucugaguccaccggcaucgcucucaagagaucaagcuggcugauugucuuacugguucucuuuacggugaguaucacuccuguacagucugcaccaauaggccacgggaaaacaauugaggccuauagggcucgggaagaguacaccuccaucugucuuuucgugcugggaagcgucuuguuugugguuucgugccuaaugaagggucugguggacucugucggcaacaucuucuuuccggggcuguucauuuguaagacuugcuccaucggaucaauuaauggcuucgaaauagagagucacaaauguuauugcagccuguuuugcugucccuacugccgucauuguuccgccgaucgcgaaauccaccagcuucaucugucuauuugcaagaaaagaaagacagguagcaacgugauguuggcgguauguaaaaggaugugcuuccggaccacgauggagguuucaaauaaggcacucuuugugcgaaguaucaucaacaccacauucgucguguguauucugauauuagccgucugcgugguuuccacuagcgcuguggagauggaaucucugccugccgggaccugggagcgcgaagaggaccuaacaaauuuuugucaccaggaaugccaaguaacugagaccgagugucucugcccauaugaagcacugguccuuagaaggcccuuguuccuggauucaaucgugaagggcaugaaaaaccuccugaacaguacaagccuugagaccucccugucuauugaagcuccuuggggagccaucaauguucagucgacuuacaagccaacggugagcgcggccaacauugcauuguccuggucaagugucgagcaccggggcaauaaaauccucgugucugggcgcagcgaguccauaaugaagcuggaagagagaacaggaaucucaugggacuuagguguagaagaugcuagcgagucuaaacugcuaaccguguccguuauggaccucagucagauguauagccccgucuuugaauaccugucuggcgauaggcaaguggaggaguggccgaaggccacuugcaccggggacuguccugaacguugcggauguacauccucaaccugccuucauaaggaguggccccacagucggaacuggcgauguaauccaacuuggugcuggggcguggguacaggguguacgugcuguggcuuggaugucaaagaccuguucaccgauuacauguuuguuaaguggaaaguggaauauauuaagacugaggcuaucgugugcguagaacucacaagccaggagagacaguguucgcugauugaggccggaaccagguucaacuuaggcuccgucacaaucacucugucugaaccucgcaauauacagcaaaaacuucccccagagauuaucaccuugcauccccggauugaagagggguuuuucgaccucaugcacgugcagaagguucugagcgcaucaacggugugcaagcuacagaguugcacccauggagucccuggugaccuccagguguaccacaucggcaaccuccugaaaggggauagaguuaauggacaccuuauacauaagaucgaacaacacuugaacacauccuggaugucuugggacggcugugaucuggacuauuacugcaauaugggugauuggccaagcuguacuuauaccggggugacacagcauaaccacgccuccuuuguaaauuuacucaacauugagacugacuacaccaaaacguuccacuuccauucaaagagggucacagcucacggcgauaccccgcagcuggaccuuaaagcgcgccccacuuauggagcaggcgagaucacagugcugguggaagucgccgauauggaguugcauaccaagaaaauugaaaucagcgggcucaaguuugcuagucugucuugcacuggauguuacgccugcuccagcggcauaucguguaagguucggauucacguggacgagccugaugagcuaaccguacaugugaaaucagacgauccagacgucguggcagccucuaguucccugauggcucgaaagcucgaaagcgguacagacucuacguucaaagccuuuagcgcaaugcccaagaccucccugugcuucuacaucguugagcgugaauauuguaaagggugcucaaaggaggauacucagaagugugugaauacaaaacuugaacaaccucagaguaucuugauugagcacaagggaaccaucauuggcaaacagaacaacacaugcacugcgaaggcuagcugcuggcuggagucugucaaauccuuuuucuacgguuuaaagaauaugcucucaggcauauuugggaacguguuccugggaaucuuuaguuuccuugccccauuuguucugcuaauucucuucuuuauguucggcuggagaauccuguucuguuuuaagugcuguaggcgcacccggggguuguucaaauauagacaccugaaggacgaugaagagacgggauacaggaaaauuaucgaacgauuaaauaacaagaaaggcaagaauaagcuccuggacggugagcgccuugcagaucggaaaauagccgaacuguuuagcacaaagacccauaucggg

SEQ ID NO: 10484 - RNA, 3495 nt, Artificial Sequence
  derived and/or modified CDS sequence (opt3) from CCHVF(CCHVF NIV 112143)__JN572085.1__Gn-NSm-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugaaauccuucaaguugugugaaaauagcgcuacugguaaaucuugcgagauugauucgaucccuguaaagugucgacagggguacugcuuaaaaauuacccaggagggacguggccaugugaagcugucaagaggcagcgaagucgugcuagacgcaugugauaguuccugcgagguuaugaucccaaaggggacaggagacauacucguggauuguucugguggccagcaacacuuucugaaagacaaccuuaucgaucuggggugcccgaagauucccuugcucggaaaaauggccaucuauauuuguaggaugagcaaucauccuaagaccacuauggcguuccuguuuugguucuccuuuggcuacgucaucacaugcauacugugcaaagugauuuucuaucucuuaaucauuuuugguacccuggggaagcgguucaagcaguaccgcgaacuuaaaccacagacguguacuaucugcgagaccacacccguaaacgcuaucgacgccgagaugcacgauuugaauuguucauauaacauuugcccuuacugugcaaguagacugacuagcgacggacuagccaggcauguuacccagugcccaaagcggaaagaaaagguggaggaaacagagcucuaccugaaucuugaacgcauacccugggucgugcgaaaacuguugcaagugucugaguccaccggcaucgcucucaagagaucaagcuggcugauugucuuacugguucucuuuacggugaguaucacuccuguacagucugcaccaauaggccacgggaaaacaauugaggccuauagggcucgggaagaguacaccuccaucugucuuuucgugcugggaagcgucuuguuugugguuucgugccuaaugaagggucugguggacucugucggcaacaucuucuuuccgggacucuucauuuguaagacuugcuccaucgggucaauuaauggcuucgaaauagagagucacaaauguuauugcagccuguuuugcugucccuacugccgucauuguuccgccgaucgcgaaauccaccagcuucaucugucuauuugcaagaaaagaaagacagguagcaacgugauguuggcgguauguaaaaggaugugcuuccgggcaaccauggagguuucaaauaaggcccucuuugugcgaaguaucaucaacacgaccuucgucguguguauucugauauuagcuaucugcgucguguccacaagcgccguugagauggaaucucugccugcagggacuugggagcgcgaagaggaccuaaccaauuuuugucaccaggaaugccaagugacagagacugagugucucugcccauaugaagcucugguacuuagaaggcccuuguuccuggauucaauugucaagggcaugaaaaaccuccugaacaguaccagccuugagacaucccugucuaucgaagccccuuggggagcgauuaaugugcagucgaccuacaagccaacuguuagcgccgcaaacaucgcuuuguccuggucaaguguggagcaccggggcaauaaaauacucgucucugggcgcagcgaguccaucaugaagcuggaagagagaacgggaauuucaugggacuuagguguggaagaugccagcgagucuaaacugcuaacaguauccgugauggaccucagucagauguauagccccguuuuugaauaccugucuggcgauaggcaagucgaggaguggccgaaggcuaccugcacuggggacuguccugaacguugcggauguaccuccucaacaugccuucauaaggaguggccccacagucggaacuggcgauguaauccaaccuggugcuggggcguggguacuggguguacaugcuguggcuuggaugugaaagaccuguucacggauuacauguuugucaaguggaaaguugaauauaucaagaccgaggccauugugugcguggaacucacuagccaggagagacaguguucgcugaucgaggcaggaacaagguucaacuuaggcuccguaaccauaacacugucugaaccucgcaauauucagcaaaaacuucccccagagaucauuacuuugcauccccggaucgaagagggguuuuucgaccucaugcacguccagaaggugcugagcgccucaaccguuugcaagcuacagaguugcacgcauggagugccuggugaccugcaggucuaccacauaggcaaccuccugaaaggggauagagugaauggacaccuuauccauaagauugaacaacacuugaacaccuccuggaugucuugggacggcugugaucuggacuauuacugcaauaugggugauuggccaagcuguacauauacugggguuacccagcauaaccacgcuuccuuugugaauuuacucaacaucgagacagacuacacuaaaaccuuccacuuccauucaaagaggguaacggcgcacggcgauacaccgcagcuggaccuuaaagcacgccccaccuauggagccggcgagauuacuguccugguggaaguggcugauauggaguugcauacaaagaaaaucgaaauaagcgggcucaaguuugccagucugucuugcaccggauguuacgcaugcuccagcggcauuucguguaagguccgaauccacguugacgagccugaugagcuaacugugcauguaaaaucagacgauccagacguggucgccgcuucuaguucccugauggcccggaagcucgaguucgguaccgacagcacauuuaaagcauucucugcgaugcccaagacgagccugugcuuuuacaucguggaacgugaauauuguaaagggugcuccaaggaggauacccagaaguguguuaauacuaaacuugaacaaccucagucaauuuugaucgagcacaagggaacaauuauaggcaaacagaacaauaccugcacagcuaaggccaguugcuggcuggagagcgugaaaucuuucuuuuacgguuuaaagaacaugcucuccggcaucuucgggaacgucuuucugggaauuuucucauuucuugcaccauucgugcugcuaauccucuuuuucauguucggcuggaggauucuguuuuguuucaagugcuguagacgcacucggggguuguuuaaauauagacaccugaaggacgaugaagagaccggauacaggaaaaucauagaacgauuaaauaacaagaaaggcaagaauaagcuccuggacggugagcgccuugccgaucggaaaaucgcugaacuguucaguacgaagacacauauuggg

SEQ ID NO: 10485 - RNA, 3495 nt, Artificial Sequence
  derived and/or modified CDS sequence (opt3) from CCHVF(CCHVF SCT ex Afghanistan)__KC344856.1__Gn-NSm-Gc
agcgaggaauccggcgacgauugcaucucuagaacccagcugcucaggacagagacugccgaagugcacaacgacaauuacgggggacccggugauaagauuacgauauguaacggcucaaccaucgucgaccaacggcuugggagugagcugggaugcuauacaauuaaucgcguuaagagcuucaaguugugugaaaacuccgcuacuggcaaaucuugcaagaucgauucgaccccugugaaaugucgacaggguuuuugcuuaaagauuacacaggaggggcguggacauguaaagcugucaagaggcagcgaggugguccuagacgcaugugauaguuccugcgaaaucaugauaccaaaaggcaccggggacauccucguggauuguucuggaggucagcaacacuuccugaaggacaaucuuauugaucugggcugcccgaacauccccuugcucgggaaaauggccauuuacaucuguaggaugagcaaucauccuaagacuacaauggcguuucuguucugguuuuccuucggauauguuauaaccugcaucuuuugcaaagugauuuucuaccugcucauugucgugggcacguuagguaagaaguuuaaacaguaucgggagcugaagccacagacuuguaccaucugcgaaacaacucccaccaacgcuaucgacgccgagaugcacgaucuuaauuguucauacaacauuugcccuuauugugcaagucgcuugacaagcgacgggcuggccagacauguaacccagugcccaaaaaggaaggagaaaguugaagagacggaacuauaccucaaucuggagcggauacccuggaucgugcgcaaacuucugcaagucucugaauccacuggaguggcuuugaaacgaucaagcuggcucauugugcuguuaguccugcucacaguuagucuuucuccugugcaguccgcaccaaucggccacggcaagaccauagagacuuaccagacaagagagggguauauuagcguaugucuguucguguugggagguauccuauuugucgugucgugccugaucaagggccucguugacucuguggggaacuccuucuuuccgggacugucaauuuguaaaaccugcaguaucggcagcgucaaugguuucgaaauugagucccacaaguguuacugcucucuucugugcugucccuauugcaggcauuguagcacggaucgggaaauacaccaguugcaucucucaaucugcaaaaagcgucgcaccgggggcaacgugaugcuggccguauguaaaagaaugugcuucagggcuacaauggagguuaguaauaagguguuauuuauucggaacaucaucaacacuaccuucgucauuuguauacugauccuagccgugugcgucguguccacaagcgcgguugaaauggagucucucccugcaggaacuugggagcgagaagaggaccugaccaauuuuugucaccaagaaugccaggugacagagaccgaaugucuuugcccauacgaggccuugguacugcgcaagccccucuuccugaacucaauugucaaaggcaugaagaaucuucugaacaguacuaauuuggagacgagccucuccaucgaagcuccuuggggagccauuaacgugcagucuacauuuaaaccaaccguuucgacugcaaauaucgcucugagcugguccucaguggagcacagagggaacaagauauuagucagugguaggucugaaagcaucaugaaacuggaggagcggaccggcauuuccugggaucuagggguggaagacgccucagagagcaagucucucacaguauccgugauggaucugagucaaauguauagccccguuuucgaauaccuuucuggagaccgccaggucgaggaauggccgaaggcgaccugcacuggcgauuguccugagagaugcgguuguacauccucaacgugcuugcauaaagaguggccccacaguaggaauuggcguuguaacccaaccuggugcuggggcguggggacuggauguacaugcuguggccuggacgugaaggaucucuuuaccgacuauauguucgucaaauggaagguugaauacaucaaaacagaggccauugugugcguggaacugacuagccaggagcggcaguguucguuaaucgaagcagggacccgauuuaaucugggaccuguaacgauaacccuuuccgagcccagaaacauucaacagaaguugccacccgagaucauuacacuccauccuaggaucgaagaggguuucuuugaucugaugcacguccagaaggugcuaucugcuagcacuguuugcaaacugcagucaugcacccauggcgugccaggggaccuccaagucuaccacauaggaaaucugcuuaagggcgacaaauugaacggucacaugauccauaagauugaaccgcacuucaauacaaguuggauguccugggaugggugugaccuggauuauuacugcaacaugggcgacuggcccucuuguacuuauaccggagugacgcagcauaaccacgccgcuuuuguuaauuuacucaacaucgagacagauuacaccaaaaauuuccacuuccauagcaagcgcgugacugcccacggcgacacaccucagcuggaucuuaaagcacggccaaccuauggggccggagaaauuacuguacuggucgagguggcugacauggaguugcauaccaagaagaucgauauauccggccucaaauuugcgucacugacaugcgcagguuguuacgccugcagcagugggauuucuuguaaggugagaauccacgucgacgaacccgaugagcuaacgguucaugugaaauccgaagacccugauaucguagcugccagcaccucgcugauugcaaggaagcucgagcugggaacugacucaacauucaaagccuuuucugcuaugccaaagaccagucuuugcuucuauaucguggagcgcgaauacuguaaguccugcagcaaagaggacacacagaagugugucaacacuaaauuggaacacccccaaggcauucugauagagcacaaggguaccaucauuggcaaacagaaugauacgugcacagccaaggcagggugcugguuagaaucuguuaagagcuuuuucuacggacucaaaaacaugcuguccggcaucuuugggaauguguucauuggaaucuuucuuuuccuggcgccguuugugcuacucauacuguucuuuauguucggcuggcgauugcuguucuguuuuaagugcugucggcguaccagagguuuauucaaauauaggcaucucaaggaggacgaggaaucaggguaccgccggaucauugagagacugaacaauaaaaagggaaagaacaaacuucuggauggcgaaagguuggcugaccgacgcaucgccgagcucuuuaguacuaagacccacauuggu

SEQ ID NO: 10486 - RNA, 3495 nt, Artificial Sequence
  derived and/or modified CDS sequence (opt3) from CCHVF(CCHVF Zahedan 2007)__KC867273.1__Gn-NSm-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugcguagcuucaaauugugugaaaauuccgcuacugguaagucuugcgagauugauucgaucccuguaaaauguaagcagggguuuugcuuaaaaauuacccaggagggacgaggccaugugaagcugucaagaggcagcgaagucgugcuagacguuugugauaguuccugcgaggugaugaucccaaaggggacaggagacauacucgucgauuguucugguggccagcaacacuuccugaaagacaaccuuguggaucuggggugcccgaagauccccuugcucggaaaaauggcaauuuacaucuguaggaugagcaaucauccuaagaccacuauggccuuucuguucugguuuuccuucggcuauguaauuacaugcauccugugcaaagcgauauuuuuccucuuaauuaucuuugguacccuggggaagcgguucaagcaguaccgcgaacuuaaaccacagacguguacuauuugcgagaccacacccguuaacgcuaucgacgccgagaugcacgauuugaauuguucauauaacaucugcccuuacugugcaaguagacugacuagcgacggacuagccaggcaugugacccagugcccacggcgcaaggaaaaagucgaggaaacagagcucuaucugaaucuugaacgaauacccuggguggugagaaagcuguugcaagucucugaguccaccggcacgguucucaaaaggucaagcuggcugauuguguuacugguacucuuuacugugagucuuucuccuguccaguccgcuccaaucggccacgggaagacaauugagaccuaccgggugcgugaagaguacacuagcaucugucuguucguuuugggaucgauacuauuuauugugucuuuccugaugaaaggucucgucgacggcguggggaacaucuucuuuccgggacuguccguaugcaagacauguucaaucggcaguauuaaugguuucgaaaucgagagccaccgcugcuauuguuccuuauuuugcugccccuacuguagacauugcucugcagauggggaaauucaccagcugcauuugagcauauguaagaaaaggaagaccggcucaaacguuaugcucgccgugugcaaacggauguguuuccgagcuacgauggaggucaguaauaaggugcuguuuauccgcuccauuaucaacaccacauucgucgugugcaucuuaauucuggccguuugugugguaagcacuucugcggucgagauggaaucacuaccugcaggaaccugggagagagaagaggaccucacaaauuuuugccaccaggaaugucaagugacugagaccgagugccuguguccauaugaagcccuuguuuugaggcggccccuguuccucgauaguauagugaaagacaugaagaaccugcuuaacagcacaucccuggagaccucuuugucgaucgaagcuccuuggggcgccauuaauguccagagcacuuacaagccaacgguguccacagcaaacaucgcucucucauggaguucuguagagcaccgcgggaauaaagugcugguuagcggaagauccgagucaauuaugaaguuagaagagaggaccgguaucagcugggaucugggcgucgaagacgccucugaguccaaacuacucacugugagugugauggaucugagccagauguauucucccgucuuugaauaccuuuccggggaccgucaaguugaggaguggccgaaggcgaccugcacaggagauugcccugaacgguguggcugcaccucaaguacuuguuugcauaaagaguggccccacagccgaaacuggagaugcaauccaacaugguguugggguguggggacgggcugcaccuguugcggacuggacgugaaggaucucuucacugacuauauguuuguaaaguggaaagucgaauacauaaagacagaggccaucguguguguugaacugaccucgcaggagaggcagugcuccuuaauugaggcaggcacacgcuucaaccuggggucugugacuaucacccuuagcgaaccucggaauauucagcaaaaauugcccccagagaucauaacgcuccaucccaagauugaagagggauuuuucgaccugaugcacguccagaaagugcuaucagcuaguaccguuuguaagcugcaguccugcacacauggugugccuggcgaucuccagguauaccacaucgggaaccugcuuaagggagacagagucaauggccacuugauucauaaaaucgaacaacacuucaacacuucuuggaugagcugggaugguugcgaccuggauuauuacuguaauaugggggacuggccauccugcaccuauacaggcgugacucagcauaaccacgccucauuugugaauuuacucaacauagagaccgauuacacgaagacauuccacuuucauagcaaaagggucaccgcucacggagacacuccgcagcuggaucuuaaggcccgccccacauauggcgcaggggagaucaccguucugguggaaguagccgacauggaguugcauacuaaaaagauugaaaucaguggacucaaauucgcuggccugaccuguacagguugcuacgcguguucuuccgggauuagcugcaaggugcgaauccacgucgaugagccugacgagcuaacggugcauguuaagucggaugacccagacguggucgcagccucaucuagucugauggcucggaaacucgaauuuggaaccgauuccacuuucaaggccuuuagcgcaaugcccaaaacaucucuguguuucuauauaguggagcgugaauacugcaagagcuguuccaaagaggacacccagaagugcguuaauacaaaacuugaacaaccucagucaauuuugaucgagcacaagggcacuaucauugguaagcagaacaacaccuguacggccaaagcuaguugcuggcuggagagcgugaaguccuuuuucuacggccuuaaaaauaugcucgggggaaucuuuggcaacgucuucauugggauauuuacauuccugaccccauucauccuucugaucuuuuucuuuauguucggauggaggauucuauuuugcuucaaguguugcagacgcacucggggccucuuuaaguauagacaccugaaagaugacgaagagaccgguuacaggaagauuaucgaacgauugaauaacaaaaaggggaaaaaucgccuguuagauggagagcggcucgccgacagaaagauagcagaacuguucucuacaaagacucauaucggc

SEQ ID NO: 10487 - RNA, 3495 nt, Artificial Sequence
  derived and/or modified CDS sequence (opt3) from CCHVF(CCHVF SPU 44/08)__KJ682805.1__Gn-NSm-Gc
agcgaggaauccaacgacgauugccugucuagaacccagcuccuuaggacagagaaugccgaaauccacucagacaacuacggcgggcccggagauaagauuacuauauguaaugguaguacgaucguggaccaacggcugggcagcgaguuggggugcuauaccauuaaccgcgucaaauccuucaaguuaugugaaaauucugcuacaggaaaaucgugcgagaucgauucaacuccuguucgaugucgucagggcuuuugccugaagauuacccaggaggguagagggcaugugaaacuaagcaggggaagugaaguagugcucgacgcaugugauuccucuugcgagaucaugauaccaaagggcacaggcgacauccuggucgauuguagcgggggacagcaacacuuccuuaaggacaaccugguggauuuggguugcccgaauauuccccuccugggcaaaauggccaucuacauuugucggauguccaaccauccuaagaccacuauggcguuucuguucugguuuucauucggguauguuaucacaugcauacucugcaaagcuaucuuuuacuuacugauuguggucggaacccuuggcaagaaauucaagcaguaucgcgaauugaagccacagacguguacuauuugcgagaccaaucccgugaacgccaucgacgcagagaugcacgaucugaauuguaguuacaacaucugcccuuauugugccagcagacuaacaucugacggucucgcuaggcauguaaugcagugcccaaaacggaaggagaaaauugaagaaacugagcuguaccuuaaucuggaacgcauacccuggguugugcgaaaguugcuccaagucuccgagucaaccgggguggcacugaaaagaagcaguugguuagugauccugcucguccuucugacaguuucuuuguccccugugcagagcgccccaauuucgcacggagagaccguagaaguguaccagacgagggagggcuauacuucuaucugucuauuuguccugggcuccauacucuuccuggugucaugccuuaugcgggggcugguugacagugugagcaacuccuuuuucccgggauugucuauuuguaagacaugcagcaucgguucaaucaauggcuuugaaauugagagucacaaauguuacugcucccucuucugcugucccuauugccgucauuguagcgcugauaucgaaauucacaagcugcauuuaucuauaugcaagaaacgcaagaccgggucaaacgucaugcuggccguguguaaaagaaugugcuucagggcgacuguagagguuaguaacaaggcacuacucauccggaauauuaucaacacaaccuuuguggucuguauccugauucuugccgugugcgucgugagcacguccgcuguugagauggaaaauuugccugccggaaccugggagaaagaagaggaccugacaaacuucugucaccaggaaugccaagugacugagaccgagugucucugcccauacgaagcacugguacuucgaaagccccuguuuuuggauucuauagucaagggcaugaaaaaucuccugaacucgacaaguuuagagacuucccugucaaucgaagcuccuuggggugccauuaaugugcagaguaccuucaagccaacaguuucugcggccaacaucgcacuaagcugguccucaguggagcaccgcgggaauaaaauucucgucagcggcagaucugaguccaucaugaagcuggaagagaggaccggaauaaguugggaccuuggcguggaagaugcuagcgagucuaaauugcugacuguauccgugauggaccucucacagauguauagucccguuuuugaauaccugagcggggaucggcaagucgaggaguggccgaaggccacgugcacaggagacuguccugaacgcugcgguuguaccucguccacuugcuuacauaaggaguggccccacucuagaaacuggagguguaauccaaccuggugcuggggcguggggacaggauguaccugcuguggccuggaugugaaagaccuuuucacugauuauauguuugucaaguggaaaguugacuacaucaagacagaagcuauugugugcguggaguugacgagccaggaacgucaguguucacucaucgaggccgguacccgguucaaccuggggccuguaacuauuacacuaagugagccccgaaauauccagcaaaaacugccacccgaaauagucacccuccauccuagaauugaggaaggcuuuuucgaccugaugcacauccagaaggugcuuuccgcaucuacaguuugcaaguugcagagcugcacucauggagugccaggcgaucugcagauuuaccacaucgggaacuuacucaaaggagacaaggucaauggucaccugauacauaaaaucgagccgcacuuuaacaccuccuggaugucaugggauggcugugaccuugauuauuacugcaacaugggggacuggcccagcuguaguuauacgggagugacccaacauaaucacgccgcuuucguuaacaugcugaauauugaaacagauuacacuaagaacuuucacuuccauucuaaaagggugaccgcgcacggcgacacaccucaguuggaucucaaggcacgcccaacuuauggugccggggagaucaccguacuggucgagguggcugacauggaacuacauacgaaaaagauugagaucuccggccugaaguucgccagccucacaugcaccggauguuacgcaugcucgucaggcauaucuuguaaagugcggauucacgucgaugaacccgacgagcugacuguucaugugaagagugaggauccugacaucguagccgcuuccagcucucuuauggccagaaaauuggaauuugggacagacagcaccuucaaggcauuuuccgcgaugccaaaaacuucacugugcuucuauaucguggagagggaauacuguaagaguugcagcaaggaggauacccagaaaugugucaauacaaaguuagaacagccccaaucuauucucaucgagcacaaaggaacgauuauaggcaagcagaacgauaccugcacugcuaaagccuccugcuggcuggagucaaucaagagcuuuuucuacggucuuaagaauaugcugagcgggauuuuuggaaacguguucaucggcauuuuucuauuccucgcaccguuuaucaugcugauauuguucuuuauguucgguuggcgcauccuguucuguuuuaaaugcugucgacggacacguggcuuauucaaguauagacaccucaaagacgacgaagagauuggguacaggaagaucauugaacgccugaauaacaaaaagggaaagaauaaacuucuggauggcgagcgguuggccgacagaaagaucgcugaacucuuuuccaccaaaacacauauaggg

SEQ ID NO: 10488 - RNA, 3495 nt, Artificial Sequence
  derived and/or modified CDS sequence (opt3) from CCHVF(CCHVF SPU 383/87)__KJ682806.1__Gn-NSm-Gc
agcgaggaauccaacgacgauugccugucuagaacccagcuccuuaggacagagaaugccgaaauccacucagacaacuacggcgggcccggagauaagauuacuauauguaaugguaguacgaucguggaccaacggcugggcagcgaguuggggugcuauaccauuaaccgcgucaaauccuucaaguuaugugaaaauucugcuacaggaaaaucgugcgagaucgauucaacuccuguucgaugucgucagggcuuuugccugaagauuacccaggaggguagagggcaugugaaacuaagcaggggaagugaaguagugcucgacgcaugugauuccucuugcgagaucaugauaccaaagggcacaggcgacauccuggucgauuguagcgggggacagcaacacuuccuuaaggacaaccugguggauuuggguugcccgaauauuccccuccugggcaaaauggccaucuacauuugucggauguccaaccauccuaagaccacuauggcguuucuguucugguuuucauucggguauguuaucacaugcauacucugcaaagugaucuuuuacuuacuggucgugguaggaacccuuggcaagaaauucaagcaguaucgcgaauugaagccacagacguguacuauuugcgagaccaaucccguuaacgcuauugacgccgagaugcacgaucugaauuguaguuacaacaucugcccuuauugugcaagcagacuaacaucugacggucucgccaggcaugugauccagugcccaaaacggaaggagaaaauugaagaaacugagcuguaccuuaaucuggaacgcauacccugggucgugcgaaaguugcuccaaguguccgagucaaccggggucgcucugaaaagaagcaguugguuaguuauccugcucgugcuucugacaguaucuuuguccccugugcagagcgcaccaauuucgcacggagagaccgucgaaguguaccagacgagggagggcuauacuucuaucugucuauuuguucugggcuccauacucuuccuggugucaugccuuaugaaggggcuggucgacagugugggaaacagcuuuuucccggguuuguccauuuguaaaacaugcucuaucggcagcaucaauggguuugaaauugagucacacaaguguuacugcagucucuucugcugucccuauugccggcauuguuccgccgauaucgaaauucaccgucugcauuuaagcauaugcaagaaacgcaagaccggaucuaacguaaugcuggcuguuuguaaaagaaugugcuucagggccacuguggaggucucaaacaaggcgcuacucauccggaauauuaucaacacaaccuuuguggucuguauccugauucuugcagugugcguugugaguacgagcgccguagagauggaaaauuugccugcuggcaccugggagaaagaagaggaccugacaaacuucugucaccaggaaugccaagucacugagaccgagugucucugcccauacgaagcccuggugcuucgaaagccccuguuuuuggauuccauaguuaaggguaugaaaaaucuccugaacucuacaucguuagagacuagccuguccaucgaagcaccuuggggcgcuauuaaugugcagucaaccuucaagccaacagucagugccgcgaacaucgcccuaucuuggagcuccguggagcaccgcgggaauaaaauucucguaucaggaagaagcgagucuaucaugaagcuggaagagaggaccggcauauccugggaccuugggguggaagaugcaagugagagcaaauugcugacuguuucugucauggaccucucccagauguauucacccguguuugaauaccugaguggagaucggcaaguggaggaguggccgaaggcuacgugcacaggugacuguccugaacgcugcggcuguaccagcucgacuugcuuacauaaggaguggccccacuccagaaacuggagguguaauccaaccuggugcuggggagucgggacaggcuguaccugcuguggucuggauguuaaagaccuuuucacugauuauauguuugugaaguggaaaguggacuacaucaagacagaagccauuguaugcgucgaguugacgucucaggaacgucaguguagccucaucgaggcugggacccgguucaaccugggcccugugacuauuacacuaucagagccccgaaauauccagcaaaaacugccacccgaaauaguuacccuccauccuagaauugaggaaggauuuuucgaccugaugcacauccagaaggugcuuagugccuccacagucugcaaguugcagucuugcacucauggcgugccaggggaucugcagauuuaccacaucggaaacuuacucaaaggugacaagguuaauggccaccugauacauaaaaucgagccgcacuuuaacaccagcuggauguccugggaugggugugaccuugauuauuacugcaacaugggagacuggcccucauguagcuauacgggcgugacccaacauaaucacgcagccuucguaaacaugcugaauauugaaacagauuacacuaagaacuuucacuuccauaguaaaagggucaccgcucacggugacacaccucaguuggaucucaaggcgcgcccaacuuauggggcaggcgagaucaccgugcugguggaggucgccgacauggaacuacauacgaaaaagauugagaucucuggacugaaguucgcuucccucacaugcaccggcuguuacgccugcagcucggggauaucauguaaaguucggauucacguggaugaacccgacgagcugacuguacaugugaagucugaggauccugacaucgucgcagccaguuccagccuuauggcuagaaaauuggaauuuggaacagacucuaccuucaaggccuuuagcgcaaugccaaaaacuucccugugcuucuauaucguggagagggaauacuguaagucaugcaguaaggaggauacccagaaauguguuaauacaaaguuagaacagccccaaagcauucucaucgagcacaaaggcacgauuuuugguaagcagaacgauaccugcacugcgaaggcuucuugcuggcuggaguccgugaaaucauucuuuuacgggcuuaagaauaugcugaguggaauauucggcaacgucuuuaucgguguguuccuauuucucgccccguucauuaugcugaucuuguuuuucauguucggcuggcgcauucuguuuuguuucaaaugcugucgacggacacguggguuauuuaaguauagacaccucaaagacgacgaagagaucggauacaggaagauaaucgaacgccugaauaacaaaaagggcaagaauaaacuucuggauggggagcgguuggcagacagaaagauugccgaacucuucagcaccaaaacacauaucgga

SEQ ID NO: 10489 - RNA, 3495 nt, Artificial Sequence
  derived and/or modified CDS sequence (opt3) from CCHVF(CCHVF SPU 130/89)__KJ682807.1__Gn-NSm-Gc
agcgaggaacccaacuacgacugccuguccagaacccagcuccuuaggacagagaaugccgaaauccacucugauaacuauggcgggccuggagacaagauuacuauauguaaugguucaacgaucguggaucaacggcugggcagugaguuggggugcuacaccauuaaccgcgucaaaaguuucaaguuaugugaaaauuccgcuacaggaaaaucuugcgagaucgacucgacuccaguucgaugucgucagggcuuuugccugaagauuacccaggaggguagagggcaugugaaacuaucaaggggaagcgaaguagugcucgaugcaugugacaguuccugcgagaucaugauaccgaagggcacaggcgauauccuggucgacuguucugggggacagcaacacuuccuuaaggauaaccugguggacuuggguugccccaauauuccucuccugggcaaaauggccaucuauauuugucggaugagcaaccauccaaagaccacuauggcguuucuguucugguuuuccuucggguacguuaucacaugcauacucugcaaagugauuuucuauuuacugaucgucgugggaacccuuggcaagaaauucaagcaguaccgcgaauugaagccccagacguguacuauuugcgagaccaauccuguaaacgcuaucgaugccgagaugcacgaccugaauuguucauauaacaucugcccauacugugcaaguagacuaacaagcgauggucucgccaggcauguuaugcagugccccaaacggaaggagaaaauugaagaaacugagcuguaccuuaaucuggaacgcauaccuugggugguccgaaaguugcuccaagugucugaguccaccgggguggcucugaaaagaucaagcugguuagucguucugcucgugcuucugacaguaaguuugucuccagugcaguccgcaccgaucagccacggagagaccgucgaaguguaucagacgagggagggcuacacuucgauuugucuauuuguucugggcucuauccucuuccugguguccugccuuaugaaggggcuggucgacucagugggaaacagcuuuuuccccgguuugagcauauguaaaacaugcuccauuggcucuaucaauggguuugaaaucgagagccacaaguguuauugcucacucuucugcuguccuuacugccggcauuguagugccgacauugaaauccacaagcugcauuuauccauuugcaaaaagcguaaaaccggaagcaacguaaugcuggcuguuuguaagcgcaugugcuucagagccacuguggaggucucuaacaaagcgcuacucauaaggaauaucauuaacacaaccuuuguggucuguauccugauccuugcagugugcguugugucaacgagugccguagagauggaaaauuugccagcuggcaccugggagaaggaagaggaucugacaaacuucugucaccaggaaugccaagucacugagaccgagugucucugccccuaugaagcccuggugcuucggaagccucugagcuuggacuccauuguuaaagguaugaagaaucuccugaacucuacaucguuagagacuagccuguccauagaagcaccauggggcgcuaucaaugugcagucaaccuuuaaacccacagucagugccgcgaacauugcccuaucuuggagcuccguggagcaccgagggaauaagauccucguaucaggacgcagcgagucuauuaugaaacuggaagagagaaccggcaucuccugggaucuugggguggaagacgcaagugagagcaaguugcugacuguuucugucauggaucucucccagauguacucaccgguguucgaauaucugaguggagacaggcaaguggaggaguggccuaaggcuacgugcacaggugauugucccgaacggugcggcuguaccagcucgacuugcuuacauaaagaguggccacacucccgcaacuggagauguaauccuaccuggugcuggggagucgggacaggcuguaccugcuguggucuggacguuaaggaucuuuuuacugacuacauguucgugaaauggaagguggauuacauaaaaacagaagccaucguaugcgucgaguugacgucucaggaaaggcaguguagccucauugaggcugggacccguuuuaaccugggccccgugacuaucacacuaucagagccacggaauauucagcaaaagcugcccccugaaaucguuacccuccauccacgaauagaggaaggauucuuugaccugaugcacauucagaaggugcuuagugccuccacagucugcaaauugcagucuugcacucauggcgugccgggggaccugcagaucuaucacauuggaaacuuacucaagggugauaaaguuaauggccaccugauccauaagauagagccccacuucaacaccagcuggauguccugggacgggugugaucuugacuacuauugcaacaugggagauuggccuucauguagcuacacgggcgugacccaacauaaucacgcagccuuuguaaacaugcugaauaucgaaacagacuauacuaaaaacuuccacuuucauaguaagagagucaccgcucacggugauacaccacaguuggaccucaaagcgaggcccacuuacggggcaggcgagauuaccgugcugguggaggucgccgauauggaacuacauacgaagaagguugagaucucuggacugaaauucgcuucccucacaugcaccggcuguuaugccugcagcucggggauuucauguaaggugcgcauccacguagacgaaccugaugagcugacugugcaugucaaaucugaggacccagauauaguggcagccaguuccagccuuauggcucggaaguuggaauuuggaacagacucuaccuuuaaagccuucagcgcaaugcccaagacuucccugugcuuuuacauuguugagagagaacacuguaagucaugcaguaaagaggacacccagaggugugugaauacaaaguuagaacagccgcaaagcauccucaucgagcacaaaggcacgauuaucgguaagcagaacgauaccugcacugcgaaggcuucuugcuggcuggaguccauuaaaucauucuuuuacgggcuuaagaauaugcugaguggaauauucggcaacgucuuuaucgguguguuccuauuucucgccccuuucauuauccugauuuuguuuuucauguuuggcuggcgcauccuguucuguuucaaaugcugucgacggacacguggguuacucaaguauagacaucugaaagacgaugaagagauaggauacaggaagaucauugaacgccuuaauaacaaaaagggcaagaauaaacuguuggacggggagcggcucgcagauagaaagaucgccgaacuguuuagcaccaaaacacacauugga

SEQ ID NO: 10490 - RNA, 3495 nt, Artificial Sequence
  derived and/or modified CDS sequence (opt3) from CCHVF(CCHVF SPU 497/88)__KJ682808.1__Gn-NSm-Gc
agcgaggaauccaacgacgauugccugucuagaacccagcuccuuaggacagagaaugccgaaauccacucagacaacuacggcgggcccggagauaagauuacuauauguaaugguaguacgaucguggaccaacggcugggcagcgaguuggggugcuauaccauuaaccgcgucaaauccuucaaguuaugugaaaauucugcuacaggaaaaucgugcgagaucgauucaacuccuguucgaugucgucagggcuuuugccugaagauuacccaggaggguaaagggcaugugaagcuaagcagaggaagugaaguagugcucgacgcaugugauuccucuugcgagaucaugauaccaaagggcacaggcgacauccuggucgauuguagcgggggacagcaacacuuccuuaaagacaaccugguggauuuggguugcccgaauauuccccuccugggcaagauggccaucuacauuuguaggauguccaaccauccuaaaaccacuaugguuuuucuguucugguuuucauucggguaugugaucacaugcauacucugcaaggucaucuuuuacuuacugauugugguaggaacccuuggcaaaaaguucaagcaguaucgggaauugaaaccacagacguguacuauuugcgagaccaaucccguuaacgcgaucgacgcugagaugcacgaucugaauuguaguuacaacaucugcccuuauugugccagccgccuaacaucugacggucucgcaagacaugugaugcagugcccaaagaggaaagaaaagauugaggaaacugagcuguaccuuaaucuggaacggauacccugggucgugcgcaaauugcuccaaguguccgagucaaccggggucgcccugaagcgaagcaguugguuaguuauccugcucgugcuucugacaguaucuuuguccccugugcagagcgcuccaauuucgcacggagagaccgucgaaguguaccagacgagagagggcuauacuucuaucugucuauuuguucugggcgggauacucuuccugguguccugccuuaugaaaggacuggucgacucaguggguaacagcuuuuucccgggcuugaguauuuguaagacaugcuccaucgggucuaucaauggauuugaaauugagagccacaaguguuacugcucacucuucugcugucccuauugcaggcauuguagugcagauaucgaaauucacaaacugcauuuauccauaugcaagaaacggaagaccuggagcaacguaaugcuggccguuuguaaacguaugugcuuccgcgcuacuguggaggucucuaacaaggcccuacucaucagaaauauuaucaacacaaccuuuguggucuguauccugauucuugcgauaugcgugguuucaacgagugcaguggagauggaaaauuugccugccggcaccugggagaaggaagaggaccugacaaacuucugucaccaggaaugccaaguaacugagaccgagugucucugcccauacgaagcucugguccuuaggaaaccccuguuuuuggauagcaucgugaaggguaugcggaaucuccugaacuccacaucuuuagagacuucgcugagcauugaagccccuuggggcgcaaucaauguucaguccaccuucaaaccaacagugucagcugccaacauugcgcuaaguuggucuagcgucgagcaccgagggaauaagauccucguguccggacgcucagagagcauaaugaaacuggaagagagaaccggcaucucuugggaccuugggguagaagaugccuccgagaguaaguugcugacugugagcguuauggaccucucucagauguauucccccgucuuugaauaccugucaggagauaggcaaguggaggaguggccgaaggcaacgugcacaggugacuguccugaacggugcggcuguaccaguagcacuugcuuacauaaagaguggccccacucgcgcaacuggagauguaauccaaccuggugcuggggaguggggacaggcuguaccugcuguggucuggaugucaaggaccuuuucacugauuauauguuuguuaaauggaagguggacuacauuaaaacagaagcuaucgugugcguagaguugacgucccaggaaaggcaguguucucucauugaggccgggacccguuucaaccugggcccugucacuaucacacuaagcgagccccggaauauacagcaaaagcugccacccgaaauugugacccuccauccucgaaucgaggaaggauuuuucgaccugaugcacauucagaagguucuuucagcuaguacagugugcaaauugcaguccugcacucauggcgucccaggggaucugcagaucuaccacauaggaaacuuacucaagggugacaaagugaauggccaccugauccauaagauugagccgcacuuuaacaccucuuggaugagcugggaugggugugaccuugauuauuacugcaacaugggagacuggcccuccuguucauauacgggcguuacccaacauaaucacgccgcauucgugaacaugcugaauaucgaaacagauuacacuaaaaacuuucacuuccauagcaagagaguaaccgcccacggugacacaccucaguuggaucucaaagcuaggccaacuuauggggcgggcgagauuaccguccugguggagguggcagacauggaacuacauacgaagaagaucgagauaaguggacugaaauucgccucucucacaugcaccggcuguuacgcuugcuccagcgggauuucguguaagguccgcauccacguugaugaacccgacgagcugacugugcauguaaaaucagaggauccugacaucguggccgcaucuaguucccuuauggcccggaaguuggaauuuggaacagacagcaccuucaaggcuuuuucugccaugccaaaaacuagccugugcuucuauauugucgagagagaauacuguaaguccugcucaaaagaggauacccagaagugugugaauacaaaauuagaacagccccaaaguauccucauugagcacaagggcacgauaaucgguaaacagaacgauaccugcacugcaagggcgagcugcuggcuggagucuauuaaguccuuuuucuacgggcuuaagaauaugcugucaggaaucuuuggcaacguuuucauugguaucuuucuauucuuugcuccguucauaaugcucauccuguuuuucauguucggcuggcgcauuuuguuuuguuucaaaugcugucgacggacacgugggcuguuuaaguauagacacuuaaaagacgacgaagaggugggauacaggaagaucauugaacgccucaauaacaaaaagggcaagaauaaacugcuugauggggagcggcuggccgacagaaagaucgcagaauuguucaguaccaaaacacauauagga

SEQ ID NO: 10491 - RNA, 3495 nt, Artificial Sequence
  derived and/or modified CDS sequence (opt3) from CCHVF(CCHVF SPU 18/88)__KJ682810.1__Gn-NSm-Gc
agcgaggaauccaacgacgauugccugucuagaacccagcuccuuaggacagagaaugccgaaauccacucagacaacuacggcgggcccggagauaagauuacuauauguaaugguaguacgaucguggaccaacggcugggcagcgaguuggggugcuauaccauuaaccgcgucaaauccuucaaguuaugugaaaauucugcuacaggaaaaucgugcgagaucgauucaacuccuguucgaugucgucagggcuuuugccugaagauuacccaggaggguagagggcaugugaaacuaagcaggggaagugaaguagugcucgacgcaugugauuccucuugcgagaucaugauaccaaagggcacaggcgacauccuggucgauuguagcgggggacagcaacacuuccuuaaggacaaccugguggauuuggguugcccgaauauuccccuccugggcaaaauggccaucuacauuugucggauguccaaccauccuaagaccacuaugggguuucuguucugguuuucauucggauauguuaucacaugcauacucugcaaagugauuuucuacuuacugaucgucgugggcacccuugguaagaaauucaagcaguaucgcgaauugaagccacagacguguacuauuugcgagaccaaucccguaaacgcgaucgacgcugagaugcacgaucugaauuguaguuacaacaucugcccuuauugugccagcagacuaacaucugacgggcucgcaaggcauguuaugcagugcccaaaacggaaggaaaagauugaggaaacugagcuguaccuuaaucuggaacgcauacccugggugguccgaaaguugcuccaaguguccgagucaaccggaguggcccugaaaagaagcaguugguuagucauccugcucguucuucugacagugucuuuguccccuguacagagcgcuccaauuucgcacggcgagaccguggaagucuaccagacgagggagggcuauacuucuaucugucuauuugugcugggguccauacucuuccugguuucaugccuuaugaagggacugguggacagugucgguaacagcuuuuccccgggcuugucuauuuguaaaacaugcagcaucgggucaaucaauggauucgaaauugagagucacaaguguuacugcucccucuuuugcugucccuauugccggcauuguagcgcagauaucgaaauucacaagcugcauuuaucuauaugcaaaaagcguaaaaccggcucaaacgugaugcuggccguauguaagcgcaugugcuucagagcuacuguugaggugaguaacaaagcccuacucaucaggaauauuaucaacacaaccuucgucguguguauccugauucuugcggucugcgugguuagcacguccgcaguggagauggaaaauuugccugccgguaccugggagaaggaagaggaccugacaaacuuuugucaccaggaaugccaaguaacugagaccgagugucucugcccauacgaagcucugguccuucggaagccccuguucuuggauucuauagugaaagggaagaaaaaucuccugaacucgaccagcuuagagacuucccugucaaucgaagccccuuggggcgcaauuaauguucagaguaccuuuaagccaacagugucugcugccaacaucgcgcuaagcugguccucagucgagcaccgaggaaauaaaauucucgugagcggccgcucugaguccaucaugaagcuggaagagagaaccgggauaaguugggaccuuggaguagaagaugccagcgagucuaaguugcugacuguguccguuauggaccucucacagauguauagucccgucuucgaauaccugagcggugauaggcaaguggaggaguggccgaaagcaacgugcacaggcgacuguccugaacggugcggguguaccucguccacuugcuuacauaaggaguggccccacucucgcaacuggagauguaauccaaccuggugcuggggagugggcacagguuguaccugcugugggcuggaugucaaagaccuuuuuacugauuauauguucguuaaguggaaaguggacuacaucaagacagaagcuauugugugcguagaguugacgagccaggaaaggcaguguucacucaucgaggccggcacccguuuuaaccugggaccugucacuauuacacuaagugagccccggaauauccagcaaaagcugccacccgaaauagugacccuccauccucgaauugaggaaggcuucuuugaccugaugcacauccagaaaguucuuuccgcuucuacagugugcaaguugcagagcugcacucauggggucccaggagaucugcagauuuaccacaucgguaacuuacucaaaggcgacaaggugaaugggcaccugauacauaaaaucgagccgcacuucaacaccuccuggaugucaugggauggaugugaccuugauuauuacugcaacaugggcgacuggcccagcuguaguuauacggguguuacccaacauaaucacgccgcauuugugaacaugcugaauauugaaacagauuacacuaagaacuuccacuuucauucuaaaagaguaaccgcccacggggacacaccucaguuggaucucaaggcuaggccaacuuauggcgcgggagagaucaccguccugguggagguggcagacauggaacuacauacgaagaaaauugagaucuccggccugaaguucgccagccucacaugcaccggguguuacgcuugcucgucaggaauaucuuguaaaguccgcauucacguugaugaacccgacgagcugacugugcauguaaagagugaggauccugacaucguggccgcauccagcucucuuauggcccggaaauuggaauuuggcacagacagcaccuuuaaggcuuucuccgccaugccaaagacuucacugugcuuuuauaucgucgagagagaauacuguaaaaguugcagcaaggaggauacccagaaaugugugaauacaaaguuagaacagccccaaucuauucucaucgagcacaaagguacgauuauagggaagcagaacgacacaugcacuggaaaggcaggcugcuggcuggaguccaucaaaucauucuuuuacggucuuaagaauaugcugaguggcauuuucgggaacguuuuuaucggaauuuuccuauuucucgcgccguucaucaugcugauauuguuuuucauguuuggcuggaggauccuguucuguuucaaaugcugucgccgaacacggggguuauuuaaguaucgucaccucaaagaugacgaagagauuggauacagaaagaucauugaaaggcugaagaauaaaaagggcaaaaacaaacuucuggauggugagcgcuuggcugaccggaaaaucgccgaacucuucagcaccaagacacauauaggg

SEQ ID NO: 10492 - RNA, 3495 nt, Artificial Sequence
  derived and/or modified CDS sequence (opt3) from CCHVF(CCHVF SPU 556/87)__KJ682811.1__Gn-NSm-Gc
agcgaggaauccgacggcgauugcaucucuagaacccagcugcucaggacagagacugccgaaauucacucagacaacuacgggggacccggugauaagauaacgaucuguaauggcaguaccauuguggaccaacggcuugggagcgagcugggaugcuauacaaucaaccgcgucaaauccuucaaguugugugaaaauucugcuacuggcaaaucgugcgagauugauucaaccccuguuaagugucgacaggguuuuugcuuaaaaaucacacaggaggggcguggacaugugaagcugagcagaggcagugaaauaguacuagacgcaugugauuccucuugcgagaucaugauuccaaagggcaccggggacauccucguggauuguagcggaggucagcaacacuuccugaaagacaaccuuauugaucugggcugcccgaauauccccuugcucgggaggauggccauauacauuugucggauguccaaccauccuaagacuacaauggcguuucuguucugguuuucauucggauaugucaucacaugcauucugugcaaagugaucuuuuaccucuuaaucguugcuggcacgguggguaagaaauucaagcaguaucgcgaacugagaccacagacuuguaccauuugcgagacaacucccgucaaugccauagacgcagagaugcacgaucuuaacuguaguuacaauaucugcccuuauugugccagcagguugaccucugacgggcuggcucggcaugugaugcagugcccaaagcgcaaagaaaagauugaggaaacagagcuauaccucaaccuggaacgaauccccuggguaguuagaaaacuucugcaaguguccgagucaaccggagucgcauugaagaggagcaguuggcucacggugcuguuagugcugcucauagucucucuuuccccuguucagagcgccccaauuggccacggcaaaacuaucgagacauaccaggcucgggaaggguauaccucguuuugucuguucaucuugggaucuauucuauuuaucguguccugccugguaaagggucucauugacucagugggcaauaguuucuuuccggggcugagcauauguaaaacuugcuccaucggaucugucaacggcuucgagauugaaagccacaaguguuacugcucacuuuucugcugucccuauugccgucauuguagugccgaucgcgagauccacaagcugcauuuguccaucugcaaaaagagaaaaacagguagcaaugugaugucugcgguuuguaagaggaugugcuuucgggcaaccauugaagugucaaaccgagcccuccugauacgcaguaucauuaauacgaccuucgcugucuguaucuuaacacuggccgugugcguaguuagcacuuccgcaguggagauggagucucuaccugcugggaccugggaaagagaggaagaccucacaaacuuuugucaccaggagugccaagucacugaaaccgagugucugugcccauacgaggcccuuguguugaggaaaccccuguuccucgauucgauugucaagggcaagaaaaaccugcuuaauagcacaucccuggaaaccucauugaguaucgaggcgccuuggggagccauaaacgugcagucuacuuuuaagccaacgguuagcgcagcuaauaucgcccucuccuggucaagcguggaacaccggggcaacaaaauucugguaucugggcgcuccgagaguaucaugaaguuagaggaaagaacaggaauuagcugggaccugggugucgaggaugcuucugaauccaaacuacucaccgugucaguuauggaccugagucagauguauagccccguguucgaguaccuuucgggcgauaggcaagucgaagaguggccgaaggccacuugcaccggggacuguccugagcguugcggauguacauccucuaccugcuugcauaaggaauggccccacagccggaauuggcgauguaacccaacuuggugcuggggcguggguacaggguguacgugcuguggccuggauguaaaagaccucuuuaccgauuauauguucgugaaguggaaaguugaguacaucaagacugaagcaauagucugcguggagcugacaucacaggaaagacaguguaguuuaauugaggccggaaccagguuuaaucugggcccugugacaaucacucuuuccgagccccgcaacauucagcaaaaauugccacccgaaaucauaacccuccauccucggaucgaggaaggguucuuugaccugaugcacguccagaagguucuaucugcuagcacggugugcaagcugcaguccugcacccauggagugccaggugaccuccagguauaccacauuggcaaucugcuuaaaggggauaaggucaacggacacuugauccauaaaauugagccgcacuucaauacaucauggaugagcugggacggcugugaucuggacuauuacugcaacaugggugauuggcccaguuguacuuauaccggggugacacaacauaaucacgcggcauuuguuaacuuacucaauaucgaaacugacuacaccaagaacuuccacuuccauucuaaaagagugacggcccacggcgauacaccucagcuggaccuuaaggcuaggccaaccuauggagccggcgaggucacugugcugguugagguggcagauauggaauugcauaccaaaaagauagagauuuccgggcucaaguuugccagccugucgugcaccggauguuacgcuugcucaucuggcaucaguuguaaaguacgcauccacgucgacgaacccgaugagcuaacugugcaugugaaguccgaggacccugauauugucgccgcagguagcucucugauggcgcgaaaacucgaguucggggcugacagcaccuuuaaggccuucuccgcaaugccaaaaacaucacugugcuuuuauaucguugaacgggaauacuguaagaguugcagccgugaggacacgcagaagugugugaacaccaaacuugaaagaccccagucuauuuugauagagcacaagggaacuaucauuggcaaacaaaaugauacaugcaccgccaaggcuuccugcuggcuggagucaguaaaaaguuucuuuuacgguuuaaagagcaugcucuccggcaucuucgggaacguguuuauuggaaucuuccuguuuauagccccguucguccuucugauccuauuuuucauguucggcuggaggauucucuuuuguuucaagugcugucgccggacaagagggcuguuuaaauauaggcacuugaaggacgaugaagagacuggauaccgaaaaaucauugaacgccugaauaacaagaaaggcaagaauaaguuacucgacggugagcggcuggcagauagaaaaaucgcugaacuuuucucuaccaagucgcauauaggg

SEQ ID NO: 10493 - RNA, 3495 nt, Artificial Sequence
  derived and/or modified CDS sequence (opt3) from CCHVF(CCHVF SPU 431/85)__KJ682812.1__Gn-NSm-Gc
agcgaggaauccgacggcgauugcaucucuagaacccagcugcucaggacagagacuacggaaauucacucagacaacuacgggggacccggugauaagauaaccaucuguaauggcaguacaauuguggaccaacggcuugggagcgagcugggaugcuauacuaucaaccgcgucaaauccuucaaguugugugaaaauucugccaccggcaaaucgugcgagauugauucaacaccuguuaagugucgacaggguuuuugcuuaaaaaucacccaggaggggcguggacaugugaagcugagcagaggcagugaaauaguacuagacgcuugugauuccaacugcgagaucaugauuccaaagggcacuggggacauccucguggauuguucuggaggucagcaacacuuccugaaagacaaucuuauugaucugggcugcccgaacauccccuugcucgggaagauggcaauauacauuuguaggaugagcaaucauccuaaaacaaccauggccuuucuguucugguuuuccuucggauaugucaucacgugcauucugugcaaggugaucuuuuaccucuuaaucguugcgggcacuguggguaaaaaguucaagcaguaucgggaacugcgcccacagaccuguacaauuugcgagacuauacccgucaacgcuaucgacgccgagaugcacgaucuuaauuguucauacaacauuugcccuuauugugcaaguagauugaccagcgacgggcuggccaggcaugugaugcagugcccaaaacggaaggaaaaaguagaggaaacagagcuauaccucaaucuggaacgcauccccuggguugugcgaaaacuucugcaagucucugaguccaccggaguggcuuugaaaagaucaagcuggcucacggugcuguuaguccugcucauaguuagucuuucuccugugcaguccgcaccaauuggccacggcaagacuaucgagacauaccaggccagggaaggguauaccagcuuuugucuguucaucuugggaucgauucuauuuguagugucuugccuggucaaaggucucaucgacuccgugggcaacucauucuuuccggggcugaguauuuguaagacuugcagcauaggauccaucaauggcuucgagauugaaucucacaaguguuacugcagccuuuucugcugucccuauugccggcauuguccugcugaucgugagauccacaaacugcauuugucaaucugcaagaaacgcaagacagguaguaacguuaugcucgccguguguaaaagaaugugcuuuagggcgaccauugaagucuccaaucgggcacuguuaauacgaaacaucauuaacacgaccuucgugguauguauccugacacuagccguuugcguggucagcacuucugcuguggagauggagucacucccagccgggaccugggaaaaggaggaagaccugacaaauuuuugucaccaggagugccaagucacugaaaccgagugucuuugccccuacgaggcauuggugcugcgcaagccucucuuccuggauaguauuguuaaaggcagaaagaaccuucugaauagcacauccuuggaaaccucucucucgaucgaggcuccauggggagccauaaacgugcagagcacuuuuaaacccacgguauccgcggccaauaucgcacugucauggaguucugucgaacacaggggcaacaagauuuuagugagcgggcgguccgagucaaucaugaaacuggaggaacgcacaggaauuagcugggaccuagguguugaggaugcuucugaauccaagcuccugaccgugagugucauggaccuuagccagauguauucuccgguguucgaguacuuguccggcgauagacaaguagaagaguggccuaaggccacuugcaccggggacugucccgagaggugcggauguacaucaaguaccugccugcauaaagaauggccacacagccguaauuggcgguguaacccuacuuggugcuggggcguggguacaggguguacgugcuguggccucgauguuaaggaccuguuuaccgauuauauguucgucaaauggaagguggaguacaucaaaacugaagcuauagugugcgucgaguuaacaucgcaggaacgacaguguucccugauugaggccggaaccagauuuaaucuuggccccguuacaaucacuuugucugagccaaggaacauucagcaaaagcugcccccugaaaucauaacccugcauccacgcaucgaggaaggguucuuugaccuaaugcacgugcagcgggugcugagcgcaucaacgguaugcaagcuccagaguugcacccauggagucccgggugaccuccagguguaccacauuggcaaucuuuugaaaggggauaagguuaacggacaccugauccauaaaauugagccccacuucaauacauccuggaugucuugggacggcugugauuuagacuauuacugcaacaugggugauuggccuagcuguacuuauaccggggugacacaacauaaucacgccgcuuuugucaaccuccugaacaucgaaacugacuacaccaagaauuuccacuuccauuccaaaagagugacggcgcacggcgauacaccacagcuugaccugaaggcaaggcccaccuauggagccggcgagguuacuguguugguagaggucgcugauauggaacuccauacaaagaagauagagauuucagggcugaaguuugccagccuaaccugcacuggauguuacgcaugcaguucuggcaucuccuguaaagugaagauccacguggacgaaccugaugagcugaccguccauguuaaaagcgaggacccagauauuguggccgcugguucgucacucauggcccgcaagcuggaguucggggcagacucuacauuuaaagcguucagugcuaugcccaagacgucccuuugcuuuuauaucguagaacgagaauacuguaagagcugcucucgggaggacacccguaaaugugugaacacuaaguuggauagaccgcagagcauucugauagaacacaaaggaacaaucauuggcaagcagaauaauaccugcacagccaaagcauccugcugguuagagucagucaagaguuucuuuuacggucucaagaacaugcugagcggcaucuucgggaacguguuuauuggaaucuuccuuuuuauagccccuuucguucugcuaauccucuuuuucauguucggcuggaggauucuguuuuguuucaaaugcugucgccggacuagaggguuguuuaaguauaggcaccugaaagacgaugaggaaaccggauaccgaaagaucauugagcgcuuaaauaacaaaaagggcaagaauaaacuccuggacggugaacggcuugcugauagaaagaucgccgagcuguucucuacgaaaucccauauaggg

SEQ ID NO: 10494 - RNA, 3495 nt, Artificial Sequence
  derived and/or modified CDS sequence (opt3) from CCHVF(CCHVF SPU 48/90)__KJ682813.1__Gn-NSm-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaagagcuucaaguugugugaaaauuccgcuacuggcaaaucuugcguuauugauucggugccaguaaagugucgacaggguuacugcuuacguaucacccaggaggggagaggacaugugaaacugucaaggggcagcgaggucgugcuagacgcaugugauacaaguugcgaaauaaugaucccgaagggcaccggggacauucucguugauuguuccggaggucagcaacacuuucugaaggacaaccuuaucgaucugggcugccccaaaauuccuuugcucgggaagauggccaucuauauaugucggaugucuaaucauccaacuacaaccauggcguuccuguuuugguucagcuuuggauacgugauuacgugcauccugugcaaagcuauuuucuaucucuuaaucaucauuggcacucuggguaagcgcuuuagacaguacagggagcuuaaaccccagaccuguacaauaugcgaaacuaccccugucaacgccaucgacgcagagaugcacgauuugaauuguuccuauaacauuugcccauacugugccucacggcugacaagugacgggcuagcucgccaugugacccagugccccaagcgaaaggagaaaguagaagagacggaacucuaccugaaucuugagagaaucccuuggguugugaggaagcuguugcaagucagcgaaucuacuggaguggcacucaaacgguccucauggcugauaguguuacugguccucuucacaguuagccuuaguccagugcagucugccccgauuggccacggcaagaccaucgaggcuuaucgugcccgcgagggguacacuuccaucugucuguuuguauugggaagcauucuauucguggucucgugccugaugaaaagacucguggacucuguugguaacuccuuuuuccccggccugucaaucuguaagacaugcaguauuagcuccauaaauggguuugaaaucgagucucacaaauguuauugcagccuuuucugcuguccuuacugcaggcauuguucagcggauaaggaaauucacaagcugcauuugaguaucugcaaaaagcggaaaaccggauccaacgugaugcucgcagucuguaagcgaaugugcuuccgcgccacgauggaggugagcgacagagcucuguuuaucaggucuauuauaaauaccacauucguauuauguauccugauucuagccguuugcguggucucaaccagugcaguggaaauggagaaccucccagcuggcacuugggagcgggaagaggaucugacaaauuuuugucaccaggaaugccaggucacugagaccgaaugucuuugccccuaugaggccuuggugcugcgcaaaccucucuucagagacagcaucguuaaggguaugaagaaccugcuuaacuccacaucucuggagaccucguugagcauugaagcgccauggggcgccaucaaugugcaauccacuuacaaacccacgguaucaacagcaaacauagcucucaguuggucuagcgucgagcacagggggaauaagauccugguguccggacguucagaaagcauuaugaaauuagaggagcggaccggcaucucuugggaucuggggguugaagacgccuccgagaguaagcuacucacugugagcgucauggaucugucucagauguauuccccgguguuugaauaccuuucaggagaccgacagguagaggaauggccuaaagcuaccugcacaggugauugucccgagagaugcggcuguaccaguagcacuugcuugcauaaggaguggccacacucgaggaacuggcgcuguaauccuacauggugcuggggaguggggacgggcuguaccugcuguggucuggacguuaaggaucucuucacugacuacauguuugucaaauggaagguggaauauauuaaaacagaggccaucgugugcgucgaacugaccucccaagagcggcaguguucuuuaauagaagcagggacaagauucaaccugggccccguuacuauuacccuuagcgagccaaggaauauccagcagaaguugcccccugagauuaucacgcuccauccacgcauagaagagggauuuuucgaccugaugcacgugcaaaaagugcuaucagccaguaccguaugcaagcugcaguccugcacacauggcgucccgggggaucuccagguguaccacaucggaaaccugcuuaagggugacaaaguuaauggccacuugauucauaagaucgaaccccacuuuaacacuucuuggaugagcugggaugggugugaccuggauuauuacugcaauaugggagacuggccuuccuguaccuauacaggcgugacucagcauaaccgagcuucauucgucaauuuacucaacauugagaccgauuacacgaaaaauuuucacuuccacagcaagcgggugacagcgcauggugacaccccacaacuggaucuuaaagcacgucccacuuauggggccggcgaaaucacaguucugguggagguagcugacauggaguugcacaccaagaaaauagaaauuaguggacucaaguucgccucucugacuugcaccggcuguuacgcaugcuccagcgggaucucguguaaggucagaauccauguggaugagccugacgaacuaacagugcacgucaaaucagaugacccagacguuguggccgcuucuaguucccugauggccaggaagcucgaguuuggaacggauagcaccuucaaagcauuuucugcgaugcccaagacuagccugugcuucuacauuguagagaaagaauauuguaaguccugcucagaggaagacacaaagaaaugugugaacaccaaacuugagcagccgcagaguaucuugauugaacauaaaggcacaauaaucgguaagcagaacagcacuugcaccgcuaaagucucuugcuggcuggaguccgccaagucauuuuucuacggguuaaaggauaugcucaguggaauuuuuggcaauguguucaucgguauuuuucuguuccuugcaccuuuuauccugcuaauacucuucuuuauguucggcuggcgcauccuguuguguuucaaaugcugucggagaacgagggggcuguuuaaguaucgacacuuaaaagacgaugaggaaacaggauaccgccggauuaucgagagacucaacaauaagaaaggcaagaacaagcugcuugacggggaaaggcuggccgaucgucgcauugcugaguuguucagcaccaaaacucacaucgga

SEQ ID NO: 10495 - RNA, 3495 nt, Artificial Sequence
  derived and/or modified CDS sequence (opt3) from CCHVF(CCHVF SPU 187/90)__KJ682814.1__Gn-NSm-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaaaucuuucaaguugugugaaaauuccgcuacuggcaaaucuugcgagauugauucgguuccagugaagugucgacaggguuacugcuuacguaucacccaggaggggagaggacauguaaaacugucaaggggcagcgaagugguccuagacgcaugugauacaaguugcgagauaaugaucccgaagggcaccggggacauucucguggauuguuccggaggucagcaacacuuucugaaggacaaccuuaucgaucugggcugccccaaaauuccuuugcucgggaagauggccaucuauauaugucggaugucuaaucauccaaaaacuacaauggcguuccuguuuugguucagcuuuggauacguuauuaccugcauccugugcaaggcuauuuucuaucucuuaaucaucauuggcacgcuggguaaacgcuuuaagcaguacagagaacuuaagccccagacuuguaccauaugcgagacaacuccugugaacgccaucgacgcagagaugcacgauuugaauuguuccuauaacauuugcccauacugugccucaaggcugaccagugacgggcuagcucggcaugucacacagugccccaaacgcaaggaaaaaguggaggaaaccgagcucuaccugaaucuugaacgaaucccuuggguaguuagaaagcuguugcaagugagcgagucuacgggagucgcacucaaaagguccucauggcugauaguguuacugguccucuucacugugagccuuaguccaguucagucugccccgauuggccacggcaagacaaucgaggcuuaucgggcccgugaaggguacaccuccaucugucuguuuguguugggaagcauucuauucguagugucgugccugaugaaaggucucgucgacucugugggcaacuccuuuuuccccgggcugucaaucuguaagacuugcaguauuggaagcauaaauggcuuugagaucgaaucccacaaguguuauugcucucuuuucugcuguccuuacugccgccauuguagcgcggauaaagagauucacaagcugcauuugucaaucugcaaaaagagaaaaacagguaguaacguuaugcucgcaguguguaagaggaugugcuuccgggccaccauggaagucuccaaucgagcucuguuuauccgcagcauuauaaacacgaccuucguguuauguauccugauucuagccguaugcguugugucuacaucagcagucgagauggagaaucucccagcugggacuugggaaagagaggaagaccugaccaacuuuugucaccaggagugccaggugacagaaacugagugucuuugccccuaugaggccuugguccugaggcggccucucuuccuggauaguaucgugaagggcaugaaaaaccuucugaauagcaccuccuuggaaacaucucucucgauugaggcgccauggggagccaucaacguucaaagcaccuacaagcccacuguguccacggcaaauauagcucugucauggaguucuguagaacaccgcggcaacaaaaucuuagucagcgggagauccgagucaauuaugaagcuggaggaaaggacaggaaucagcugggaccuagguguggaggaugccucugaauccaaacuccugaccguuagugugauggaccuuagccagauguauucuccggucuuugaguacuuguccggcgaucgucagguggaagaguggccuaaggcuacuugcaccggggacugucccgagcggugcggauguacaucaaguaccugccugcauaaggaauggccacacagccgaaauuggagauguaacccuacuuggugcuggggcguagguacaggguguacgugcuguggccucgaugugaaagaccuguucaccgauuacauguuuguuaaguggaaagucgaguauauuaagacugaagccaucgugugcguggaguuaacaucgcaagaaaggcaguguucccugauagaggcaggaacccgcuucaaucuuggccccgucacaauuacuuugucugagccacggaacauccagcagaaacugcccccugaaauuaucacccuccauccaagaauagaggaaggguuuuucgaccuaaugcacguucaaaaggugcugagcgccucaacggugugcaagcuccagaguugcacccauggaguaccgggugaccugcaggucuaccacaucggcaaucuuuugaaaggggauaaggugaacggacaccugauucauaaaaucgagccccacuuuaauacauccuggaugucuugggacggcugugauuuagacuauuacugcaacaugggugauuggccuagcuguacuuauaccgggguuacacagcauaaucacgcuuccuucgugaaccuccugaauauugaaacugacuacaccaagaacuuucacuuccauucaaaaagggucacggcgcacggcgauacaccacaacuugaccugaaggcacgccccaccuauggagccggcgagaucacuguguugguugagguggcugauauggaacuccauaccaaaaagauagagauuagcgggcugaaguucgccagucuaacaugcacuggauguuacgcaugcagcuccggcaucagcuguaaaguacgaauccacgucgacgaaccugaugagcugaccgugcaugugaagucggacgauccagacgucguugccgcuucaucuagucucauggcccggaaacuggaguuugguacagacuccauuuucaaggcauuuagcgcgaugcccaaaacgucucuuugcuucuacaucguggaacgugagcacuguaagagcugcuccgaagaggauaccaagaaauguguaaacacuaaguuggaacagccgcagucaauucugauagagcacaaagggacaaucauuggaaagcagaauaguaccugcacagcuaaaacuagcugcugguuagagucugugaaguccuuuuucuauggccucaagaacaugcugucagguaucuuuggcaaugucuucauugggaucuuucuuuuccuggccccuuuuauacuacucauccuguucuuuauguucggauggagaauuuuguucuguuuuaaaugcuguaggcgcacccggggccuguucaaguacagacauuuaaaagacgaugaagagacgggguauaggcgaaucauugaacgccucaacaauaagaaaggaaagaacaagcugcuugacggcgagcggcuggcagauagaaggaucgccgaauuguuuaguacaaaaacccacauaggu

SEQ ID NO: 10496 - RNA, 3495 nt, Artificial Sequence
  derived and/or modified CDS sequence (opt3) from CCHVF(CCHVF Haskovo-V46/13)__KR092379.1__Gn-NSm-Gc
agcgaggaacugggcgacgauugcaucuccagaacccagcuccuuaggacagagacugccgaaauucacgacgauaacuacgggggacccggugacaagauaacgaucuguaauggcucuaccauuguggaucaacggcuggggucagaguugggaugcuauacaaucaaccgcggcaaaaguuucaaguuaugugaaaauagcgcuacugguaaaaccugcgagauugacuccacaccugucaagugucgacagggguuuugccugaaaaucacccaggagggacguggccauguuaagcuaucuagaggcucggaagugguacucgaugcaugugacucaagcugcgaggugaugauaccaaaggggacuggagauauccuggucgacuguagugguggccagcaacacuuccuuaaagauaaccugauugacuuggggugcccgcauaucccccuccugggaaagauggccauuuacaucuguaggauguccaaucacccucggacaaccauggcguuucuguucugguuuucuuucggcuaugugauaacgugcaucuuuugcaaagcucucuucuacagcuuaauuauuaucgguacucuggggaagaaaaucaagcaguaucgcgaacuuaagccacagaccuguacaauuugcgagacuacccccguuaacgccauagaugcagagaugcaugacuugaauuguuccuacaacaucugcccuuauugugccucaagacugacaagugacggacuagcuaggcacgugacccagugcccaaaacggaaggaaaaagucgaggaaacggagcucuaccugaaucuugaacgcauucccuggaucgugcgaaagcuguugcaaguaagcgagucuacuggcguugcacucaaaagauccucauggcugauaguguuacugguccuccuuccugugagccugaguccagugcagucugccccggucggccacgggaagacaauugagaccuaccagacuagggaaggauuuacauccaucuguuuguucaugcuagguagcauccuguuuauuguuucgugccucgugaaaggccugguagauucugugggggacuccuucuuucccggacuuucagucuguaagaccugcaguaucggcagcauuaacgguuucgagauagaaucccauaaguguuauugcucucuguucugcuguccuuacugccggcacuguagcgcugaucgugagauccaucaguugcaccucucaauuugcaaaaagcgcaaaacggggaguaaugugaugcuggccguuuguaagagaaugugcuuuagggcgaccaucgaagcaucccggcgagccuuacugauccgcagcauuauaaacacaacuuucgcuauguguauccuaacccucacaauuugcguggucucuacuucagccguggagauggagaaucugccagcaggcaccugggaaagagaggaagaccuuacaaacuuuugucaccaagagugccagguaaccgaaacugaguguuugugccccuaugaggcucugguucucaggaaaccucuguuccuugauaguaucgugaagggaaugaagaaucuguugaacagcacgucccucgaaacaucucugucgauugaggccccauggggcgcgaucaacguccagagcaccuuuaaacccacuguguccaccgccaauauagcauuaucauggaguucugucgaacaucgggggaacaagauccuggugacaggacgcagcgaguccauuaugaaacuagaggaaagaaccgguguuucaugggaccucggcguggaggaugcuagcgaaucuaagcugcuuacuguauccaucauggacuugagucaaauguacagcccggucuucgaguaucugucuggggaucgucagguggaagaguggccuaaagccacaugcacgggagacugucccgagaggugcggcuguaccuccucaacuugccuccacaaggaauggccacauagucggaauuggcgauguaacccuacauggugcugggguguugggaccggcuguacaugcuguggaguggaugucaaggaccuguuuacugaccacauguucgugaaauggaagguagaguacauuaaaaccgaagcuaucgugugcguugaguuaacgagccaggaaagacaguguucgcugauagaggccggcaccagguuuaaucuugggcccgucacaauuacuuuguccgagccacgcaacauccaacagaagcugcccccugaaauuaucacccuccauccaaaaauagaggaaggauucuuugaucuaaugcacgugcagaaggugcugucugcaagcacagucugcaagcuccagucaugcacucacgguaucccgggcgaccugcaaguuuaucauauugggaaucuuuugaaaggagaucgggugaacggccaccugauccauaagauugagccccacuucaauaccaguuggauguccugggacgguugugauuuagacuacuacugcaacaugggggauuggccuucuuguacguauacaggcgugacccagcacaaucaugccgcuuuuguaaaccuccugaauaucgaaacugacuacacaaaaaccuuccacuuccauagcaagagagucacugcgcacggagauaccccacagcuugaccugaaagcaaggcccacauauggcgccggggagauaacgguguugguugagguggcugauauggaacuccauaccaagaaagucgagauuuccggacugaaguuugccucacuaacuugcacaggcuguuacgcaugcagcagugguaucucuuguaaggugcgcauccacguugacgaaccugaugagcugaccgugcacguaaaauccagcgacccagacgucguggccgcugggacaucgcucauggcccgaaagcuggaguucggaacugauucaaccuuuaaagcauucucugcgaugcccaagacgagucuuugcuuuuauauuguggaacgggaguacuguaaauccugcagcgaagacgauacacagaagugugucgacaccaaguuggagcaaccgcagucuauccugauugaacauaaaggcacuauaaucgguaagcagaacgauaccugcacagcucgugccagcugcugguuagaguccguuaaaucauucuuuuauggccucaagaauaugcuggggaguguguucggaaacuuucuuauuggcauccugcuauuccucgcaccuuuuguacuguuggugcuguucuuuauguucggguggaaaauuuuauucuguuuuaagugcuguagaaggacucgcggacucuucaaguaccggcaccugaaagacgaugaggaaaccggcuacagaaggaucauagagcgacuuaacagcaagaaagguaagaaucgccuguuggacggggaacggcucgccgauagaaaaaucgcugagcuguuuucuacaaagacgcauauugga

SEQ ID NO: 10497 - RNA, 3495 nt, Artificial Sequence
  derived and/or modified CDS sequence (opt3) from CCHVF(CCHVF 24-R-2012)__KR814856.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacacuucaugcgaggucaugauaccgaagggcacaggggauauccucguggacuguagcggaggucagcaacacuuccugaaagauaaccuuauugaccugggcugcccccauaucccuuugcucgggaagauggccauuuacaucuguaggaugaguaaucacccacggaccacgauggcguuucuguucugguuuuccuucggauauguuauaacuugcaucuuuugcaaagcucuguucuacucucucauuauuaucggcaccuuagguaagaaaaucaagcaguaucgcgaacugaagccccagacauguacuauuugcgagaccgccccugugaacgcaauagaugccgagaugcaugaccuuaauuguagcuacaacaucugcccauauugugcuuccagauugacaucagacgggcuggcaaggcacgucccccagugcccuaaacggaaggaaaaaguggaggaaaccgagcuauaccucaaucuggaacgcauuccauggaucguacgaaaacuucugcaaguuagugagagcacgggaguggccuugaagagaucuuccuggcucauaguccuguuagugcugcucacugugucacuuagcccgguccagagugcucccguuggccacggcaagacaauugagaccuaccagacuagggaaggguuuacaucugugugucuguucauguugggauccauccuauuucugguaagcugccucgugaaaggucuggucgauucggugucugacuccuucuuuccuggccuuucaguuuguaagaccugcaguaucgggagcauuaacggauucgagaucgaaucccauaaguguuauugcucucuguucugcuguccauacugccggcacuguagcgccgaucgugagauucaucaguugcaccucucaauaugcaaaaagcgcaaaaugggcaguaaugugaugcuggcggucuguaagagaaugugcuuuagggcaacgaucgaagccucccggcgagcuuuacugauucgcagcaucaucaacaccacauucgugauuuguauacuaacucucaccaucugcguaguuucuacaucagccguggagauggagaaucugcccagugguacuugggaaagagaggaagaccuuaccaacuuuugucaccaagagugccaggucacagaaaccgaguguuugugcccuuaugaggcacuggugcucaggaaaccacuguuccuugauagcauugucaaggggaugaagaaucuguugaacuccacuucucucgaaacgucgcugagcaucgaggcucccuggggcgccauuaacgugcaguccacauuuaaaccgaccguuucaacugcgaauaucgccuuaaguuggucuagcguggaacaucggggaaacaagauacugguaaccggccgcuccgagucaaucaugaaacuagaggaaagaacaggggucagcugggaccucggaguggaggaugcaucugaauccaagcugcuuaccguuaguauuauggacuugagccaaauguacucuccuguguucgaguaucuguccggugauaggcaggucgaagaguggcccaaagcuacuugcacaggcgacuguccagagcguugcggguguacgucaaguaccugccuccacaaggaauggccucauagccggaauuggcgauguaaccccacuuggugcuggggagugggcacagguuguaccugcugugggguagaugugaaggaccuguuuacagaccacauguucguuaaauggaaggucgaguacaucaaaacugaagccauugugugcguggaguuaaccucgcaggaaagacaguguucccugaucgaggcuggcacgagguuuaaucuuggaccagucaccauaacauugucugagccccgcaacauucaacagaagcucccuccagaaaucauuacucugcauccgaaaguugaggaaggcuucuuugaucuaaugcacgugcagaaggugcugagcgccucaaccguaugcaagcuccagaguugcacacacgggauccccggagaccugcaagucuaucauauagguaaucuuuugaaaggcgaucgggugaacgggcaccugauccauaagauugagccucacuucaauacuuccuggaugucuugggacggaugugauuuagacuacuacugcaacaugggcgauuggccaagcuguaccuauacggguguuacacagcacaaucaugcagccuuugugaaccuccugaauaucgaaaccgacuacacuaaaacauuccacuuccauuccaagagagucaccgcucacggggauacuccccagcuugaccugaaagcgaggccuaccuauggcgcaggagagauuacaguguugguugagguggccgauauggaacuccauacgaagaaaguagagaucucaggccugaaguuugcuagccuagccugcaccggguguuacgcaugcaguucuggaauauccuguaagguccgcauucacguggacgaaccagaugagcugacugugcacgucaaaagcaacgaccccgacguuguggccgcuucgacaucacucauggcccgaaagcuggaguucggcaccgauucuacauuuaaagcauucagugcgaugccgaagacuucccuuugcuuuuauaucguagaacgggaguacuguaaaagcugcucugaagaggacacccagaaguguguggauacgaaguuggaacaaccucagagcauccugauugagcauaaagguacaaucauugggaagcagaaugauaccugcacugcuaaagccuccugcugguuagagucagucaagaguuucuuuuauggacucaaaaacaugcugggcagcguguucgguaacuuuuucauaggcauccuucuguuucuagcaccauucguucuccugguguuguuuuucauguucggguggaagauucuguuuuguuucaagugcugucguagaaccaggggauuacucaaauaccgccugcuuaaggacgacgaagagacaggcuaccggagaaucauugaaaggcugaauaacaaaaaggggaaaaaucgauugcucgauggagagcgccuggccgaccggaagaucgcugaacuauuuucuacuaagacccacauaggc

SEQ ID NO: 10498 - RNA, 3495 nt, Artificial Sequence
  derived and/or modified CDS sequence (opt3) from CCHVF(CCHVF 36-ST-2014)__KR814857.1__Gn-NSm-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuacagccucauuaucaucggcacuuuagguaaaaagauuaagcaguaucgggaacugaaaccccagaccuguacaauaugcgagacugccccuguuaacgcaaucgaugccgagaugcaugaccuuaauuguuccuacaacauuugcccauauugugcuucacgcuugaccagugacgggcuggcaagacacgugacacagugccccaagaggaaagaaaaggucgaggaaaccgagcuauaccucaaucuggaacggaucccuuggauagugcgcaaacuucugcaaguaagcgagucuacgggaguugccuugaagcgauccucauggcucauugugcuguuaguccugcucacugugagccuuaguccagugcagucugcuccggucggccacggcaaaacaaucgagaccuaccagacuagagaaggguuuacaaacaucugucuguucauguugggauccauucuauuuaucguuagcugccuggugaagggucucguagauucggugucugacuccuucuuucccggccugucagucuguaagaccugcaguauugggagcauaaauggauucgagaucgaaucccauaaauguuauugcucucuuuucugcuguccuuacugcaggcacuguagcgccgaucgggagauucaucagcugcacuugggcaucugcaagaaacguaagacggguucaaacgugaugcucgcgguuuguaaacgcaugugcuuuaaggcaaccaucgaagccaguagaagggcucuguuaauucgguccauaaucaauacaacuuucgugauuuguauccugacccuagccauuugcgucgugagcacaucugcaguagagauggagaaccucccagcugggacuugggaacgagaggaagaccugaccaauuuuugucaccaagagugccagguuucagaaacagagugucuuugccccuaugaggccuuggugcugcgcaagccucucuuccuggauaguaucgucaaaggcaugaagaaccuucugaacagcaccuccuuggaaacuucucucucgauagaggcgccauggggagccaucaaugugcagagcacguuuaaacccacagucuccaccgcaaacauugcucugucauggaguucuguggaacauagaggcaauaagaucuuaguuacugggaggagcgaguccauuaugaaacuggaggaacggaccggagugucaugggaccuagguguagaggaugccagcgaaucuaagcuccugacagucuccaucauggaccuuagucaaauguacagcccgguguucgaguauuugucuggcgaucgccagguugaagaguggccuaaggcuaccugcacuggggacugucccgagagaugcggauguacauccucaacgugccugcacaaagaauggccacauaguaggaacuggcguuguaauccuaccuggugcuggggcguggguacuggguguacaugcuguggcgucgaugugaaggaccucuuuaccgaccacauguucauaaaauggaagguagaguacauuaaaacagaagccaucgugugcguugagcugacuagccaggaacggcaguguucguuaauugaggcaggaacccgauuuaaccugggccccgucacgaucacccuuuccgagccaagaaauauacaacagaaguugcccccugaaaucauuacacuccauccaaagaucgaggaaggguucuuugaucugaugcacgugcagaaagugcuaucugccagcacugucugcaagcugcagucaugcacccacgguauuccgggagaccuccaaaucuaucauauaggcaaccugcuuaaaggggauagguugaauggacaccugauucauaagaucgagccccacuucaacacaaguuggauguccugggacggcugugauuuagacuacuacugcaauaugggugauuggccuucuuguacuuauaccgggguuacgcagcacaaccaugcugcguuugugaaucuccugaacaucgaaacagacuacaccaaaacuuuccacuuccauagcaagcgcgugacagcacacggcgauaccccacagcuugaccugaaagcccggcccacuuauggagcuggcgagauuaccguauuggucgagguggccgauauggaacuccauacaaagaagguugagaucuccgggcugaaauuugcaucacuagccugcacgggauguuacgcuugcagcaguggcauuucuuguaaggugagaauacacgucgacgaaccugaugagcugaccgugcacguuaaauccagcgacccagacgugguagccgcaucgacuucacucauggcgaggaagcuggaguucgguacagauucuaccuuuaaggcuuucagugccaugcccaaaacaucccuuugcuuuuauaucgucgaacgcgaguacuguaagagcugcucugaagacgauacuaaaaaguguguggacaccaaauuggaucagccgcaaagcauucugaucgagcauaaggggacgauuaucggaaaacagaaugacacaugcaccgcaaaggccuccugcugguuagaaucagugaagaguuucuuuuauggccucaaaaacaugcuggguagcgucuucggcaacuuuuucguugggauacuucuguuucuagcuccuuucgugcuccugguauuguuuuucauguguggauggaaguuccuguuuugcuucaaauguugccgacggacucguggcuuauuuaaguacagacaccucaaagaugacgaggagaccggguacaggcgcaucauugaacggcuuaauucuaagaagggcaaaaacagacugcuggauggagagagguuggccgaccgaaagaucgcagaacucuucuccacaaaaucacauauuggu

SEQ ID NO: 10499 - RNA, 3495 nt, Artificial Sequence
  derived and/or modified CDS sequence (opt3) from CCHVF(CCHVF 37-R-2013)__KR814858.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacacuucaugcgaggucaugauaccgaagggcacaggggauauccucguggacuguagcggaggucagcaacacuuccugaaagauaaccuuauugaccugggcugcccccauaucccuuugcucgggaagauggccauuuacaucuguaggaugaguaaucacccacggaccacgauggcguuucuguucugguuuuccuucggauauguuauaacuugcaucuuuugcaaagcucuguucuacucucucauuauuaucggcaccuuagguaagaaaaucaagcaguaucgcgaacugaagccccagacauguacuauuugcgagaccgccccugugaacgcaauagaugccgagaugcaugaccuuaauuguagcuacaacaucugcccauauugugcuuccagauugacaucagacgggcuggcaaggcacgucccccagugcccuaaacggaaggaaaaaguggaggaaaccgagcuauaccucaaucuggaacgcauuccauggaucguacgaaaacuucugcaaguuagugagagcacgggaguggccuugaagagaucuuccuggcucauaguccuguuagugcugcucacugugucacuuagcccgguccagagugcucccguuggccacggcaagacaauugagaccuaccagacuagggaaggguuuacaucugugugucuguucauguugggauccauccuauuucugguaagcugccucgugaaaggucuggucgauucggugucugacuccuucuuuccuggccuuucaguuuguaagaccugcaguaucgggagcauuaacggauucgagaucgaaucccauaaguguuauugcucucuguucugcuguccauacugccggcacuguagcgccgaucgugagauucaucaguugcaccucucaauaugcaaaaagcgcaaaaugggcaguaaugugaugcuggcggucuguaagagaaugugcuuuagggcaacgaucgaagccucccggcgagcuuuacugauucgcagcaucaucaacaccacauucgugauuuguauacuaacucucaccaucugcguaguuucuacaucagccguggagauggagaaucugcccagugguacuugggaaagagaggaagaccuuaccaacuuuugucaccaagagugccaggucacagaaaccgaguguuugugcccuuaugaggcacuggugcucaggaaaccacuguuccuugauagcauugucaaggggaugaagaaucuguugaacuccacuucucucgaaacgucgcugagcaucgaggcucccuggggcgccauuaacgugcaguccacauuuaaaccgaccguuucaacugcgaauaucgccuuaaguuggucuagcguggaacaucggggaaacaagauacugguaaccggccgcuccgagucaaucaugaaacuagaggaaagaacaggggucagcugggaccucggaguggaugacgcaucugaguccaagcugcuuaccguuaguauuauggauuugagccaaauguacucuccuguguucgaauaucuguccggugacaggcaggucgaggaauggcccaaagcuacuugcacaggcgauuguccagagcguugcggguguacgucaaguaccugccuccacaaggaguggccucauagccggaauuggcgauguaaccccacuuggugcuggggagugggcacagguuguaccugcugugggguagacgugaaggaccuguuuacagaucacauguucguuaaauggaaggucgaauacaucaaaacugaggccauugugugcguggaauuaaccucgcaggagagacaguguucccugaucgaagcuggcacgagguuuaaucuuggaccagucaccauaacauugucugagccccgcaacauucaacagaagcucccuccagagaucauuacucugcauccgaaaguugaagagggcuucuuugaccuaaugcacgugcagaaggugcugagcgccucaaccguaugcaagcuccagaguugcacacacgggauccccggagaucugcaagucuaucauauagguaaucuuuugaaaggcgaccgggugaacgggcaccugauccauaagauugaaccucacuucaauacuuccuggaugucuugggauggaugugacuuagauuacuacugcaacaugggcgacuggccaagcuguaccuauacggguguuacacagcacaaucaugcagccuuugugaaccuccugaauaucgagaccgauuacacuaaaacauuccacuuccauuccaagagagucaccgcucacggggacacuccccagcuugaucugaaagcgaggccuaccuauggcgcaggagaaauuacaguguugguugagguggccgacauggagcuccauacgaagaaaguagaaaucucaggccugaaguuugcuagccuagccugcaccggguguuacgcaugcaguucuggaauauccuguaagguccgcauucacguggaugagccagacgaacugacugugcacgucaaaagcaacgaccccgauguuguggccgcuucgacaucacucauggcccgaaagcuggaguucggcaccgacucuacauuuaaagcauucagugcgaugccgaagacuucccuuugcuuuuauaucguagagcgggaauacuguaaaagcugcucugaggaagauacccagaaguguguggacacgaaguuggagcaaccucagagcauccugauugaacauaaagguacaaucauugggaagcagaaugugaccugcacugcuaaagccuccugcugguuagagucagucaagaguuucuuuuauggacucaaaaacaugcugggcagcguuuucgguaacuuuuucauaggcauccuucuguuucuagcaccauucgugcuccuggucuuguuuuucauguucggguggaagauucuguuuuguuucaagugcugucguagaaccaggggauuacucaaauaccgccugcuuaaggaugacgaggaaacaggcuaccggagaaucauugagaggcugaauaacaaaaaggggaaaaaucgauugcucgauggagaacgccuggccgaccggaagaucgcugagcuauuuucuacuaagacccacauaggc

SEQ ID NO: 10500 - RNA, 3495 nt, Artificial Sequence
  derived and/or modified CDS sequence (opt3) from CCHVF(CCHVF 44-ST-2010)__KR814859.1__Gn-NSm-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucugcugugguucucuuuuggauaugugauuacgugcaucuucugcaaggcucucuuuuacagcuuaauuaucaucggcacucuggguaaaaagauuaagcaguaucgggaacuuaaaccccagaccuguacaauaugcgagacugccccuguuaacgcaaucgaugccgagaugcaugacuugaauuguuccuacaacauuugcccauauugugcuucacgccugaccagugacgggcuagcaagacacgugacacagugccccaagaggaaagaaaaggucgaggaaaccgagcucuaccugaaucuugaacggaucccuuggauagugcgcaaacuguugcaaguaagcgagucuacgggaguugcccucaagcgauccucauggcugauuguguuacugguccuccuuacugugagccugaguccagugcagucugcuccggucggccacggcaaaacaaucgagaccuaccagacuagagaaggguucacaaacaucuguuuguuuaugcuaggauccauucuguucaucguuagcugccucgugaagggucugguagauucggugucugacuccuuuuuccccggccuuucagucuguaagaccugcaguuuugggagcauuaauggauucgagauagaaucccauaaauguuauugcucucuguucugcuguccuuacugcaggcacuguagcgccgaucgggagauccaucaguugcaccucggcauuugcaagaaacguaagacggguucaaacgugaugcuggcgguuuguaaacgcaugugcuuuaaggcaaccaucgaagccaguagaagggcuuuacugauccgguccauuauaaauacaacuuucgugaucuguauucuaacccucgccaucugcgucgugagcacaucugcaguagagauggagaaccugccagcugggacuugggaacgagaggaagaccuuaccaauuuuugucaccaagagugccagguuucagaaacagaguguuugugccccuaugaggcccuggugcuccgcaagccucuguuccuugauaguauugucaaaggcaugaagaaccuguugaacagcaccucccucgaaacuucucugucgaucgaggcgccauggggagccauaaaugugcagagcacguuuaaacccacagucuccaccgcaaacaucgcuuuaucauggaguucuguggaacauagaggcaauaagauucugguuacugggaggagcgaguccaucaugaaacuagaggaacggaccggagugucaugggaccucgguguagaggaugccagcgaaucuaagcugcuuacagucuccauuauggacuugagucaaauguacagcccgguguucgaguaucugucuggcgaucgccagguugaagaguggccuaaggcuaccugcacuggggacugucccgagagaugcggauguacauccucaacgugccuccacaaagaauggccacauaguaggaacuggcguuguaauccuaccuggugcuggggcguggguacuggguguacaugcuguggcgucgaugugaaggaccuguuuaccgaccacauguucaucaaauggaagguagaguacauaaaaacagaagccauugugugcguugaguuaacuagccaggaacggcaguguucgcugaucgaggcaggaacccgauuuaaccuuggccccgucacgauuaccuuguccgagccaagaaauauccaacagaagcugcccccugaaauaaucacacuccauccaaagauugaggaaggguucuuugaucuaaugcacgugcagaaagugcugucugccagcacugucugcaagcuccagucaugcacccacggaaucccgggugaccugcaaauuuaucauaucggcaaccuuuugaaaggggauaggcugaauggacacuuaauacauaagauugagccccacuucaacacaaguuggauguccugggacggcugugaucucgacuacuacugcaauaugggugauuggccuucuuguacuuauaccgggguuacgcagcacaaccaugcugcguuugugaaucugcuuaacaucgaaacagacuacaccaaaacuuuccacuuccauagcaagcgcgugacagcacacggcgauaccccacagcuggacuugaaagcccggcccacuuauggagcuggcgagaucaccguacucgucgagguggccgauauggaacugcauacaaagaagguugagauuuccgggcuaaaauuugcaucacuggccugcacgggauguuacgcuugcagcaguggcaucucuuguaaggugaggauucacgucgacgaaccugaugagcucaccgugcacguuaaauccagcgacccagacgugguagccgcaucgacuucacugauggcgagaaaacuugaguucgguacagauucuaccuuuaaggcuuucagugccaugcccaagacauccuugugcuuuuauauagucgaacgcgaguacuguaagagcugcucugaagacgauacuaaaaaguguguggacaccaaacuggaucagccgcaaagcaucuuaauugagcauaaggggacgaucauuggaaaacagaaugacacaugcaccgcaaaggccuccugcuggcucgaaucagugaagaguuucuuuuauggccugaaaaacaugcuugguagcgucuucggcaacuuuuucguugggauccugcuauuucucgcuccuuucgugcuguugguacuguuuuucauguguggauggaagauauuauucugcuuuaaauguugccgacggacucguggccucuucaaguacagacaccugaaagaugacgaggagaccggguacaggcgcaucauugaacggcuuaauucuaagaagggcaaaaacagacuguuggauggagagaggcucgccgaccgaaagaucgcagaacuguuuuccacaaaaucacauauuggu

SEQ ID NO: 10501 - RNA, 3495 nt, Artificial Sequence
  derived and/or modified CDS sequence (opt3) from CCHVF(CCHVF 46-ST-2012)__KR814860.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaaaagauccucauggcucauaguccuguuagugcugcucacggugagccuuaguccgguccagucugcucccguuggccacggcaagacuauugagacauaccagaccagggaaggguuuacuuccaucugucuguucauguugggaagcauccuauuucuggugucgugccucguaaaaggucugguggauucugucuccgacucauucuuuccuggccuuaguguguguaagacaugcagcauuggguccaucaacggauucgagauugaaucucauaaguguuauugcagccuguucugcuguccauacugccggcacuguucagccgaucgugagauacaucaguugcaccucaguaucugcaaaaagcgcaaaaccggcuccaauguuaugcuggcgguguguaagagaaugugcuuuagggcaacgauugaagccagccggcgagcuuuacugauccgcucuaucauuaacgccaccuucgucauauguauccuaacacucacuauuugcgugguaucaaccagugcaguugagauggagagccugcccgcugguacaugggaaagagaggaagaccuuacuaauuuuugucaccaagagugccaggugaccgaaacagaguguuugugcccuuaugaggcccugguccucaggaaaccacuguuccuugauuccaucgugaaggggaugaagaaccugcucaauucuaccucguuggaaacuagccuguccauugaggcgcccuggggcgccaucaacguccagucaacguuuaaaccgacagugaguaccgcaaacauagcuuuaucuuggagcuccguugaacaucggggaaauaagauccuggugacuggccgcucagagagcauuaugaaacuagaggaaagaaccgggguaucuugggaccucggagucgaggaugccuccgaaaguaagcugcuuacagugagcaucauggacuugucucaaauguacuccccuguuuucgaguaucugucaggugaucgucagguggaagaguggcccaaagcuaccugcacuggcgacuguccagagaggugcggguguacaaguagcacgugccuccacaaggaauggccucauucgcggaacuggcgauguaaucccaccuggugcuggggagucggcacugguuguacaugcugugggguggauguaaaggaccuguuuaccgaccacauguucgugaaauggaagguugaguacauuaaaacagaagccaucgucugcguggaguuaacuucccaggaaagacaguguucucugauagaggcaggcaccagguuuaaccuuggaccagugacgauuaccuugagcgagccccgcaauauccaacagaagcucccuccagaaauuaucacacugcauccgaaagucgaggaaggcuucuuugaucuaaugcacguucagaaggugcugucagccaguacugugugcaagcuccaguccugcacccacgggauacccggagaccugcaaguauaucauaucgguaaccuuuugaaaggcgaucggauuaaugggcaccugauccauaagauugagccucacuucaacacaucuuggaugagcugggacggaugugauuuagacuacuacugcaauaugggcgauuggccauccuguacuuauaccggugucacgcagcacaaccaugcugcguuugugaaucuccugaacaucgaaacagacuacaccaaaacuuuccacuuccauucaaagagaguuacagcacacggggauacuccccagcuugaccugaaagccaggccuacuuauggcgcuggagagauaaccguguuggucgagguggccgauauggaacuccauacaaagaaaguugagauuagcggccugaaguuugcaagucuagccugcacgggguguuacgcuuguucuuccggaaucagcugcaaggugcgcauccacguagacgaaccagaugagcugaccguccacgugaaaucgucagaccccgacguggucgccgcaucuaccagucucauggcgcgaaagcuggaguucggcacagauuccaccuuuaaggcuuucagcgccaugccgaagacaucucuuugcuuuuauauuguugaacgggaguacuguaaaagcugcuccgaagaggacacucagaaguguguggauacccguuuggaacaaccucagucaauccugauugagcauaaggguacgauaaucgggaaacagaaugacacaugcaccgcaaaggccaguugcugguuagagagcguaaaaucuuucuuuuauggacucaagaacaugcugggcuccguguucgguaacuuuuucauuggcauccuucuguuucuagcuccauucguccuccugguguuguuuuucauguucggguggaaaauucuguuuuguuucaagugcuguagaaggacucgcggauuacucaaguaccggcaccugaaagaugacgaagagaccggcuacagaaggaucauagaacgacuuaauaacaagaaagggaagaaucgccuguuggauggagagcggcucgccgacagaaaaaucgcagaacuguuuucaacaaagacucauauuggc

SEQ ID NO: 10502 - RNA, 3495 nt, Artificial Sequence
  derived and/or modified CDS sequence (opt3) from CCHVF(CCHVF 47-ST-2013)__KR814861.1__Gn-NSm-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauuguguaagaauagcgcuacuggcaaaaccugcgaaauugacuccacaccaguuaagugucgccaggguuuuugcuuaaagaucacccaggaggggcgaggacaugugaaacugucucguggcucggagguagugcuagaugcaugugacucaagcugcgaaauaaugaucccgaagggcacuggggauauucucgucgacuguaguggaggucagcaacacuuccugaaagauaaccuuaucgaccugggcugcccccauauuccuuugcucgggaagauggccaucuacauauguagaauguccaaucacccaaggacaaccauggcguuucuguucugguuuucuuucggauaugugauuacgugcaucuuuugcaaagcucuguucuacagccucauuaucaucggcacuuuagguaagaagauuaaacaguaucgggagcugaagccccagaccuguacaauaugcgaaacugccccuguuaacgcaaucgaugccgagaugcaugaccuuaauuguuccuacaacauuugcccauauugugcuucacgcuugaccagugacgggcuggcaagacacgugacacagugccccaaaaggaaggagaaagucgaagagaccgaacuauaccucaaucuggagcggaucccuuggauagugcgcaaacuucugcaaguaagcgaaucuacgggaguugccuugaaacgauccucauggcucauugugcuguuaguccugcucacugugagccuuaguccagugcagucugcuccggucggccacggcaagacaaucgagaccuaccagacuagagagggguuuacauccaucugucuguucauguugggaagcauucuauuuaucguuucgugccuggugaagggucucguagauucuguguccgacucauucuuucccggccugagugucuguaggaccugcagcauuggguccauaaacggauucgaaaucgagucucauaaauguuauugcagccuuuucugcuguccuuacugccggcacuguucagccgaucgugaaauucaucagcugcacuugaguaucugcaagaaacgcaagacgggcuccaaugugaugcucgcgguuuguaaaagaaugugcuuuaaggcaaccaucgaggccagcaggcgggcucuguucauucgaucuauaaucaacacaacuuuugugaccuguauuuuaacacuggccaucugcgucgugucaaccagugcaguagaaauggaggaccuaccagcugguacuugggagcgcgaagaggaucucacaaauuucugucaccaagaaugccagguuaccgagacugaaugucugugccccuaugaggcccuuguguugagaaagccucuguuucucgacagcauugucaaagggaugaagaaccugcuuaauuccacgucucuggagacaucguugagcaucgaagcgccauggggcgccauaaacgugcaguccaccuucaaacccacugucucaaccgcaaacaucgcucucaguuggucuagcguggagcauaggggaaauaagauucugguuacaggccgguccgaaucaaucaugaaauuagaggagcgcaccggggugagcugggaucugggaguagaagacgccucugaguccaagcuacucacugucaguauuauggaucugagccaaauguacucuccgguguuugaauaucuuuccggugacagacagguugaggaauggccuaaggcuacaugcacgggcgagugucccgagaggugcggguguaccucaaguacuugcuugcacaaagaauggccacauagccguaacuggcgguguaauccuacauggugcuggggagugggcaccgguuguacaugcuguggggucgaugugaaggaccuguucacugaccacauguuuaucaaauggaagguagaguacauaaaaaccgaagccauugugugcguugagcucacgucgcaggaacgacaguguucccugaucgaggcaggcaccagauucaacuuaggacccgucacaauuacucugucugagccaaggaauauccaacagaaacuucccccugaaauaaucaccuugcauccaaagauugaggaaggcuuuuucgaucucaugcacgugcagaaggugcugagcgccucaacagucugcaagcuacagaguugcacucacgggaucccgggagaccugcaaauuuaucauaucgguaaccuccugaaaggcgaucgcguuaaugggcaccuuauacauaagauugagccccacuuuaacaccuccuggaugucuugggacggaugugauuuggacuacuacugcaauaugggcgauuggccuagcuguacguauacaggugugacccagcacaaccaugcugcguucgugaaucuguuaaacaucgaaacugacuacacaaaaaccuuccacuuucauuccaagcggguaacugcacacggggauaccccacagcucgaccugaaagccagacccacauauggcgcuggagagaucacgguccuuguggagguugccgauauggaacugcauaccaagaagguggaggucucaggcuugaaauucgcaagccucgccugcacuggguguuacgcuugcaguucuggaauuuccuguaaggugaggauccacguugacgaaccugaugagcugacagugcacguaaaaagcucggacccagacgucguggccgcaucaaccucucuaauggcgcgcaagcuggaguuuggcacagauaguacuuucaaggcuuuuuccgccaugcccaagaccagccucugcuucuauauuguggaacgagaguacuguaagucuugcagcgaagacgauacgaaaaagugugucgacacaaaacuggagcagccgcaauccauacuuaucgaacauaaggguaccauuaucgggaaacagaaugauacuugcaccgcaaaggccucaugcugguuggagaguguuaagagcuuuuucuauggacugaaaaacauguuaggcucuguguuugguaauuucuuuguaggcauucuccuguuccuugcuccuuuugugcugcuaguccucuucuucauguuuggguggaagauccuguucuguuuuaaaugcugucggcguacaagaggauuguucaaguacaggcaccugaaagacgaugaggaaacuggcuaccgccggauaaucgagagauuaaacuccaagaaggggaaaaacaggcuccuggacggagaacgacuugccgaucgcaagauugcagagcuguuuucaaccaaaacacauaucggc

SEQ ID NO: 10503 - RNA, 3495 nt, Artificial Sequence
  derived and/or modified CDS sequence (opt3) from CCHVF(CCHVF 52-R-2014)__KR814862.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacacuucaugcgaggucaugauaccgaagggcacaggggauauccucguggacuguagcggaggucagcaacacuuccugaaagauaaccuuauugaccugggcugcccccauguuccuuugcucgggaagauggccaucuacauuuguaggaugaguaaucacccacggaccacgauggcguuucuguucugguuuuccuucggauaugugaucacuugcauauuuugcaaagcucuguucuacucucucauuaucauuggcaccuuagguaagaaaaucaagcaguaucgcgaacugaagccccagacauguacuaucugcgagaccgccccugucaacgcaauugaugccgagaugcaugaccuuaauuguagcuacaacauaugcccauauugugcuuccagauugacaucagacgggcuggcaaggcacgugccccagugcccuaaacggaaggaaaaaguagaggaaaccgagcuauaccucaaucuggaacgcaucccauggauuguucgaaaacuucugcaagugagugagagcacgggagucgccuugaaaagaucuuccuggcucaucgugcuguuagugcugcucacugucucacuuagcccgguucagagugcucccgugggccacggcaagacaauagagaccuaccagacuagggaaggguuuacaucuguaugucuguucauguugggauccauucuauuucuggugagcugccucgucaaaggucugguggauucgguuucugacuccuucuuuccuggccuuucaguguguaagaccugcaguaucgggagcaucaacggauucgagauugaaucccauaaguguuauugcucucuguucugcuguccauacugccggcacuguagcgccgaucgugagauccaucaguugcaccucucaauuugcaaaaagcgcaaaaugggcaguaaugucaugcuggcgguguguaagagaaugugcuuuagggcaacgauagaagccucccggcgagcuuuacugauccgcagcauuaucaacaccacauucguaaucuguauucuaacucucaccauaugcguugugucuacaucagccgucgagauggagaaucugcccagugguacuugggaaagagaggaagaccuuaccaacuuuugucaccaagagugccaggugacagaaaccgaguguuugugcccuuaugaggcacugguccucaggaaaccacuguuccuugauagcaucgugaaggggaugaagaaucuguugaacuccacuucucucgaaacgucgcugagcauugaggcucccuggggcgccaucaacguucaguccacauuuaaaccgaccgugucaacugcgaauauugccuuaaguuggucuagcguagaacaucggggaaacaagauccuggucaccggccgcuccgagucaauaaugaaacuagaggaaagaacaggggugagcugggaccucggaguugaugacgcaucugaguccaagcugcuuaccgugaguaucauggauuugagccaaauguacucuccugucuucgaauaucuguccggugaccgucagguggaggaauggcccaaagcuacuugcacaggcgauuguccagagaggugcggguguacgucaaguaccugccuccacaaggaguggccucauagccggaauuggcgauguaaccccacuuggugcuggggaguaggcacagguuguaccugcugugggguggacguuaaggaccuguuuacagaucacauguucgucaaauggaagguggaauacauuaaaacugaggccaucgugugcgucgaauuaaccucgcaggagagacaguguucccugauugaagcuggcacgagguuuaaucuuggaccaguuaccaucacauugucugagccccgcaacauacaacagaagcucccuccagagauuaucacucugcauccgaaaguggaagagggcuucuuugaccuaaugcacgugcagaagguacugagcgccucaaccgucugcaagcuccagaguugcacacacgggauucccggagaucugcaaguguaucauaucgguaaucuuuugaaaggcgaccggguuaacgggcaccugauacauaagaucgaaccucacuucaauacuuccuggaugucuugggauggaugugacuuagauuacuacugcaacaugggcgacuggccaagcuguaccuauacgggugugacacagcacaaucaugcagccuuugucaaccuccugaauauugagaccgauuacacuaaaacauuccacuuccauuccaagagagugaccgcucacggggacacuccccagcuugaucugaaagcgaggccuaccuauggcgcaggagaaaucacaguuuugguggagguagccgacauggagcuccauacgaagaaagucgaaauuucaggccugaaguuugcuagccuagccugcaccggguguuacgcaugcaguucuggaaucuccuguaaggugcgcauacacguggaugagccagacgaacugacuguccacguuaaaagcaacgaccccgaugugguagccgcuucgacaucacucauggcccgaaagcuggaguucggcaccgacucuacauuuaaagcauucagugcgaugccgaagacuucccuuugcuuuuauauuguggagcgggaauacuguaaaagcugcucugaggaagauacccagaagugugucgacacgaaguuggagcaaccucagagcauccugaucgaacauaaagguacaauuaucgggaagcagaaugauaccugcacugcuaaagccggaugcugguuagaguccgugaagucauucuuuuauggccucaaaaacaugcuggguaguguuuucggcaacuuuuucauugggauacuucuguuucuagcaccauucgugcuccuggucuuguuuuucauguucggauggaagauccuguuuuguuucaagugcugucguagaaccaggggcuuacucaaauaccgccugcuuaaggacgaugaggaaacaggguaccggagaauuaucgagaggcugaauaacaaaaagggaaagaaucgauugcucgacggcgaacgccuggccgaucggaagauugcugagcuauuuagcacuaagacccacaucggu

SEQ ID NO: 10504 - RNA, 3495 nt, Artificial Sequence
  derived and/or modified CDS sequence (opt3) from CCHVF(CCHVF 75-R-2012)__KR814863.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccgcaccaguuaagugucgacaggguuuuugcuuaaaaaucacacaggaggggcguggacaugugaagcugucuagaggcucggaaguagugcuagaugccugugacucaagcugcgaggucaugauaccgaagggcaccggggauauccucguggacuguaguggaggucagcaacacuuccugaaagauaaccuuauugaccugggcugcccccauaucccuuugcucgggaagauggcgauuuacaucuguaggauguccaaucacccacggacuacaauggcuuuucuguucugguuuucuuucggauauguuauaaccugcaucuuuugcaaagcccuguucuacagccucauuauuaucggcacguuagguaagaaaaucaagcaguaucgcgaacugaagccccagacuuguaccauuugcgagacagcaccugugaacgccauagaugcugagaugcaugaccuuaauuguuccuacaacaucugcccauauugugcaucaagauugacuucugacgggcuggccaggcacgucccccagugcccuaaacggaaggaaaaaguggaggaaaccgagcuauaccucaaucuggaacgcauuccauggaucguacgaaaacuucugcaaguuagcgagucuacaggaguggcuuugaagagauccucauggcucauaguccuguuagugcugcucaccgugagccuuaguccgguccagucugcccccguuggccacggcaagacgauugagacuuaccagacaagggaaggguuuaccuccaucugucuguucauguugggaagcauccuauuucuggugucgugccucguaaaaggucuggugaacucugucuccgauucauucuuuccuggccuuaguguguguaagacuugcagcauuggguccaucaauggauucgagauugaaucucauaaguguuauugcagccuguucugcuguccauacugccggcacuguucagcggaccgugagauacaucaguugcaccucaguaucugcaaaaagcgcaaaacaggcuccaacguuaugcuggcaguguguaagagaaugugcuuuagggccaccauugaagcuagccggcgagccuuacugauccgcucuaucauuaauacgaccuucgucauauguauccuaacacucacuauuugcgugguaucaaccagugcaguugagauggagaaccugcccagcgguacaugggaaagagaggaagaucuuacuaauuuuugucaccaagagugccaggugaccgaaacagaguguuugugcccuuaugaggcucugguccucaggaaaccacuguuccuugacuccaucgugaaggggaugaagaaccuguugaacucuaccucgcucgaaacuagccuguccauugaggcccccuggggcgcgaucaauguccagucaacguuuaaaccgacagugaguaccgccaacauagcauuaucuuggagcuccguugaacaucggggaaauaagauccuggugacuggccgcucagagagcauuaugaaacuagaggaaagaaccgggguaucuugggaucucggagucgaggacgcuuccgaaaguaagcugcuuacagugagcaucauggauuugucucaaauguacuccccuguuuucgaguaucugucaggugaccgucagguggaagaguggcccaaagcuaccugcacuggcgauuguccagagaggugcggguguacaaguagcacgugccuccacaaggaauggccucauucgcggaacuggcgauguaaucccaccuggugcuggggagucggcacugguuguacaugcugugggguggacguaaaggaucuguuuaccgaccacauguucgugaaauggaagguugaguacauuaaaacagaagccaucgucugcguggaguuaacuucccaggaaagacaguguucucugauagaggccggcaccagguuuaaccuuggaccagugacgauuaccuugagcgagccccgcaauauccaacagaagcucccuccagaaauuaucacacugcauccgaaagucgaggaaggcuucuuugaccuaaugcacguucagaaggugcugucagcaaguacugugugcaagcuccaguccugcacccacgggauacccggagaucugcaaguauaucauaucgguaaccuuuugaaaggcgaccgggucaaugggcaccugauucauaagaucgagccucacuucaacacaucuuggaugagcugggauggaugugacuuagauuacuacugcaauaugggcgacuggccauccuguacuuauaccggugugacgcagcacaaccaugccgcuuuuguuaaucuccugaacauugaaacagauuacaccaaaacuuuccacuuccauucaaagagagugacagcgcacggggacacuccccagcuugaucugaaagcaaggccuacuuauggcgccggagagaucaccgucuugguggagguugcugacauggaacuccauacaaagaaaguggagauaagcggccugaaguuugccagucuagcaugcacgggguguuacgccugcaguuccggaauuagcuguaagguacgcauccacgucgaugaaccagacgagcugaccgugcacgugaaaucgucagaucccgacgucguugcugccucuaccagucucauggcacgaaagcuggaguucggcacagacuccaccuuuaaagcguucagcgcuaugccgaagacaucucuuugcuuuuauaucguggaacgggaguacuguaaaagcugcuccgaagaggauacucagaaguguguagacaccaaguuggaacaaccucagucaauucugaucgagcauaaagguacgauuauagggaagcagaaugauacaugcaccgccaaagcaaguugcugguuagagagcgugaagucuuuccucuauggacugaaaaacaugcuuggcuccgucuuugguaacuucuuuaucggcauucugcuauuccucgccccauuugugcuguugguucuguucuuuauguucggguggaagaucuuauucuguuuuaagugcugucguagaacuaggggacuccugaaauaccgccuucugaaggacgaugaagagaccggcuaccggagaauuaucgaaagguugaauaacaaaaaggggaaaaaucgacuccuggacggagagcgccuagcugaucggaagauagccgaacuguucucaacaaagacucacaucggc

SEQ ID NO: 10505 - RNA, 3495 nt, Artificial Sequence
  derived and/or modified CDS sequence (opt3) from CCHVF(CCHVF 75-ST-2010)__KR814864.1__Gn-NSm-Gc
agcgaggaauccggcgacgauugcaucucuagaacccagcugcucaggacagagacugccgaaauucacgacgauaacuacgggggacccggugacaagauaacgaucuguaauggcucaaccauuguggaucaacggcuugggagugagcugggaugcuauacaaucaaccgcgucaagagcuucaaguugugugaaaauuccgcuacuggcaaaaccugcgagauugacucuacaccuguuaagugucgacaggguuuuugcuuaaaaaucacccaggaggggcguggacaugugaagcugucgagaggcucagaaguagugcuagaugcaugugacagcaguugcgaggucaugauaccaaagggcacuggggauauccucguggacuguuccggaggucagcaacacuuccugaaagauaaccuuauugaccugggcugcccgcauauccccuugcucgggaagauggccauuuacaucuguaggaugucuaaucacccucggacaaccauggcguuucuguucugguuuagcuucggauauguuauaacgugccuguuuugcaaagcucucuucuacuccuuaauuaucauuggcacucuggguaagaaaaucaagcaguaucgcgaacuuagaccacagaccuguacaaucugcgagacugcccccgugaacgcaauugaugccgagaugcaugacuugaauuguucauacaacauaugcccuuauugugcuaguaggcugaccagcgacgggcuagcacggcacgucccacagugccccaagcgcaaagaaaagguggaggaaacagagcucuaccugaaucuugaacgaaucccuuggauuguaagaaaacuguugcaaguuucugaguccaccggaguggcccucaagaggucaagcuggcugaucgucuuacuggugcuccuuacggugagucugucuccaguccaguccgcuccgguuggccacggcaaaacuauagagacauaccagacccgggaaggguuuacuagcauuuguuuguucaugcuaggaucgauccuguuucucgugucuugccugguaaagggucuuguggauuccgucucagacaguuucuuucccggccugagcguguguaaaacaugcuccaucgggucuauuaacggauucgagaucgaaagccauaaguguuauugcucauugcucugcuguccuuacugccgucacuguagugccgaucgcgagauucaucagcugcacuuauccauaugcaagaaaagaaagaccggcagcaauguuaugcuggcgguguguaaaaggaugugcuuccgggcaacgaucgaagccucucgacgcgcucuacucauuagaucaaucaucaacaccacauuugucauuuguauacugacucuuaccaucugcgugguaaguacaagcgccguugagauggagaauuugccauccgguacuugggaaaaggaggaagaccugaccaacuucugucaccaagagugccaggugacagaaaccgagugucucugccccuaugaggcacugguccuuaggaaaccucuguuuuuggauucuauugugaaggggaugaagaaucuccugaacucgacuagcuuagaaacgucccugucaaucgaggcuccauggggcgccauuaacguccagaguacauucaaacccaccgugucuacugcgaauaucgcccuaagcugguccucaguugaacaucggggaaacaagauacucgugaccggccgcagcgagucuaucaugaaacuggaggaaagaacagggguauccugggaccuuggagucgaggaugcaagugaaagcaaguugcugaccgugucuauuauggaccucucccaaauguacucaccgguuuuugaguaucugaguggugaucgucagguggaagaguggccuaaagcuacuugcacaggcgacugucccgagaggugcggguguacgagcucgaccugcuuacacaaggaauggccacauucccggaauuggcgauguaacccuacuuggugcuggggagucggcacagguuguaccugcugugggguggauguaaaggaccuguucacagaccacauguuugugaaauggaagguugaguacaucaaaacugaagccauugucugcguggagcuuaccucucaggaaagacaguguagcuugaucgaggcuggcacgagguucaaucucggacccgugaccauaacacugucagagccacgcaacauucaacagaagcuacccccugaaaucauuacucugcauccaaaagucgaggaaggcuuuuucgaucucaugcacguucagaaggugcugagugccuccaccgugugcaaacuucagucuugcacacacgggaucccgggagacuugcaaguauaucauauagguaaucuguuaaaaggcgaucgggucaacgggcaccucauccauaagauugagccccacuuuaauacuagcuggauguccugggacggaugugaucuggacuacuacugcaacaugggcgauuggccuucauguaccuauacgggugugacacagcacaaucaugcagccuucguuaaccuucugaauaucgaaaccgacuacacuaaaacauuucacuuccauagcaagagagugaccgcucacggggauacuccacaguuggaccucaaagcgaggcccaccuauggcgcaggagagauuacaguccugguggagguugccgauauggaacuacauacgaagaaaguggagaucaguggccugaaguucgcuucucucgccugcaccggguguuacgcaugcuccagcggaauaucguguaagguacgcauucacgucgacgaaccugaugagcugacugugcacgugaaaucaucugacccagacgucguugccgcuaguacaucccuuauggcccgaaaguuggaguuuggcaccgauagcacauucaaagcauuuucugcgaugcccaagacuagccugugcuucuauaucguggaacgggaguacuguaaauccugcucagaagaggacacccagaaguguguagauacgaaguuagaacaaccgcagaguauccucauugagcauaaagguacaaucauugggaagcagaacgauaccugcacugcuaaagccagcugcuggcuggagucugugaaguccuuuuucuauggacuuaaaaauaugcugggcucagucuuugguaacuucuuuauaggcauccuacucuuccuggcaccuuuuguguugcugguuuuauucuuuauguucggguggaagauucucuucuguuuuaagugcugucguagagccaggggacugcuuaaauaccgccaccugaaggacgacgaagagaccggcuaccggaaaaucauugaaagauugaacaauaagaaagggaagaacaggcuccuggauggagagcgacuagcugaccgcaagaucgccgaacuguucaguacaaaaacucauauaggc

SEQ ID NO: 10506 - RNA, 3495 nt, Artificial Sequence
  derived and/or modified CDS sequence (opt3) from CCHVF(CCHVF 81-R-2014)__KR814865.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaaaagauccucauggcucauaguccuguuagugcugcucacggugagccuuaguccgguccagucugcucccguuggccacggcaagacuauugagacauaccagaccagggaaggguuuacuuccaucugucuguucauguugggaagcauccuauuucuggugucgugccucguaaaaggucugguggauucugucuccgacucauucuuuccuggccuuaguguguguaagacaugcagcauuggguccaucaacggauucgagauugaaucucauaaguguuauugcagccuguucugcuguccauacugccggcacuguucagccgaucgugagauacaucaguugcaccucaguaucugcaaaaagcgcaaaaccggcuccaauguuaugcuggcgguguguaagagaaugugcuuuagggcaacgauugaagccagccggcgagcuuuacugauccgcucuaucauuaacaccacauucgucauauguauccuaacucucaccauuugcgugguaucaacaagugccguugagauggagaaucugcccgcagguacuugggaaagagaggaagaccuuaccaacuuuugucaccaagagugccaggugacagaaaccgaguguuugugcccuuaugaggcucugguccucaggaaaccacuguuccuugauagcaucgugaaggggaugaagaaucuguugaacuccacuucucucgaaacgucgcugagcauugaggcccccuggggcgcgaucaacguccaguccacauuuaaaccgaccgugucaacugccaauauagcauuaaguuggucuagcguugaacaucggggaaacaagauccuggugaccggccgcuccgagucaauuaugaaacuagaggaaagaacagggguaagcugggaccucggagucgaggaugcuucugaauccaagcugcuuaccgugaguaucauggacuugagccaaauguacucuccuguuuucgaguaucuguccggugaucgucagguggaagaguggcccaaagccacuugcacaggcgacuguccagagaggugcggguguacgucaaguaccugccuccacaaggaauggccucauagccggaauuggcgauguaaccccacuuggugcuggggagucggcacagguuguaccugcugugggguggauguaaaggaccuguuuacagaccacauguucgugaaauggaagguugaguacauuaaaacugaagcuaucgucugcguggaguuaaccucgcaggaaagacaguguucccugauagaggccggcacgagguuuaaucuuggaccagugaccauuacauugucugagccccgcaacauccaacagaagcucccuccagaaauuaucacucugcauccgaaagucgaggaaggcuucuuugaucuaaugcacguucagaaggugcugagcgcaucaaccgugugcaagcuccagaguugcacacacgggauacccggagaccugcaaguauaucauaucgguaaucuuuugaaaggcgaucggauuaacgggcaccugauccauaagauugagccucacuucaauacuuccuggaugucuugggacggaugugauuuagacuacuacugcaacaugggcgauuggccaagcuguaccuauacgggugucacacagcacaaucaugccgcuuuugugaaccuccugaauaucgaaaccgacuacacuaaaacauuccacuuccauuccaagagaguuaccgcgcacggggauacuccccagcuugaccugaaagcaaggccuaccuauggcgccggagagauaacaguguuggucgagguggcugauauggaacuccauacgaagaaaguugagauuucaggccugaaguuugccagccuagcaugcaccggguguuacgccugcaguucuggaaucuccuguaaggugcgcauccacguagacgaaccagaugagcugacuguccacgugaaaagcucggaccccgacguggucgcugccucaacaucucucauggcacgaaagcuggaguucggcaccgauaguacauuuaaagcguucuccgcuaugccgaagacuagccuuugcuuuuauauuguugaacgggaguacuguaaaucuugcagcgaagaggacacccagaaguguguggauacgcguuuggaacaaccucaguccauccugauugagcauaaggguacaauaaucgggaaacagaacgauaccugcacugccaaggcaucaugcugguuagagaguguaaagagcuucuuuuauggacucaagaauaugcugggcucuguguucgguaacuuuuucauuggcauccuucuguuucuagccccauucguccuccugguguuguuuuucauguucggguggaaaauucuguuuuguuucaagugcuguagaaggacccgcggauuacucaaguaccggcaccugaaagacgacgaagagacaggcuacagaaggaucauagaacgacuuaacaauaagaaagggaagaaccgccuguuggauggagagcggcucgcugacagaaaaaucgccgaacuguuuuccacuaagacccauauuggc

SEQ ID NO: 10507 - RNA, 3495 nt, Artificial Sequence
  derived and/or modified CDS sequence (opt3) from CCHVF(CCHVF 3756-ST-2007)__KR814866.1__Gn-NSm-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuacagccucauuaucaucggcacuuuagguaaaaagauuaagcaguaucgggaacugaaaccccagaccuguacaauaugcgagacugccccuguuaacgcaaucgaugccgagaugcaugaccuuaauuguuccuacaacauuugcccauauugugcuucacgcuugaccagugacgggcuggcaagacacgugacacagugccccaagaggaaagaaaaggucgaggaaaccgagcuauaccucaaucuggaacggaucccuuggauagugcgcaaacuucugcaaguaagcgagucuacgggaguugccuugaagcgauccucauggcucauugugcuguuaguccugcucacugugagccuuaguccagugcagucugcuccggucggccacggcaaaacaaucgagaccuaccagacuagagaaggguuuacauccaucugucuguucauguugggaagcauucuauuuaucguuucgugccuggugaagggucucguagauucuguguccgacucauucuuucccggccugagugucuguaagaccugcagcauuggguccauaaacggauucgagaucgaaucucauaaauguuauugcagccuuuucugcuguccuuacugcaggcacuguucagccgaucgggagauucaucagcugcacuugaguaucugcaagaaacguaagacgggcuccaaugugaugcucgcgguuuguaaacgcaugugcuuuaaggcaaccaucgaagccagcagaagggcucuguuaauucggucuauaaucaacacaacuuucgugauuuguauccugacccuagccauuugcgucgugucaacaagugcaguagagauggaggaccucccagcugguacuugggaacgagaggaagaucugaccaauuuuugucaccaagagugccagguuacagaaaccgagugucuuugccccuaugaggccuuggugcugcgcaagccucucuuccuggacagcaucgucaaagggaugaagaaccuuuuaaauuccacuucuuuggaaacgucgcucagcauagaggcgccauggggcgccaucaacgugcaguccacauuuaaacccaccgucucaacugcaaacauugcucugaguuggucuagcguggaacauagaggaaauaagaucuuaguuaccggcagguccgagucaauuaugaaacuggaggaacggacaggggugagcugggaucuaggaguagaggacgccucugaauccaagcuccugaccgucaguaucauggaucuuagccaaauguacucuccgguguucgaguauuuguccggugaccgccagguugaagaguggccuaaggcuacuugcacaggcgauugucccgagagaugcggguguacgucaaguaccugccugcacaaagaauggccacauagcaggaacuggcguuguaauccuacuuggugcuggggagugggcacagguuguaccugcuguggggucgacgugaaggaccucuuuacagaucacauguucauaaaauggaagguagaguacauuaaaacugaagccaucgugugcguugagcugaccucgcaggaacggcaguguuccuuaauugaggcaggcacgcgauuuaaccugggacccgucaccaucacacuuucugagccaagaaauauacaacagaaguugcccccugaaaucauuacucuccauccaaagaucgaggaaggcuucuuugaccugaugcacgugcagaaagugcuaagcgccucaaccgucugcaagcugcagaguugcacacacgggauuccgggagaucuccaaaucuaucauauagguaaccugcuuaaaggcgacaggguuaaugggcacuugauucauaagaucgagccccacuucaacacuuccuggaugucuugggauggaugugaccuggauuacuacugcaauaugggcgacuggccuagcuguaccuauacgggugugacacagcacaaccaugcugcguuugugaauuuacucaacaucgaaaccgauuacacuaaaacauuccacuuccauuccaagcgcguaaccgcacacggggacacuccacagcuggaucuuaaagcccggcccaccuauggcgcuggagagauuacaguccugguggagguugccgacauggaauugcauacgaagaagguggagaucucaggccucaaauuugcaagccugaccugcacuggguguuacgccugcaguucuggaauuuccuguaaggucagaauacacguggaugaaccugacgagcuaacaguucacgugaaaagcucggacccagauguagucgcugccucaaccucucugauggcaaggaagcucgaguucggcacagacaguacuuuuaaagcguucuccgcuaugcccaagaccagccugugcuuuuauaucguggaacgcgaguacuguaagucuugcagcgaagaugacacgaaaaaguguguggauacaaaacuugagcagccgcaauccauuuugaucgaacauaaggguaccauuaucgggaaacagaaugacacuugcaccgccaaggcaucaugcuggcuggagagugucaagagcuucuuuuauggacugaaaaacaugcucggcucuguuuucgguuccuuuuucgugggcauacugcuuuuucugacaccuuucguacuacucgugcuguuuuucauguucggguggaagaucuuguuuuguuucaaaugcugucgacggacucguggacuguuuaaguacagacacuuaaaagaugacgaggaaaccggcuacaggcgcauuaucgagcggcucaauucaaagaaggggaaaaacagacugcuugauggagaaaggcuggccgaccgaaagauugcugaguuguucaguacaaaaacgcauaucggc

SEQ ID NO: 10508 - RNA, 3495 nt, Artificial Sequence
  derived and/or modified CDS sequence (opt3) from CCHVF(CCHVF 3809-ST-2007)__KR814867.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaagagauccucauggcucauaguccuguuagugcugcucacggugagccuuaguccgguccagucugcucccguuggccacggcaagacuauugagacauaccagaccagggaaggguuuacuuccaucugucuguucauguugggaagcauccuauuucuggugucgugccucguaaaaggucugguggauucugucuccgacucauucuuuccuggccuuaguguguguaagacaugcagcauuggguccguuaacggauucgagaucgaaucucauaaguguuauugcagccuguucugcuguccauacugccggcacuguucagccgaucgugagauucaucaguugcaccucagugugugcaaaaagcgcaaaaccggcuccaaugucaugcuggcgguguguaagagaaugugcuuuagggcaacgauagaagccagccggcgagcuuuacugauccgcucuauuaucaacaccacauucguaaucuguauucuaacucucaccauaugcguugugucaacaagugccgucgagauggagaaucugcccgcagguacuugggaaagagaggaagaccuuaccaacuuuugucaccaagagugccaggugacagaaaccgaguguuugugcccuuaugaggcucugguccucaggaaaccacuguuccuugauagcaucgugaaggggaugaagaaucuguugaacuccacuucucucgaaacgucgcugagcauugaggcccccuggggcgcgaucaacguucaguccacauuuaaaccgaccgugucaacugccaauauugcauuaaguuggucuagcguagaacaucggggaaacaagauccuggucaccggccgcuccgagucaauaaugaaacuagaggaaagaacaggggugagcugggaccucggaguugaggaugcuucugaauccaagcugcuuaccgugaguaucauggacuugagccaaauguacucuccugucuucgaguaucuguccggugaucgucagguggaagaguggcccaaagccacuugcacaggcgacuguccagagaggugcggguguacgucaaguaccugccuccacaaggaauggccucauagccggaauuggcgauguaaccccacuuggugcuggggaguaggcacagguuguaccugcugugggguggauguuaaggaccuguuuacagaccacauguucgucaaauggaagguggaguacauuaaaacugaagcuaucgugugcgucgaguuaaccucgcaggaaagacaguguucccugauugaggccggcacgagguuuaaucuuggaccaguuaccaucacauugucugagccccgcaacauacaacagaagcucccuccagaaauuaucacucugcauccgaaaguggaggaaggcuucuuugaucuaaugcacgugcagaagguacugagcgcaucaaccgucugcaagcuccagaguugcacacacgggauucccggagaccugcaaguguaucauaucgguaaucuuuugaaaggcgaucggguuaacgggcaccugauacauaagaucgagccucacuucaauacuuccuggaugucuugggacggaugugauuuagacuacuacugcaacaugggcgauuggccaagcuguaccuauacgggugugacacagcacaaucaugccgcuuuugucaaccuccugaauauugaaaccgacuacacuaaaacauuccacuuccauuccaagagagugaccgcgcacggggauacuccccagcuugaccugaaagcaaggccuaccuauggcgccggagagaucacaguuuugguggagguagcugauauggaacuccauacgaagaaagucgagauuucaggccugaaguuugccagccuagcaugcaccggguguuacgccugcaguucuggaaucuccuguaaggugcgcauacacguggacgaaccagaugagcugacuguccacguuaaaagcucggaccccgacgugguagcugccucaacaucucucauggcacgaaagcuggaguucggcaccgauaguacauuuaaagcguucuccgcuaugccgaagacuagccuuugcuuuuauauuguggaaaaagaguacugucggucuugcagcgaagaggacacccagaagugugucgauacgaaguuggaacaaccucaguccauccugaucgagcauaaagguacaauuaucgggaagcagaacgauaccugcacugccaaagcaucaugcugguuagagaguguuaagagcuucuuuuauggacucaaaaauaugcugggcucuguguucgguaacuuuuucauuggcauacuucuguuucuaaccccauucgugcuccuggucuuguuuuucauguucggguggaagauccuguuuuguuucaagugcugucguagaacaaggggauuacucaaauaccgccaccugaaggacgacgaagagacuggcuaccggagaauuaucgaaaggcuuaacaauaaaaaggggaaaaaccgacuguuggauggagagcgccucgccgaccggaagauugcugaacuguuuuccaccaagacacauaucggc

SEQ ID NO: 10509 - RNA, 3495 nt, Artificial Sequence
  derived and/or modified CDS sequence (opt3) from CCHVF(CCHVF 3820-ST-2007)__KR814868.1__Gn-NSm-Gc
agcgaggaacccggcgacgauugcaucuccagaacccagcugcucaagacagagacugccgaaauucacgacgauaacuacgggucuccuggagacaaaauaacgaucuguaaugguucaaccauuguggaucaaaggcuuggcagugagcuggggugcuauacaaucaaccgggucaagagcuucaaauugugugaaaauuccgcuacuggaaagaccugcgagauugacucuacaccaguuaaaugucgccagggcuuuugcuuaaagaucacccaggagggucgagggcaugugaagcugucgcguggaucagaaguagugcuagaugcaugugacagcaguugcgagauaaugaucccgaaaggcacuggcgauauucucgucgacuguuccgggggacagcaacacuuccugaaggauaaccuuaucgaccuggguugcccccauauuccuuugcucggcaaaauggccaucuacauauguagaaugucuaaucacccaaggacaaccauggcguuucuguucugguuuagcuucggguaugugauuacgugcaucuuuugcaaggcucuguucuacucccucauuaucaucggaacuuuaggcaaaaagauuaagcaguaucgggaacugaaaccccagaccuguacaauaugcgagacugccccuguuaacgcaaucgaugccgagaugcaugaccuuaauuguucauacaacauuugcccauauugugcuagucgcuugaccagcgacggucuggcaagacacgugacacagugccccaagaggaaagaaaaggucgaggaaaccgagcuauaccucaaucuggaacggaucccuuggauagugcgcaaacuucugcaaguaucugaguccacggggguugccuugaagcgaucaagcuggcucauugugcuguuaguccugcucgcugugagucuuucuccagugcaguccgccccggucggacacggcaaaacuaucgagacauaccagaccagagaaggcuuuacuagcaucugucuguucauguuggggucgauucuauuuaucguuucuugccuggugaagggacucguagauuccgugucagacaguuucuuucccggucugagcgucuguaagacaugcuccauuggcucuauaaacggguucgagaucgaaagccauaaauguuauugcucacuuuucugcuguccuuacugcaggcacuguagugcggaucgggagauucaucagcugcacuuguccaucugcaagaaacguaagaccggaagcaaugugaugcucgcaguuuguaaacgcaugugcuuuaaggccacgaucgaagccucuagaagggcccuguuaauucggucaauaaucaacaccacauucgugauguguauucugacucuagcaaucugcgucgugaguaccagcgcuguagagauggaggaccucccagccggcacaugggaacgagaggaagaucugacuaauuuuugucaccaagagugccagguuaccgaaacagagugucuuugccccuaugaggcguuggugcugcgcaagccucucuuccuggacuccauugucaaagguaugaagaaccuuuuaaauucuaccucguuggaaacuagccucuccaucgaggccccauggggcgcaauaaacgugcagucaacguuuaaacccacagucaguaccgcuaacaucgcccugucuuggagcuccguggaacauagagggaauaagauuuuaguuacuggaaggucagagagcaucaugaaacuggaggaacggaccggcgugucuugggaucuagggguagaggacgcuuccgaaaguaagcuccugacagucagcauuauggaucuuucucaaauguacuccccgguguucgaguauuugucaggagaccgccagguugaagaguggccuaaggcuaccugcacuggugauugucccgagagaugcggcuguacaaguagcacgugccugcacaaagaauggccacauucgaggaacuggcguuguaauccuaccuggugcuggggaguggggacuggcuguacaugcuguggugucgacgugaaggaccucuuuaccgaucacauguucaucaaauggaagguagaguacauaaaaacagaagcaauugugugcguugagcugacuucccaggaacggcaguguucuuuaaucgaggccgggacccgauuuaaccugggccccgucacgauuacccuuagcgagccaagaaauauccaacagaaguugcccccugaaauaaucacacuccauccaaagauugaggaaggauucuuugaccugaugcacgugcagaaagugcuaucagcuaguacugucugcaagcugcaguccugcacccacggcaucccgggggaucuccaaauuuaucauaucggaaaccugcuuaaaggugacaggguuaauggccacuugauacauaagauugagccccacuucaacacaucuuggaugagcugggaugggugugaccuggauuacuacugcaauaugggagacuggccuuccuguacuuauaccggcgugacgcagcacaaccaugcggcauuugugaauuuacucaacaucgaaacagauuacaccaaaacuuuccacuuccauucaaagcgcguaacagcccacggugacaccccacagcuggaucuuaaagcucggcccacuuauggggccggcgagaucaccguccugguggagguugcagacauggaauugcauacaaagaagguggagauuagcggacucaaauuugccagucugacgugcaccggcuguuacgcuuguucuuccgggaucagcugcaaggucaggauucacguggaugaaccugacgagcuaacuguucacgugaaaucgucagacccagauguagucgccgcaucuacaagucugauggcgagaaagcucgaguucggaaccgacuccacauuuaaggcuuucagcgccaugcccaaaacuucucugugcuuuuauauaguggaacgcgaguacuguaagagcugcuccgaagaugacaccaaaaaguguguggauacgaaacuugagcagccgcaaucaaucuugauugaacauaagggcacaaucauugguaaacagaaugauaccugcacugcaaaggccaguugcuggcuggagagcgucaagucuuucuuuuaugggcugaaaaacaugcucggauccguuuucggcucauuuuucguggguauccugcuuuuucuggcuccuuucguacuacucgugcuguuuuucauguucggcuggaagauauuguuuuguuucaaaugcugucgacggacccgugggcuguuuaaguacagacacuuaaaagacgacgaggaaacaggauacaggcgcaucauugagcggcucaauaguaagaagggcaaaaacagacugcuugauggggaaaggcuggccgaccgaaagaucgcagaguuguucagcacuaaaacccauauugga

SEQ ID NO: 10510 - RNA, 3495 nt, Artificial Sequence
  derived and/or modified CDS sequence (opt3) from CCHVF(CCHVF 4495-ST-2008)__KR814869.1__Gn-NSm-Gc
agcgaggaauccggcgacgauugcaucucuagaacccagcugcucaggacagagacugccgaaauucacgacgauaacuacgggggacccggugacaagauaacgaucuguaauggcucaaccauuguggaucaacggcuugggagugagcugggaugcuauacaaucaaccgcgucaagagcuucaaguugugugaaaauuccgcuacuggcaaaaccugcgagauugacucuacaccuguuaagugucgacaggguuuuugcuuaaaaaucacccaggaggggcguggacaugugaagcugucgagaggcucagaaguagugcuagaugcaugugacagcaguugcgaggucaugauaccaaagggcacuggggauauccucguggacuguuccggaggucagcaacacuuccugaaagauaaccuuauugaccugggcugcccgcauauccccuugcucgggaagauggccauuuacaucuguaggaugucuaaucacccucggacaaccauggcguuucuguucugguuuagcuucggauauguuauaacgugccuguuuugcaaagcucucuucuacuccuuaauuaucauuggcacucuggguaagaaaaucaagcaguaucgcgaacuuagaccacagaccuguacaaucugcgagacugcccccgugaacgcaauugaugccgagaugcaugacuugaauuguucauacaacauaugcccuuauugugcuaguaggcugaccagcgacgggcuagcacggcacgucccacagugccccaagcgcaaagaaaagguggaggaaacagagcucuaccugaaucuugaacgaaucccuuggauuguaagaaaacuguugcaaguuucugaguccaccggaguggcccucaagaggucaagcuggcugaucgucuuacuggugcuccuuacggugagucugucuccaguccaguccgcuccgguuggccacggcaaaacuauagagacauaccagacccgggaaggguuuacuagcauuuguuuguucaugcuaggaucgauccuguuucucgugucuugccugguaaagggucuuguggauuccgucucagacaguuucuuucccggccugagcguguguaaaacaugcuccaucgggucuauuaacggauucgagaucgaaagccauaaguguuauugcucauugcucugcuguccuuacugccgucacuguagugccgaucgcgagauucaucagcugcacuuauccauaugcaagaaaagaaagaccggcagcaauguuaugcuggcgguguguaaaaggaugugcuuccgggcaacgaucgaagccucucgacgcgcucuacucauuagaucaaucaucaacaccacauuugucauuuguauacugacucuuaccaucugcgugguaaguacaagcgccguugagauggagaauuugccauccgguacuugggaaaaggaggaagaccugaccaacuucugucaccaagagugccaggugacagaaaccgagugucucugccccuaugaggcacugguccuuaggaaaccucuguuuuuggauucuauugugaaggggaugaagaaucuccugaacucgacuagcuuagaaacgucccugucaaucgaggcuccauggggcgccauuaacguccagaguacauucaaacccaccgugucuacugcgaauaucgcccuaagcugguccucaguugaacaucggggaaacaagauacucgugaccggccgcagcgagucuaucaugaaacuggaggaaagaacagggauuuccugggaccuuggaguagaggaugcaagugaaagcaaguugcugaccgucucuaucauggaccucucccaaauguacucaccgguguuugaguaucugaguggugauaggcagguugaagaguggccuaaagcuacuugcacaggcgacugucccgagcguugcggguguacgagcucgaccugcuuacacaaggaauggccacauucccggaauuggcgauguaacccuacuuggugcuggggagugggcacagguuguaccugcuguggggucgaugugaaggaccuguucacagaccacauguuuguaaaauggaagguggaguacauuaaaacugaagccaucguuugcgucgagcuuaccucucaggaaagacaguguagcuugauagaggcuggcacgagguucaaucucggacccgugaccauuacacugucagagccacgcaacauccaacagaagcuacccccugaaauuaucacucugcauccaaaaguggaggaaggcuuuuucgaucucaugcacguccagaagguucugagugccuccaccgugugcaaacuucagucuugcacacacgggauaccgggagacuugcaaguguaucauaucgguaaucuguuaaaaggcgaucggguaaacgggcaccucauucauaagaucgagccccacuuuaauacuagcuggauguccugggacggaugugaucuggacuacuacugcaacaugggcgauuggccuucauguaccuauacgggugucacacagcacaaucaugcagccuucgugaaccuucugaauauugaaaccgacuacacuaaaacauuucacuuccauagcaagagaguuaccgcucacggggauacuccacaguuggaccucaaagcgaggcccaccuauggcgcaggagagaucacagugcuggucgagguggccgauauggaacuacauacgaagaaaguugagauaaguggccugaaguucgcuucucucgccugcaccggguguuacgcaugcuccagcggaauuucguguaaggugcgcauccacguagacgaaccugaugagcugacuguccacgugaaaucaucugacccagacguggucgccgcuaguacaucccuuauggcccgaaaguuggaguuuggcaccgauagcacauucaaagcauuuucugcgaugcccaagacuagccugugcuucuauaucguugaacgggaguacuguaaauccugcucagaagaggacacccagcguuguguggauacgaaguuagaacaaccgcagaguauucucaucgagcauaaggguacaauuauagggaaacagaacgauaccugcacugcuaaggccagcugcuggcuggagucuguaaaauccuuuuucuauggacuuaagaauaugcugggcucaguguuugguaacuucuuuaucggcauucuacucuuccuggcaccuuuugucuugcugguguuauucuuuauguucggguggaaaauccucuucuguuuuaagugcuguagaagggcccgcggacugcuuaaguaccggcaccugaaagacgacgaagagaccggcuacagaaagauuaucgaaagguugaacaauaaaaaggggaaaaaccgacuccuggauggagagcgccuagcugaccggaagauagccgaacuguucaguacaaagacucauaucggc

SEQ ID NO: 10511 - RNA, 3495 nt, Artificial Sequence
  derived and/or modified CDS sequence (opt3) from CCHVF(CCHVF 4691-ST-2009)__KR814871.1__Gn-NSm-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuacagccucauuaucaucggcacuuuagguaaaaagauuaagcaguaucgggaacugaaaccccagaccuguacaauaugcgagacugccccuguuaacgcaaucgaugccgagaugcaugaccuuaauuguuccuacaacauuugcccauauugugcuucacgcuugaccagugacgggcuggcaagacacgugacacagugccccaagaggaaagaaaaggucgaggaaaccgagcuauaccucaaucuggaacggaucccuuggauagugcgcaaacuucugcaaguaagcgagucuacgggaguugccuugaagcgauccucauggcucauugugcuguuaguccugcucacugugagccuuaguccagugcagucugcuccggucggccacggcaaaacaaucgagaccuaccaggccagagaaggguuuacuuccaucugucuguucauguugggaagcauucuauuuaucguuucgugccuggugaagggucucguagauucuguguccgacucauucuuucccggccugagugucuguaagacaugcagcauuggguccauaaacggauucgagaucgaaucucauaaauguuauugcagccuuuucugcuguccuuacugcaggcacuguucagcggaucgggagauucaucagcugcacuugaguaucugcaagaaacgucgcaccggcuccaaugugaugcucgcaguuuguaagagaaugugcuuuaaagccacgaucgaagcuagcaggcgggcccuguuaauucgaucuauaaucaacaccacauucgugauuuguauccugacucuagcaauuugcgucgugucaaccagugcuguagagauggagaaucucccagccgguacaugggaacgcgaggaagaccugacuaacuuuugucaccaagagugccagguuaccgaaacagagugucuuugccccuaugaggcguuggugcugagaaagccucucuuccuggauagcaucgucaaggggaugaaaaaucuucugaacuccaccucuuuggaaacuucgcucagcauagaggccccauggggcgcaaucaacgugcaguccacguuuaagcccgcugucucaacagccaauauugcucugaguuggucuagcguggaacauaggggaaacaaaaucuuaguuaccggccgguccgagucaauuaugaagcuggaggaacgcacuggggugagcugggaccuaggaguagaggaugccucugaauccaaacuccugaccgucaguaucauggaccuuagccaaauguacucuccgguguucgaguauuuguccggugauagacagguugaagaguggccuaaggcaacaugcaccggcgacugucccgagaggugcggguguacuucaaguacaugccugcacaaggaauggccacauagccguaauuggcgguguaacccuacguggugcuggggagugggcaccgguuguacuugcuguggggucgaugugaaagaccucuuuacagaccacauguucauaaaguggaaaguagaguacauuaagaccgaagccaucgugugcguugagcugacaucgcaggaacgacaguguuccuuaauugaggcuggcacuagauuuaaucugggacccgucaccaucacgcuuucugagccaaggaacauacaacagaaauugcccccugaaaucauuacccuccauccaaagaucgaggaaggcuucuuugaucugaugcacgugcagaaggugcuaagcgcgucaacagucugcaaacugcagaguugcacucacgggauuccgggagaccuccaaaucuaucauauagguaaucugcuuaagggcgaucgcguuaacgggcacuugauucauaaaaucgagccccacuucaauaccuccuggaugucuugggacggaugugaucuggacuacuacugcaacaugggcgauuggccuagcuguacauauacuggugugacccagcacaaucaugcagccuuugugaacuuacucaauaucgaaacggacuacacaaagaccuuccacuuccauuccaaacggguaacugcucacggggauacaccacagcuggaccuuaaggccagacccaccuauggcgcaggagagauuacuguccugguggagguugccgauauggaauugcauaccaaaaagguggagaucucaggccucaaguuugcuagccuggccugcacaggguguuacgcaugcaguucuggaauuuccuguaaagucaggauacacguggacgaaccugaugagcuaacgguucacguaaagagcucggacccagacguggucgcggcuucaaccucucugauggcccgcaaacucgaguucggcacugauaguacauuuaaggcauucuccgccaugcccaaaaccagccugugcuuuuauaucguggaacgagaguacuguaagucuugcagcgaagacgauacaaagaaauguguggacacuaaacuugagcagccgcaauccauuuugaucgaacauaaggguaccauuaucgggaagcagaacgauacgugcacagcuaaagccucaugcuggcuggagagugucaagagcuucuuuuauggauuaaagaauaugcucggcucuguuuucgguaacuuuuucgugggcauacugcuuuuucuggcaccuuucguacuacucgugcuguuuuucauguucggguggaaaaucuuguuuuguuucaagugcugucggcguaccagaggacuguuuaaauacaggcacuuaaaggacgaugaggaaacuggcuaccgccggauuaucgagagacucaacuccaaaaaggggaagaauaggcugcuugacggagaacgacuggcugaucgcaaaauugccgaguuguucucaaccaagacacauaucggc

SEQ ID NO: 10512 - RNA, 3495 nt, Artificial Sequence
  derived and/or modified CDS sequence (opt3) from CCHVF(CCHVF 4701-ST-2009)__KR814872.1__Gn-NSm-Gc
agcgaggaacccggcgacgauugcaucuccagaacccagcugcucaagacagagacugccgaaauucacgacgauaacuacgggggaccuggugacaaaauaacgaucuguaauggcucuaccguggucgaucaaaggcuugggucagagcugggaugcuauacaauuaaccggguuaagaguuucaaauugugugaaaauagcgcuacuggcaagaccugcgagaucgacuccacaccagugaaaugucgccaggguuuuugcuuaaagauuacccaggaggggcgaggacauguaaagcugucucguggcucggaagugguccuagaugcaugugacucaagcugcgagaucaugauaccgaaaggcacuggggauauccucguggacuguaguggaggucagcaacacuuccugaaggauaaccuuauugaccugggcugcccccauaucccuuugcucgggaaaauggccauuuacaucuguagaauguccaaucacccaaggacaaccauggcguuucuguucugguuuucuuucggauauguuauaacgugcaucuuuugcaaggcucuguucuacagccucauuauuaucggcacuuuagguaaaaagaucaagcaguaucgggaacugaaaccccagaccuguacaauuugcgagacugccccugugaacgcaauagaugccgagaugcaugaccuuaauuguuccuacaacaucugcccauauugugcuucacgcuugaccagugacgggcuggcaagacacgucacacagugccccaagaggaaagaaaagguggaggaaaccgagcuauaccucaaucuggaacggauuccuuggaucguacgcaaacuucugcaaguuagcgagucuacgggaguggccuugaagcgauccucauggcucauaguccuguuagugcugcucacugugagccuuaguccaguccagucugcuccgguuggccacggcaaaacaauugagaccuaccagacuagagaaggguuuacauccaucugucuguucauguugggaagcauccuauuuauugugucgugccugguaaagggucucguggauucugucuccgacucauucuuucccggccugaguguguguaagaccugcagcaucggguccauuaacggauucgagauagaaucucauaaauguuauugcagccuuuucugcuguccuuacugcaggcacuguucagccgaucgggagauccaucagcugcacuugaguauuugcaagaaacguaagacgggcuccaauguuaugcucgcgguguguaaacgcaugugcuuuaaggcaaccaucgaagccagcagaagggcucuguuaauccggucuauuauaaacacaacuuucgucauguguauccugacccuagccauuugcgugguaucaacaagugcaguugagauggaggaccucccagcugguacuugggaacgagaggaagaucugaccaauuuuugucaccaagagugccaggugacagaaaccgagugucuuugccccuaugaggccuugguccugcgcaagccucucuuccuggacagcaucgugaaagggaugaagaaccuuuuaaauuccacuucuuuggaaacgucgcucagcauugaggcgccauggggcgccaucaacguccaguccacauuuaaacccaccgugucaacugcaaacauagcucugaguuggucuagcguugaacauagaggaaauaagaucuuagugaccggcagguccgagucaauuaugaaacuggaggaacggacagggguaagcugggaucuaggagucgaggacgccucugaauccaagcuccugaccgugaguaucauggaucuuagccaaauguacucuccgguuuucgaguauuuguccggugaccgccagguggaagaguggccuaaggcuacuugcacaggcgauugucccgagagaugcggguguacgucaaguaccugccugcacaaagaauggccacauagcaggaacuggcguuguaauccuacuuggugcuggggagucggcacagguuguaccugcugugggguggacguaaaggaccucuuuacagaucacauguucauuaaauggaagguggaguacaucaaaacugaagccauaguuugcgucgagcugaccucgcaggaacggcaguguuccuuaauugaggcaggcacgcgauuuaaccugggacccgugaccaucacacuuucugagccaagaaauauucaacagaaguugcccccugaaaucauaacucuccauccaaagaucgaggaaggcuucuuugaccugaugcacgugcagaaaguccuaagcgccucaaccguuugcaagcugcagaguugcacacacgggauuccgggagaucuccaaaucuaucauauugguaaccugcuuaaaggcgacagggugaaugggcacuugauccauaagauagagccccacuucaacacuuccuggaugucuugggauggaugugaccuggauuacuacugcaauaugggcgacuggccuagcuguaccuauacgggugugacacagcacaaccaugcugcguuuguaaauuuacucaacauugaaaccgauuacacuaaaacauuccacuuccauuccaagcgcgucaccgcacacggggacacuccacagcuggaucuuaaagcccggcccaccuauggcgcuggagagaucacagugcugguugagguggccgacauggaauugcauacgaagaaggucgagaucucaggccucaaauuugcaagccugaccugcacuggguguuacgccugcaguucuggaauuuccuguaaggugagaauccacguugaugaaccugacgagcuaacagugcacguaaaaagcucggacccagaugucguggcugccucaaccucucugauggcaaggaagcucgaguucggcacagacaguacuuuuaaagcguucuccgcuaugcccaagaccagccugugcuuuuauauuguggaacgcgaguacuguaagucuugcagcgaagaugacacgaaaaagugugucgauacaaaacuugagcagccgcaauccauauugaucgaacauaaggguaccauuaucgggaaacagaaugacacuugcaccgccaaggcaucaugcuggcuggagaguguuaagagcuucuuuuauggacugaaaaacaugcucggcucuguguucgguggcuuuuucguagggauucugcuuuuucuggccccuuucgugcuacucguccuguuuuucauguucggauggaagaucuuguuuuguuucaaaugcugucgacggacacguggccuguuuaaguacagacacuuaaaagaugacgaggaaacuggguacaggcgcauaaucgagcggcucaauuccaagaagggcaaaaacagacugcuugauggagaaaggcuggcugaccgaaagauugccgaguuguucucaaccaaaacacauaucggu

SEQ ID NO: 10513 - RNA, 3495 nt, Artificial Sequence
  derived and/or modified CDS sequence (opt3) from CCHVF(CCHVF 5170-R-2011)__KR814873.1__Gn-NSm-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugucugugacucaagcugcgagauaaugaucccgaaaggcacuggggauauucucguggacuguaguggaggucagcaacacuuccugaaggauaaccuuaucgaccugggcugcccccauauuccuuugcucgggaaaauggcaaucuacauauguagaauguccaaucacccaaggacaaccauggccuuucuguucugguuuucuuucggauauguuauuacgugcaucuuuugcaaggcgcuguucuacagccucauuaucaucggcacuuuagguaaaaagauuaagcaguaucgggaacugaaaccccagaccuguacaauaugcgagacugcuccugugaacgccaucgaugcagagaugcaugaccuuaauuguuccuacaacauuugcccauauugugccucacgcuugaccagugaagggcuggcuagacacgucacacagugccccaagaggaaagagaagguggaagagaccgaacuauaccucaaucuggagcggaucccuuggauaguacgcaaacuucugcaaguuagcgagucuacgggaguggcauugaagcgauccucauggcucauuguccuguuagugcugcucacugugagccuuaguccaguccagucugccccgguuggccacggcaaaacaaucgaaaccuaccagacuagagagggguuuacauccaucugucuguucauguugggaagcauucuauuuaucgugucgugccugguaaagggucucguggacucugucuccgauucauucuuucccggccugaguguguguaagaccugcagcauuggguccauaaacggauucgaaaucgagucucauaaauguuauugcagccuuuucugcuguccuuacugcaggcacuguucagcugaccgggaaauucaucagcugcacuugaguaucugcaagaaacguaagacgggcuccaauguuaugcucgccguguguaaacgcaugugcuuuaaggcgaccaucgaggcaagcagaagggcccuguuaauucggucuauaaucaacacaacuuucgucauuuguauccugacccuagcuauuugcgugguaucaacaagugccguugagauggaagaucucccagcagguacuugggagcgagaagaggaccugaccaauuuuugucaccaagaaugccaggugacagagaccgagugucuuugccccuaugaggcuuugguccugcgcaagccucucuuccuggauagcaucgugaaagggaugaagaaccuuuuaaauuccacuucuuuggagacgucgcucagcauagaagccccauggggcgcgaucaacguccaguccacauuuaaacccaccgugucaacugccaacauugcacugaguuggucuagcguugagcauagaggaaauaagaucuuagugaccggcagguccgagucaauuaugaaacuggaagaacggacagggguaagcugggaccuaggagucgaagaugcuucugaguccaagcuccugaccgugaguaucauggaccuuagccaaauguacucuccgguuuucgaauauuuguccggugaucgccagguggaggaguggccuaaggccacuugcacaggcgacugucccgaaagaugcggguguacgucaaguaccugccugcacaaagaguggccacauagcaggaacuggcguuguaauccuacuuggugcuggggagucggcacagguuguaccugcugugggguggauguaaaggaccucuuuacagaccacauguucauaaaauggaagguggaauacauuaaaacugaggcuaucguuugcgucgaacugaccucgcaggagcggcaguguuccuuaauugaggccggcacgcgauuuaaccugggacccgugaccaucacacuuucugaaccaagaaauauacaacagaaguugcccccugagaucauuacucuccauccaaagaucgaagagggcuucuuugaucugaugcacgugcagaaaguccuaagcgcaucaaccguuugcaagcugcagaguugcacacacgggauuccgggagaccuccaaaucuaucauauagguaaccugcuuaaaggcgauagggugaaugggcacuugauucauaagaucgaaccccacuucaacacuuccuggaugucuugggacggaugugaucuggacuacuacugcaauaugggcgauuggccuagcuguaccuauacgggugugacacagcacaaccaugccgcuuuuguaaauuuacucaacaucgagaccgacuacacuaaaacauuccacuuccauuccaagcgcgucaccgcgcacggggauacuccacagcuggaccuuaaagcacggcccaccuauggcgccggagagauuacagugcugguugaaguggcugauauggaguugcauacgaagaaggucgaaaucucaggccucaaauuugccagccugaccugcacuggguguuacgcaugcaguucuggaauuuccuguaaggugagaauacacguugacgagccugaugagcuaacagugcacguaaaaagcucggacccagacgucguggccgcuucaaccucucugauggccaggaagcucgaguucggcacagauaguacuuuuaaagcauucuccgcgaugcccaagaccagccugugcuuuuauaucguggaacgcgaauacuguaagucuugcagcgaggacgauacgaaaaagugugucgacacaaaacuugaacagccgcaauccauuuugaucgagcauaaggguaccauuaucgggaaacagaaugauacuugcaccgcuaaggccucaugcuggcuggagaguguuaagagcuucuuuuauggacugaaaaacaugcucggcucuguguucgguuccuuuuucguaggcauacugcuuuuucuggcaccuuucgugcuacucguccuguuuuucauguucggguggaagaucuuguuuuguuucaaaugcugucgacggacacguggacuguuuaaguacagacacuuaaaagacgaugaagagacuggcuacaggcgcauuaucgaacggcucaauucaaagaaggggaaaaacagacugcuugacggagagaggcuggccgaucgaaagauugcugaauuguucaguaccaaaacacauaucggc

SEQ ID NO: 10514 - RNA, 3495 nt, Artificial Sequence
  derived and/or modified CDS sequence (opt3) from CCHVF(CCHVF Oman-199809166)__KR864901.1__Gn-NSm-Gc
agcgaggaauccggcgaggacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaagagcuucaaguugugugaaaauuccgcuacugguaaaucuugcgagauugacaacaccccuguuaaguguaaacagggguuuugcuuaaagaucacacaggaaggacgaggccaugugaagcugucgcgugauucagagguagugcuagacgcaugugauagcaguugcgaaauaaugaucccaaaaggcaccggggacauucucgucgauuguuccggaggucagcaacacuuccugaaggacaaucuuaucgaucugggcugcccgaacauucccuugcucgggaaaauggccaucuacauauguagaaugucuaaucauccuaagacuacaauggcguuucuguucugguuuagcuucggauaugugauuaccugcauccugugcaaaguuaucuuuuaccucuuaauuguggucggcacgcuggguaagaaguucaaacaguauagggagcuuaagccacagacuuguaccaucugcgagacaacucccgugaacgcuauugacgccgaaaugcacgauuugaauuguuccuacaacauaugcccuuauugugcaucacggcugaccagugacgggcuagcccgccauguaaugcagugcccaaaaagaaaggagaaaaucgaagagacagaacucuaccugaaucuugagaggauucccuggguugugcggaagcuguugcaagucagcgagucuaccggaguggcucucaaacgcuccucauggcugaucguguuacugguccuccuuacgguuagccugaguccugugcagucugcaccaauaggccacggcaagacuauugaaacauaccagacccgagagggguauacuuccaucuguuuguuuguacuaggaagcauccuguucauugugucgcaccucaugaagggucuggucgacucugugggcaacuccuuuuucccggggcuuucaaucugcaaaacauguaguauuggaagcauaaauggcuuugaaaucgagucccauaagugcuacuguucucuguucugcugccccuauuguagacacugcagcgccgauaaagaaauucauaaguugcaccucucaaucuguaaaaagaggaaggcugguaguaacguuaugcuggccgugugcaaacggauguguuuccgugcgaccauggaggucuccaauaaggcauuacugauccgcagcgugauuaacacgaccuuuguaguuugcauacuaauccucgccgugugugucgugucuacaucagcugucgagauggaaagucugccugccgggacuugggagagagaagaggaccuuaccaacuucugccaccaggaaugucaagugacagagacugagugcuuguguccauacgaagcacugguucucaggaaaccccuguuucuugauagcauugcuaagggcaugaaaaaucuguugaacuccaccucucucgagacaucgcugagcaucgaagccccuuggggagcgauuaaugugcaguccaccuucaagccaacuguaucaacggccaacaucgcauuaaguuggucuagcgucgagcaucggggcaauaagauacugguguccgggcgaucagagagcaucaugaaacuagaggagcgcacaggaauuucuugggaccucgguguugaagaugcuuccgagaguaagcugcuuaccgugagcgucauggacuugucucagauguauucccccguguuugaauaccugucaggcgauagacaaguagaggaguggccgaaagccacuugcaccggggacugcccugaaagguguggaugcacaaguagcaccugucuccacaaggaguggccccauucgcggaacuggcgcugcaauccaacuugguguuggggcguggguacagggugcacguguugcggccuggauguuaaagacuuauucaccgauuauauguuugucaaguggaagguggaauacaucaaaacugaggcuauugugugugucgaacugacaucccaggagagacagugcucucuuaucgaggccggaaccagguucaacuugggcccuguuacaauaacucucagcgaaccccguaauauucagcaaaagcugccacccgagaucgugacccuacacccucggauugaagagggguuuuucgaccugaugcaugugcagaaaguacucucagcaaguacggucuguaagcugcaguccugcacccacggagugccaggugaccuucagguuuaccacaucggcaacuugcugaaaggggauaaggugaauggacauuuaauacacaaagucgaaccgcauuuuaacacaucuuggaugagcugggacggcugcgaucucgacuauuacuguaauaugggugauuggcccuccugcacuuauaccggggugacacaacacaaccacgccgcuuucguuaaucugcuuaacaucgagacugacuacaccaagaacuuucauuuccacucaaagcgagugacggcgcauggcgauacaccucagcuggacuugaaagcaagaccaaauuauggagccggcgagauuaccguacucgucgaaguggcugauauggagcugcacacuaagaaaaucgaaauuagcgggcuaaaguucgccagucugacauguaccggaugcuacgcauguucuuccggcaucagcugcaaagugaggauacaugucgacgagcccgaugagcucacuguucacgugaagucggaagacccugauauuguagccgcuucaucuagucugauggcccgcaaacuugaguuugguaccgacuccacauucaaagcauuuagcgcgaugccaaagacgucuuuguguuucuauaucguggaacgggaguacugcaaaagcuguuccaaggaagacacccagaaaugcgucaacgcuaagcuggagagaccccagucaaucuuaauugagcacaaggggacuaucauuggaaaacaaaaugauacauguaccgccaaggcaaguugcuggcucgaaagcgugaaauccuuuuucuacggccugaagaacaugcuuucugguauauuuggcaauguuuucaucgggauuuuucuguuccuagccccguuuauccuccugauuuuguucuuuauguucggauggaggauccuguucugcuuuaaauguugccgccgaacacggggcuuauucaaguaucgucaucucaaggacgaugaggaaacuggguacagaaaaauaaucgagaggcugaacaauaagaaaggaaagaacaaacuucuggacggcgaacgcuuggcugaucggaagauugccgagcucuuuucaaccaaaacgcacaucggu

SEQ ID NO: 10515 - RNA, 3495 nt, Artificial Sequence
  derived and/or modified CDS sequence (opt3) from CCHVF(CCHVF 200406546-Turkey)__KR864902.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugucugugacucaagcugcgaggugaugauaccgaagggcacuggggauauccucguugacuguaguggaggucagcaacacuuccugaaagauaaccuuauugaccugggcugcccccaugugccuuugcucgggaggauggcaaucuacauuugucggauguccaaucacccacgcacaaccauggccuuucuguucugguuuucuuucggauaugucaucacgugcauauuuugcaaggcgcuguucuacagccucauuaucauuggcacuuuagguaaaaaguuuaaacaguauagagaacugaagccccagaccuguacaaucugcgagacugcuccugugaacgccaucgaugcagagaugcaugaccuuaauuguuccuacaacauuugcccauauugugccucaagguugaccagugacgggcuggcucggcacguaccccagugcccuaagcgcaaagaaaagguugaggaaacagagcuauaccucaaucuggaacgaauaccauggaucgugagaaaacuucugcaagucagcgagucuaccggaguggcauugaagagguccucauggcucauugugcuguuaguccugcucacgguuagccuuaguccggugcagucugcccccguaggccacggcaaaacuaucgagacauaccagacccgggaaggguucacuuccauaugucuguuuauguugggaagcauucuauucaucgugucgugccuggucaagggucucguggauucuguuuccgacucauuuuucccuggccugaguguguguaaaacaugcagcaucggguccauuaacggauucgagaucgaaucucauaaguguuauugcagcuuauuuugcuguccauacugccgucacuguucagcugaucgcgagauucaucagcugcacuugaguauaugcaagaaaagaaagaccggcuccaaugucaugcucgccguguguaaaaggaugugcuuccgggcgacgaucgaagcaagccgacgcgcccuguuaauuagaucuaucaucaacaccacauuuguaauuuguauacugacucuaaccaucugcguugugucaacaagugcugucgagauggagaaucuccccgccgguacuugggaaagggaggaagaccugaccaacuucugucaccaagagugccaggugacagaaaccgagugucuuugcccuuaugaggcauugguccugcggaagccacucuuucuggauagcauugugaaagggaugaagaaucuucugaacuccacuucuuuggaaacgucgcucagcaucgaggcucccuggggcgccauuaacguucaguccacauucaagccgaccgugucaacugcgaauaucgcccugaguuggucuagcauagaacaucgcggaaacaaaaucuuaguaaccggcagauccgagucaauuaugaagcuggaggaaaggacaggggucagcugggaccuaggaguggaggaugcaucugaauccaaacuccugaccguuaguaucauggaccuuagccaaauguacucuccuguguuugaguauuuguccggugaucgucaggucgaagaguggcccaaggcuacuugcacaggcgacuguccagagcggugcggguguacgucaaguaccugccugcacaaagaauggccucauagccgaaauuggagauguaaccccacuuggugcuggggagugggcacagguuguaccugcugugggguagaugugaaggaccucuucacagaccacauguuuguuaaguggaaagucgaguacauuaagacugaagccaucgugugcguggagcugaccucgcaggaaaggcaguguuccuuaauagaggcuggcacgcgcuucaaucugggaccagucaccauuacacuuucugagccccggaacauccaacagaaauugccuccagaaauuaucacucuccauccgaagguugaggaaggcuuuuucgaucugaugcacgugcagaaagugcuaagcgccucaaccguaugcaagcugcagaguugcacacacgggauacccggagaccuccaagucuaucauaucgguaaucugcuuaagggcgauagagugaacgggcacuugauucauaaaaucgagccucacuuuaauacuuccuggaugucuugggacggaugugaucuggacuacuacugcaacaugggcgauuggccaagcuguaccuauacggguguuacacagcacaaucaugcagccuucgugaacuuacucaauauugaaaccgacuacacuaagacauuccacuuucauuccaaaagggucaccgcucacggggauacuccccagcuggaccuuaaggcgcgcccuaccuauggcgcaggagagaucacagugcugguugagguggccgauauggaauugcauacgaaaaagguagagauaucaggccucaaauucgcuagccuggccugcaccggguguuacgcaugcaguucuggaauuuccuguaagguccgaauccacguggacgaaccagaugagcuaacugugcacgucaagagcucggaccccgacguuguggccgcuucaacaucucugaccgcccggaaacucgaguuuggcacagauaguacuuucaaggcauuuuccgcgaugccgaaaaccagccugugcuucuauaucguagaaaaggaguacuguaaaucuugcaacgaagacgauacgcagaaguguguggacacaaaacuugagcaaccucagagcauuuugaucgaacauaaggguaccauuauagggaagcagaaugauacuugcaccgcuaaagccuccugcuggcuggagucagucaagagcuuuuucuauggacuuaaaaacaugcucggcaguguguuugguaacuucuuuaucggcauucugcuuuuccuggcaccauuuguucuacucgugcuguucuucauguuuggguggaagaucuuguucuguuuuaagugcugucguagaacaaggggacuguucaaauaccgccacuuaaaggacgaugaggaaacuggcuacaaacggauuaucgagagacucaauaacaagaaagggaagaauaggcugcuugacggagaacgacuggccgaucgcaagauagcugaguuguuuucuaccaaaacacauaucggc

SEQ ID NO: 10516 - RNA, 3495 nt, Artificial Sequence
  derived and/or modified CDS sequence (opt3) from CCHVF(CCHVF 1-CR/HU-2015)__KU161584.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucacacagugccccaaacggaaggaaaaaguggaggaaaccgagcuauaccucaaucuggaacgcauuccuuggaucguacgaaaacuucugcaaguuagcgagucuacgggaguggccuugaaaagauccucauggcucauaguccuguuagugcugcucacugugagccuuaguccaguccagucugcuccgguuggccacggcaagacaauugagaccuaccagacuagggaaggguuuacauccaucugucuguucauguugggaagcauccuauuuauugugucgugccugguaaaaggucucguggauucugucuccgacucauucuuucccggccugagugugugucggaccugcagcaucggguccauuaacggauucgagauagaaucucauaaguguuauugcagccuuuucugcuguccuuacugccgucacuguucagccgaucgcgagauccaucagcugcacuugaguauuugcaagaaaagaaagacgggcuccaauguuaugcucgcgguguguaaaaggaugugcuuucgggcaaccauggaagccagccgacgcgcucuguuaaucagaucuaucauuaacacaacuuucgucauauguauccugacccuaacaauuugcgugguaucaacuagcgccguugagauggagaaucucccagcagguaccugggaaagggaggaagaccugacaaacuuuugucaccaagagugccaggugaccgaaacugagugucuuugccccuaugaggcuuugguccugcggaagccucucuuccuggauagcaucgugaaagggaugaagaaucuucugaacuccacgucuuuggaaacaucgcucagcauugaggccccauggggcgcgaucaacguccaguccaccuuuaagcccacugugucaaccgccaauauagcacugaguuggucuagcguugaacaucgcggaaacaaaaucuuagugacaggcagauccgagucaauuaugaagcuggaggaaaggaccgggguaagcugggaccuaggagucgaggaugcuucugaauccaaacuccugacugugaguaucauggaccuuagccaaauguacucuccgguuuucgaguauuuguccggugaucgucagguggaagaguggccuaaggccacaugcacgggcgacugucccgagcggugcggguguaccucaaguacuugccugcacaaagaauggccacauagccgaaauuggagauguaacccuacauggugcuggggagucggcaccgguuguacaugcugugggguggauguaaaggaccucuuuacugaccacauguucgugaaguggaaaguugaguacauuaagaccgaagcuaucgucugcguggagcugacgucgcaggaaaggcaguguuccuuaauagaggccggcacccgcuuuaaucugggacccgugacaauuacucuuucugagccacggaacauccaacagaaauugcccccugaaauuaucacccuccauccaaagauagaggaaggcuucuuugaucugaugcacguccagaaaguucuaagcgcaucaacagugugcaagcugcagaguugcacucacgggaucccgggagaccuccaaguguaucauauugguaaucugcuuaagggcgauagaguaaacgggcacuugauccauaaaauugagccccacuucaauaccuccuggaugucuugggacggaugugaucuggacuacuacugcaacaugggcgauuggccuagcuguacguauacaggugucacccagcacaaucaugccgcuuuugugaacuuacucaauaucgaaacugacuacacaaagaccuuccacuuccauuccaaaaggguuacugcgcacggggauaccccacagcuggaccuuaaggcacgccccacauauggcgccggagagauaacggugcuggucgagguggcugauauggaauugcauaccaaaaagguugagauuucaggccucaaauuugccagccuggcaugcacuggguguuacgccugcaguucuggaaucuccuguaaggugcgaauccacguagacgaaccugaugagcuaacaguccacgugaagaguucggacccagacguggucgcugccucaaccucucugauggcacggaaacucgaguucggcacagauaguacuuuuaaggcguucuccgcuaugcccaaaaccagccugugcuuuuauauuguugaacgugaguacuguaagucuugcagcgaagacgauacgaaaaaguguguggacacaaaacuugagcagccgcaauccaucuugauugaacauaaggguaccauaaucgggaagcagaacgauacuugcaccgccaaagcaucaugcuggcuggagaguguaaagagcuucuuuuauggauuaaagaauaugcucggcucuguguucgguaacuuuuucauuggcauccugcuuuuucuggccccuuucguccuacucgugcuguuuuucauguucggguggaagauuuuguuuuguuucaagugcuguagaaggacacgcggacuguuuaaauaccggcacuuaaaggacgaugaggaaacuggcuacagaaggaucauagagcgacucaacaauaaaaaggggaaaaaccgccugcuugacggagaacggcuggcugauagaaagaucgccgaguuguucuccaccaagacacauauuggc

SEQ ID NO: 10517 - RNA, 3495 nt, Artificial Sequence
  derived and/or modified CDS sequence (opt3) from CCHVF(CCHVF 1231-CR/TI-2015)__KU161585.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcauuuucugcaaagcucuguucuacagccucaucauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucacacagugccccaaacggaaggaaaaaguggaggaaaccgagcuauaccucaaucuggaacgcauuccuuggaucguacgaaaguugcugcaaguuagcgagucuacgggaguggccuugaaaagauccucauggcucauaguccuguuagugcugcucacugugagccuuaguccaguccagucugcuccgguuggccacggcaagacaauugagaccuaccagacuagggaaggguuuacauccaucugucuguucauguugggaagcauccuauuuauugugucgugccugguaaaaggucucguggagucugucuccgauucauucuuucccggccugagugugugucggaccugcagcaucggguccauuaacggauucgaaauagagucucauaaguguuauugcagccuuuucugcuguccuuacugccgucacuguucagccgaccgcgaaauccaucagcugcacuugaguauuugcaagaaaagaaagacgggcuccaauguuaugcucgcgguguguaaaaggaugugcuuucgggcaaccauggaggccagccgacgcgcucuguuaaucagaucuaucauuaacacaacuuucgucauauguauccugacccuaacaauuugcgugguaucaaccagugccguugagauggaaaaucucccagcagguacuugggagagggaagaggaucugacaaacuuuugucaccaagaaugccaggugaccgagacugagugucuuugccccuaugaagcucuuguccugcggaagccucucuuccuggacagcaucgugaaagggaugaagaaucuucugaacuccacgucuuuggagacaucgcucagcauugaagccccauggggcgcgaucaacguccaguccaccuuuaagcccacugugucaaccgccaauauagcacugaguuggucuagcguugagcaucgcggaaacaaaaucuuagugacaggcagauccgagucaauuaugaagcuggaagagaggaccgggguaagcugggaucuaggagucgaagacgcuucugaguccaaacuccugacugugaguaucauggaucuuagccaaauguacucuccgguuuucgaauauuuguccggugaccgucagguggaggaguggccuaaggccacaugcacgggcgauugucccgaacggugcggguguaccucaaguacuugccugcacaaagaguggccacauagccgaaauuggagauguaacccuacauggugcuggggagucggcaccgguuguacaugcugugggguggacguaaaggaucucuuuacugaccacauguucgugaaguggaaaguugaauacauuaagaccgaggcuaucgucugcguggaacugacgucgcaggagaggcaguguuccuuaauagaggccggcacccgcuuuaaucugggacccgugacaauuacucuuucugaaccacggaacauccaacagaaauugcccccugagauuaucacccuccauccaaagauagaagagggcuucuuugaccugaugcacguccagaaaguucuaagcgcaucaacagugugcaagcugcagaguugcacucacgggaucccgggagaucuccaaguguaucauauugguaaucugcuuaagggcgacagaguaaacgggcacuugauccauaaaauugaaccccacuucaauaccuccuggaugucuugggauggaugugaccuggauuacuacugcaacaugggcgacuggccuagcuguacguauacaggugucacccagcacaaucaugccgcuuuugugaacuuacucaauaucgagacugauuacacaaagaccuuccacuuccauuccaaaaggguuacugcgcacggggacaccccacagcuggaucuuaaggcacgccccacauauggcgccggagagauaacggugcuggucgaaguggcugacauggaguugcauaccaaaaagguugaaauuucaggccucaaauuugccagccuggcaugcacuggguguuacgccugcaguucuggaaucuccuguaaggugcgaauccacguagaugagccugacgagcuaacaguccacgucaagagcucggauccagacgugguggcugccucaaccucucugauggcacggaaacucgaauuuggcacagacaguacuuuuaaggcguucuccgcuaugcccaaaaccagccugugcuuuuauauuguugagcgugaauacuguaagucuugcagcgaggaugacacgaaaaaguguguggauacaaaacuugaacagccgcaauccaucuugauugagcauaaagguaccauaaucgggaagcagaacgacacuugcaccgccaaagcaucaugcuggcuggagaguguaaagagcuucuuuuauggauuaaagaauaugcucggcucuguguucgguaacuuuuucauuggcauccugcuuuuucuggccccuuucguccuacucgugcuguuuuucauguucggguggaagauuuuguuuuguuucaagugcuguagaaggacacgcggacuguuuaaauaccggcacuuaaaggaugacgaagagacuggcuacagaaggaucauagaacgacucaacaauaaaaaggggaaaaaccgccugcuugauggagagcggcuggcugacagaaagaucgccgaauuguucuccaccaagacacauauuggc

SEQ ID NO: 10518 - RNA, 3495 nt, Artificial Sequence
  derived and/or modified CDS sequence (opt3) from CCHVF(CCHVF Gaib)__KX013445.1__Gn-NSm-Gc
agcgaggaauccucugacgauugcaucucaagaacccagcugcucaggacagagacugccgaaauucacaacgacaauuacggcgggcccggagauaagauaacgaucuguaacgguaguaccauuguggaccaacggcuuggcagcgagcuggggugcuauacaaucaaucgcgucaaauccuucaaguugugugaaaacucugcuacuggaaaaucgugcgagauugauucaaucccuguuaagugucgacagggcuuuugcuuaaaaauaacccaggagggucgugggcaugugaagcugagcagaggaagugaaguagugcuagacgcaugugauuccucuugcgagaucaugauuccaaagggcacaggcgacauccucgucgauuguagcgggggacagcaacacuuccugaaagacaaucuuauugaucuggguugcccgaacauccccuugcucggcaagauggccauauacauuuguaggauguccaaucauccuaaaaccacuauggcguuucuguucugguuuucauucggguaugugaucacaugcaucuuuugcaaggcuauuuucuaccugcucaucauuguuggaaccuuaggcaaaaaguuuaagcaguaucgggaacugaaaccacagacguguacuauaugcgagaccacacccgugaacgccaucgacgcagagaugcacgaucuuaauuguaguuacaacauuugcccuuauugugccagccgcuugacuucugacggucuggcuagacaugucgugcacugcccaaagaggaaagaaaagaucgaggaaaccgagcuauaccucaaucuggaacggguacccuggguugugcgcaaacuucugcaggucuccgagucaacagggguggcauugaagcgaagcaguuggcucauagugcuguuaguccugcucaccguuucucuuuccccugugcaaagcgccccaauuggacacggcaaaacgaucgagacuuaccagacaagagaaggcuauaccucgaucugucuguucguauugggagggauucuauuuaucgugucuugccugaugaagggucucgucgacuccgugggcaacaauuucuuuccggggcugacuauuuguaagacaugcucaauaaguagcaucaacggauucgagauugaaucccauaaauguuacugcucucuucugugcugucccuauugcaggcacuguagcgcugaucgggagauccaucaguugcaccucucaaucugcaagaaacguaagaccggcaguaauguuaugcuggccguguguaaacgcaugugcuuaagagucacgaccgaaguguccaacagggcgcuguucauucggagcauaaucaacacaacuuuuguaauuuguauccuaauucucgcaguuugcgugaucucuaccucagccgucgagauggagaaucugccugcugguacaugggaacgagaggaagaccuuacuaacuucugucaccaggagugccaagugaccgaaacagaguguuugugcccauacgaggcccugguccuccgcaagccccuguuuagugauagcauagugaaggggaugaaaaaucuucugaacuccaccucuuuggaaacuucgcucagcaucgaggcaccuuggggcgcuauuaauguucaguccacguucaagccaacagugucaaccgccaacaucgcgcugaguuggucuagcauugaacauagaggaaauaaaaucuuaguauccggcaggucagagagcauaaugaagcuggaggaacggacugggauuucuugggaccuaggagucgaggaugccuccgaaagucgccuccugaccgugagcguuauggaccuuucucagauguauucccccguguuugaguacuugucaggugauagacaagucgaagaguggccgaaagcaacaugcaccggcgacuguccugagaggugcggguguacaaguagcacaugccugcacaaggaauggccccauucgcguaacuggcgguguaauccaacguggugcuggggagugggcaccgguuguacuugcugugggcucgauguaaaggaccuguucacagauuauauguuugugaaauggaagguugaguacaucaaaaccgaagcuauugucugcguggaguuaacaucccaggaacgacaguguucucugaucgaggccggcacuagauucaaccuuggaccugugaccauaacguugagcgagcccaggaauauccagcaaaagcucccacccgaaauuaucacccugcacccucgcauugaggaaggcuuuuucgaccuaaugcauguccagaaaguucugucagcuaguacagugugcaagcuccaguccugcacucacggggugccaggagaccugcagguauaccacaucgguaaccuuuugaagggcgauaaagucaaugggcaucugauacacaagauugagccgcauuuuaacaccucuuggaugagcugggacggaugugauuuagacuauuacugcaauaugggcgauuggcccuccuguacauauacuggugugacccaacacaaccacgccgcauucguuaaccuccugaauaucgaaacggacuacacuaaaaacuuucauuuccacucaaagcgggugaccgcccauggggauacuccucagcuugaccugaaagcuagaccaacauauggcgcgggagagaucaccgucuugguggagguugcagauauggaacuccacacuaagaaaauugagaucagcggccugaaguucgccagucuaaccugcacaggguguuacgcuuguucuuccggaauuagcugcaaggugaggauacauguagacgaacccgaugagcugacgguccacgugaaaucggaggacccugauaucguggccgcaucaucuagucucauggcccgcaagcuggaauuuggcaccgacuccacuuucaaggcuuuuagcgccaugccaaaaacaucucuuugcuucuauauugucgagcgagaauacuguaaaagcugcucccgggaggacacccagaaguguguuucaacaaaguuggaacagccccaaaguauccugauugagcacaaagguacuaucauagggaagcagaauaauaccugcacgacaaaaaccacuugcugguuagagagcgugaaguccuuuuucuacggacucaaaaacaugcugucuucaaucuuuggcaacguauucguggguauuuuuaguuuccuugcaccguuuauccugcuaauucucuucuuuauguucggcuggcguauccuguucuguuuuaagugcuguagaaggacccgcggguuguucaaguaucggcaucugaaagaugacgaagagacaggauacagaaggauaauugaacgauuaaauaacaagaaaggcaagagcaaacuccuggauggggagcgccuugcggaccggaagaucgcugaacuguuuuccacuaagacccacaucgga

SEQ ID NO: 10519 - RNA, 3495 nt, Artificial Sequence
  derived and/or modified CDS sequence (opt3) from CCHVF(CCHVF Hodzha)__KX013448.1__Gn-NSm-Gc
agcgaggaauccggcgacgauugcaucucuagaacccagcugcucaggacagagacugccgaaauucacggggacgauuacggaggucccggcgacaagauaacgaucuguaacgggucaaccauuguggaucaacggcuuggaagugagcugggcugcuauacaaucaaucgcgucaagagcuucaaguugugugaaaacuccgcuacugguaaaucuugcgagauugacucgaccccuguuaagugucgacagggguacugcuuaaaaaucacacaggagggacguggccaugugaagcugucaagaggcagcgaaguagugcuagaugcaugugacaguuccugcgaggucaugauaccaaaggggaccggagauauccucguggacuguucugguggccagcaacacuuucugaaagauaaucuuauugaccuggggugcccgaggauccccuugcucggaaagauggccauuuauaucugucggaugagcaaccauccugaaacuacaauggcguuccuguuuugguucuccuuuggcuacguuauaaccugcauucugugcaaagcuaucuucuaucucuuaauuaucguggguacgcuggggaagcgcuuuaaacaguacagagagcuuaagccacagacuuguaccaucugcgagacaacucccgccaaugcaauugaugccgaaaugcacgacuugaacuguucauauaauauaugcccuuacugugcuaguaggcugaccagcgacggacuagcacggcaugucacacagugcccaaagcgcaaagagaagguggaagagaccgaacucuaccugaaccuugagcgaauccccuggauuguaagaaaacuguugcaaguuucugaguccacgggcguggcccucaagaggucaagcuggcugaucgucuuacuggugcuuuucgcugugagucuuucuccuguccaguccgccccaauaggccacgggaaaacuauugaaacauaucaggcgcgggaggaauacaccagcaucugucuguuuguuuugggaucgauccuauucauugugucuugccugaugaagggucucguagauuccaucggcaauauuuucuucccggggcugacuauauguaaaacaugcucaaucggaaguauuaacggcuuugagaucgaaagccacaaguguuauugcucccuucugugcugucccuacugccgucauuguccugcagaccgcgagauccaccaguugcaucucucuauuugcaagaaaagaaagaccgguagcaaugugaugcuggccgucuguaaaaggaugugcuuccgggcuacgauggaggugucaaacaaggccuuacugauacgaaguaucauuaauaccacauucguuguguguauccuaauucucgcagucugcgugguauccacuagcgcuguugaaauggagucucugccagccgggaccugggaacgcgaggaagaucuuacaaacuuuugucaccaagagugccaggugacugagaccgaauguuugugccccuaugaggcgcugguccucagaaggccucuguuccuugacucaaucgugaaaggcaagaagaaucuguugaacaguacaagccucgaaaccucccugucuauagaggccccauggggagcaaucaacguccagucgacuuacaaacccacggugagcacagcuaauauugccuuauccuggucaaguguugagcaccggggcaacaagauccuggugucugggcgcagcgaauccauuaugaaacuagaggaaagaaccggaaucucaugggaucucgguguagaggacgcuagcgaaucuaagcugcuuacugucuccgugauggauuugagucaaauguauagcccgguuuuugaguaccugucuggcgaccgucagguggaggaauggccuaaagcaaccugcacaggggauuguuccgagaggugcggauguaccucaaguacuugccuccauaaggaauggccccacagccggaauuggcgauguaacccaacauggugcuggggcgucgguacgggguguaccugcuguggccuggacgugaaggauuuauucacugacuacauguuuguaaaauggaagguggacuauauaaaaacagaggccauuguuugcgucgaacugaccucgcaggagagacaguguucccuuguggaggccggaacaagguucaauuugggcccugugacuaucacccucucugaaccccgcaacauucaacagaagcugccacccgagaucauaacgcuacauccucggaucgaagagggguuuuucgaucugaugcacguccagaaaguucucagcgcuucaaccgugugcaagcugcagaguugcacacauggagugccaggugaccuucaaguauaccacauuggcaauuugcugaagggggauaaagucaacggacacuuaauccauaagauugaaccgcacuuuaauacuuccuggaugucuugggacggcugugaucucgacuauuacugcaacaugggugauuggcccagcuguaccuauacaggggugacucagcauaaucacgcguccuucguuaaccugcuuaauaucgagaccgacuacacgaaaucauuucacuuccauagcaagagagugacagcacacggcgauaccccucagcuggacuugaaagccaggccaacuuauggagcuggcgagauaacaguccucguggaaguugccgauauggagcugcauaccaagaaaauugaaaucacugggcuaaaguuugcaagucugaccugcacaggauguuacgccuguucuuccggcaucagcugcaaggugcgcauucacguagacgagcccgaugagcucacgguccaugugaaaucggacgacccugauguggucgcugccucaucuagucugauggcacgaaagcucgaauuugguaccgacuccacuuucaaagcguuuagcgcuaugccaaagacaucuuugugcuucuacaucguugagcgggaauauuguaaaagcugcuccaaggaggauacccagaagugugugaacacaaaacuggaacaaccccagucaauuuuaauagagcagaaggggacuaucauuggaaaacagaauaauaccugcacggccaaggcaaguugcuggcucgagagcguaaaauccuuuuucuacggccugaagaacaugcuuucugguaucuuuggcaacguguucgucgggauuuuucuguuccuagccccguuuauccuccugauauuguucuuuauguucggauggcguauccuguuuuguuucaagugcuguagaaggacacgcggcuuauucaaauauaagcaccucaaagacgaugaagagaccggguaccggagaauuaucgaaaggcugaacaauaagaaaggaaagaacaaacuucuggacggcgagcgauuggcugaucgccggauugccgaacucuuuucaacuaaaacccacaucggu

SEQ ID NO: 10520 - RNA, 3495 nt, Artificial Sequence
  derived and/or modified CDS sequence (opt3) from CCHVF(CCHVF IbAn7620)__KX013451.1__Gn-NSm-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaaaucuuucaaguugugugaaaauuccgcuacuggcaaaaacugcgagauugauucuguuccagugaagugucgacaggguuacugcuuacguaucacccaggaggggagaggacauguaaaacugucgaggggcucagaaauagugcuagacgcaugugauacaagcugcgagaucaugauuccgaagggcaccggggacauccucgucgauuguaguggaggucagcaacacuuucugaaggacaaucuuauugaucugggcugccccaaaaucccuuugcucgggaagauggccauauauauuugucggauguccaaccauccaaaaacuacaauggcguuccuguuuugguucucuuuuggauacgugauuaccugcauucugugcaaggcuaucuucuaucucuuaaucauuauaggcacgcuggguaaacgccuuaagcaguacagagaauugaagccccagacuuguaccaucugcgagacaacuccuguuaaugccauugacgcagagaugcacgaucugaacuguagcuauaauaucugcccauacugugccuccaggcuaaccucagacgggcucgcucggcaugugauacagugccccaaacgcaaggaaaaagucgaggaaacagagcuguaccuuaaccuggaacgaaucccuugggugguaagaaaguugcuccaaguuagugagagcaccggaguggcacugaaaaggucuuccugguuaaucguccugcucgugcuuuuuacggugucacugagcccaguccagagugccccgaucggccagggcaagacuacagaggcuuaucgggcccgugaaggguacaccucuauuuguuuguucguucuaggauccauccuguuuauugugagcugccucaugaaaggucugguagacucggugggcaauucuuucuuucccgggcuuuccauauguaagacuugcucaaucaguagcauuaacggauucgagaucgaaucccacaaguguuauugcucucuguuuugcuguccuuacugccgccacuguagcacagauaaagagauccauaaguugcaccucucaauuugcaaaaagagaaaaaccggcaguaaugucaugcuggcgguguguaagaggaugugcuuccgggcaacgauggaaguuuccaaccgagccuuauucauacgcagcaucauuaauaccacauuugugcuguguauccuaauucucgcugucugcgugguaucuacuucagccguugagauggagaaccugccagcagguaccugggaaagagaggaagaccuuacaaacuucugucaucaggagugccaagugacugaaaccgaguguuugugccccuaugaggcucugguccucaggaagccucuguuucuugauaguaucgccaaagggaugaagaauccacugaacagcacauccuuggaaaccucucucucgauagaggcgcccuggggcgccaucgacgugcagagcacuuacaaaccgacggucuccacagcaaauauugcucugucauggaguucuguggaacaccggggaaacaagaucuuaguuagcggccgcuccgagucaauuaugaaacuggaggaaagaaccgggaucagcugggaucuaggaguggaggacgccucugaauccaagcuccugacuguaagugucauggaucuuagccagauguauucuccuguguucgaguacuuguccggugacaggcaaguugaagaguggcccaaggcuaccugcacaggcgauuguccagagcguugcggguguaccucaaguacuugccugcacaaagaauggccucauagccggaauuggcgauguaaccccacauggugcuggggagugggcacggguuguaccugcugugggcucgacgucaaggaucuguuuacugacuacauguucgugaaauggaagguagaguauauaaaaacagaagccauugugugcguugaguuaaccucgcaggaaagacaguguucccugaucgaggcaggcacaagguuuaaucuuggaccagucacuauuaccuugucugagccccgcaacauccagcaaaagcucccuccagaaauaaucacgcugcacccgcggauugaggaaggcuucuuugaccuaaugcaugugcagaaggugcugagcgccucaaccgucugcaaacuccagaguugcacacacgggguucccggagaucuucagguguaccauaucgguaaucuguugaagggcgacaaagugaacgggcaccugauucacaagaucgagccucauuucaauacuuccuggaugucuugggauggaugugacuuagauuauuacugcaacaugggcgacuggccaagcuguaccuauacagguguaacucaacacaaucaugcuuccuuugucaaccuccugaauauagaaaccgauuacacgaaaaacuuccacuuucacucaaagagagugacagcgcauggggacacaccccagcuugaucugaaagcaaggccuacuuauggcgccggagagauuacaguuuugguggaggucgcuaacauggaacuccacaccaagaagaucgagaucagcggccugaaauucgccagucuaacuugcaccggguguuacgcaugcagcuccggaauuagcuguaaggugcgcauccauguugacgaaccagaugagcugacagugcacguaaaaucggacgaucccgacgucguggccgcuucaucuagucucauggcccgaaagcuggaguucggcacggacuccaccuuuaaagcauucagcgcgaugccgaagacuucucuuugcuuuuacauuguggaacgggagcauuguaagagcugcuccgaagaggauaccaaaaagugugucaauaccaaauuggaacagccucagucaauacugaucgagcacaaggguacaauuaucgggaaacaaaacaguacuugcaccgcuaaggccagcugcugguuagagucuguuaaguccuucuuuuauggacucaaaaauaugcugucaggcauuuucgguaacguguuuaugggcaucuuccuuuuucuggcaccauucauacuacucauccuguuuuucauguuuggguggcguauuuuguucuguuucaagugcuguagaaggacgcgcggacuguuuaaauaccggcacuuaaaggacgaugaagagacaggcuauagaaggaucauugaacgacucaauaacaaaaaggggaagaauaaacugcuugacggagagcgccuggccgaucggagaaucgcugaauuguucaguaccaagacucauauaggc

SEQ ID NO: 10521 - RNA, 3495 nt, Artificial Sequence
  derived and/or modified CDS sequence (opt3) from CCHVF(CCHVF K128_76)__KX013454.1__Gn-NSm-Gc
agcgacgaguccggcgaugacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaagagcuucaaauugugugagaauagcgcuacugguaaaucuugcgaaauugacucgaucccuguuaagugucgacagggguacugcuuaaaaauaacccaggagggacguggccaugugaagcugucaagaggcagcgagguagugcuagaugcaugugacaguuccugcgaagucaugaucccaaaggggacaggagauauucucguggacuguucugguggccagcaacacuuucugaaagauaaccuuaucgaccuggggugcccgaagauucccuugcucggaaaaauggccaucuauauauguaggaugagcaaucauccuaagaccacuauggcguuccuguuuugguucuccuuuggcuacguuauuacaugcaucgugugcaaagcuauuuucuaucugcucaucaucgucgguaccuuagggaagcgguuuaagcaguaccgcgagcugaaaccacagacguguacuauuugcgaaaccacacccacuaacgccauagaugcagagaugcacgaccuuaauuguucauauaacaucugcccuuacugugccaguagauugaccagcgacggacuggcuaggcaugugacacacugcccaaagcggaaagagaagguagaagagaccgaacuauaccucaaucuggagcgcauucccuggguugugcgaaaacuucugcaggucucugaauccacgggcguggcauugaagagaucaagcuggcucaucgugcuguuaguccuguucgccguuagucucucuccugugcaauccgcuccaauaagccacggcaaaacuauugagacauaucagguaagggaggaauacaccucgaucugucuuuuugugcuggggucuaucuuguucauugucuccugccuaaugaagggacuggugaacucaguugguaauaucuuuuucccgggccucaguauuuguaagacuugcagcauaggguccaucaacggauuugagauugaaucucauaaauguuauugcagccugcuuugcugucccuacugccggcacuguucagccgaucgugagauccaucagcugcacuugaguaucugcaagaaacgcaagacaggcuccaaugugaugcucgcggucuguaaaagaaugugcuucagggcaaccauggaagugagcaacaaggcccuguucauucggucuauaaucaauacgaccuuuguaguuuguauuuuaauccuggcugugugcgucgugucaacaagugccgucgagauggagagccuaccugcagguacuugggaacgagaggaagaccucaccaacuucugucaccaggagugccaagugacagaaacugagugucugugcccauaugaggcucuuguuuugcgcagaccccuguuucaggauuccauugugaaggggaugaaaaaccuccucaauucuaccucgcuugaaacaagccuguccaucgaggccccuuggggcgcgauaaacguacagucaaccuacaagccagccgucagugcagcuaauaucgccuugucuuggagcuccguggaacauaggggaucaaaaauucucguuagcggccggucugaguccaucaugaagcuggaggaacgcacugggauuaguugggacuuaggaguggaggaugcuagcgaaucuaaacugcuaacggucuccgugauggaccucucacaaauguauagucccguauucgaguaccugagcggugauagacagguggaagaguggccgaaggccacaugcaccggcgacuguccugagaggugcggguguacuucgucuaccugccuucacaaggaauggccccauucccguaacuggcgguguaauccaacauggugcuggggaguuggcaccgguuguacuugcuguggguuggaugucaaagaccuguuuacagauuacauguucgugaaguggaaaguggaguauaucaagacggaagcaauagucugcguugagcucaccagccaggaacgacaguguucacugauugaggccggcacuagauuuaacuuaggaccugugacaaucacccugagugagcccaggaauauucaacagaaacuuccacccgaaaucauaacauugcacccucgcaucgaggaaggcuucuuugaccucaugcaugugcagaagguacuguccgcuucuacugucugcaagcuacagagcugcacccacggggugccaggagaccugcaaguuuaccacauugguaaccuccugaaaggcgaucgggugaaugggcaucuuauccacaagauugagccgcauuucaacacguccuggaugucaugggacggaugugauuuggacuauuacugcaauaugggcgauuggcccagcuguaccuauacaggugucacucagcacaaccacgcgaguuuugugaaucuguuaaacaucgaaaccgacuacacaaaaucuuuccauuuucacuccaagagaguuacugcacauggggauaccccucagcucgaccugaaagccaggccaaauuauggcgcuggagagauaacggugcuuguagaggucgccgauauggaacugcacacaaagaaaauugagaucagcggcuugaaguucgcaucgcugaccugcacuggguguuacgccugcucaucuggaaucaguuguaaggugcgcauucauguggacgaacccgaugagcugacaguccacguuaaauccgacgauccugacgugguagcugccagcucuagccuaauggcacgaaagcuggaguucggcaccgacuccacuuuuaaagcguucucagcuaugccaaagaccagucucugcuuuuacaucguggaacgggaguauuguaaaagcugcucuaaggaagauacacagaagugugucaacacgaaacuggagcaaccccaguccauucuuauagaacacaaggguaccaucauugggaaacagaacaauacuugcacagccaagaccucaugcugguuggagagugugaaauccuucuuuuacggacugaagaacauguuauccggcaucuucgguaauguuuuugugggcauuuuccucuuucuggcaccguucauccuucugauacuauuuuucauguuuggguggcguauccucuucuguuucaagugcuguagaaggacacgcggacuguuucgguauaaacauuuggagaacgacgaagagacuggcuacagaaggauuaucgaacgacugaauaacaagaaagggaagaauaaauuacucgauggagagcgccuggccgaccggagaauugcugaacuuuucucuaccaagacgcacaucggc

SEQ ID NO: 10522 - RNA, 3495 nt, Artificial Sequence
  derived and/or modified CDS sequence (opt3) from CCHVF(CCHVF K168_40)__KX013457.1__Gn-NSm-Gc
agcgacgaguccggcgaugacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaaauccuucaaguugugugagaauagcgcuacugguaaaucuugcgaaguugacucgauuccugugaagugucgacagggguacugcuuaaaaaucacccaggagggacguggccauguaaagcugucaagaggcagcgaggugguccuagaugcaugugacaguuccugcgaagugaugauaccaaaggggacaggagauauccucguugacuguucugguggccagcaacacuuucugaaagauaaccuuauugaccuggggugcccgaagauccccuugcucggaaaaauggccauuuauaucuguaggaugagcaaucauccuaagaccacuauggcguuccuguuuugguucuccuuuggcuacgugauaacaugcauugucugcaaagcuaucuucuaucugcucauuaucguggguaccuuagggaagcgguuuaagcaguaccgcgagcugaaaccacagacguguacuaucugcgaaaccacacccacuaacgccauugaugcagagaugcacgaccuuaauuguucauauaacauaugcccuuacugugccaguagauugaccagcgacggacuggcuaggcauguaacacacugcccaaagcggaaagagaagguugaagagaccgaacuauaccucaaucuggagcgcauccccugggugguccgaaaacuucuucaggugucugaauccacgggcguggcauugaagagaucaagcuggcucauuguccuguuaguucuguucgccgugagucucucuccuguacaauccgcuccaaucggccacgggaaaacuauagagacauaucaggugagggaggaauacaccagcauuugucuuuuuguccugggaucgaucuuguucaucgugucuugccuaaugaagggucugguuaacuccgugggcaauaucuuuuucccggggcucucaauuuguaagacuugcaguauuggaagcauaaacggcuuugagaucgaaucccauaaauguuauugcucucugcuuugcugucccuacugccggcacuguagcgccgaucgugagauucaucagcugcacuugucaaucugcaagaaacgcaagacagguaguaaugucaugcucgcgguguguaaaagaaugugcuucagggcaaccguagaaguuuccaacaaggcccugagcauccggucuauuauaaauacgaccuucguggucuguaucuuaauucuggcugugugcgucgugucaacaagugccguugagauggagagccuaccugcagggacuugggaacgagaggaagaccucaccaacuuuugucaccaggagugccaagugacagaaacugagugucugugcccauaugaggcucuuguauugcgcagaccccuguuccucgauggcaucgucaagggaaugaaaaaccugcuuaauuccaccucucuggaaacaucguugagcauugaggccccuuggggcgcgaucaacgugcaguccaccuacaagccaacuguuucagccgcaaauauagcucucaguuggucuagcguggaacauagggggaacaaaauccuggucuccggacggucagagagcauuaugaaguuagaggaacgcacggguaucucuugggaccugggcguggaggaugccuccgaaaguaaacuacucacaguaagcgugauggaccugucucagauguauucccccguuuuugaguaccuuucaggggauagacaagucgaagaguggccgaaggcuaccugcacuggagacuguccugagaggugcggcuguaccaguagcacaugcuugcacaaggaauggccccauucgcguaauuggcgguguaacccaaccuggugcugggguguggggacuggcuguacaugcuguggacuggaugugaaagaccucuucacggauuacauguuugucaaguggaaaguugaguauauuaagaccgaagccaucgugugcguggagcugacuucccaggaacgacaguguucuuuaauagaggcaggcacaagauucaaucuggggccuguaaccauuacacuuagcgagcccaggaacauccagcaaaaauugccacccgaaauuaucacucuccacccucgcauagaggaaggauuuuucgaccugaugcauguccagaaggugcuaucagccaguaccguuugcaagcugcaguccugcacgcacggugugccaggcgaccuccaggucuaccacaucgggaaucugcuuaaaggagauaaggugaacggccauuugauucacaaaaucgagccgcauuuuaauaccucuuggaugagcugggacgguugugaucuggacuauuacugcaacaugggggauuggcccuccuguacauauacuggcguuacccaacacaaucacgcuucauucauuaacuuacucaauaucgaaacagacuacacuaagagcuuucauuuccacaguaaacgggugaccgcgcauggagauacgccucagcuggaccuuaaggcaagaccaaacuauggcgccggggagauaacaguacuggucgagguggcugauauggaauugcacaccaaaaagauugagaucucuggacucaaguuugccucccugacuugcacaggcuguuacgcaugcagcucggguaucucauguaaagugaggauucaugucgacgaacccgaugagcuaaccguucacgugaagucugacgauccugacguaguggccgcuaguuccagccugauggcccgcaaacucgaguucgggacugacucuaccuucaaggcauuuagcgcgaugccaaaaacaucccugugcuucuacaucgucgaacgagaguauuguaagucaugcaguaaggaagauacgcagaaaugugugaacaccaagcuggagcacccccagagcauuuugauagaacauaaaggaacuaucauuggcaagcaaaauaacacaugcaccgcuaaaacaucuugcuggcuggaguccguuaagucauuuuucuacgguuuaaagaauaugcucaguggcaucuuugggaacguguucgucggaauuuuucuguuccuugccccguuuauccugcuaauacucuucuuuauguucggcuggcggauccuguuuuguuucaaaugcugucguagaacuaggggguuguuccgcuauaagcaccuggaggacgaugaagagaccggauaccggagaauuaucgaaagguuaaauaacaaaaagggcaaaaauaagcuccuggacggugagcgacuugcagaucgccggauugccgaacuguuuagcacgaagacacauaucggg

SEQ ID NO: 10523 - RNA, 3495 nt, Artificial Sequence
  derived and/or modified CDS sequence (opt3) from CCHVF(CCHVF K168_125)__KX013460.1__Gn-NSm-Gc
agcgacgaguccggcgaugacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaagagcuucaaauugugugagaauagugcuacugguaaaucuugcgaaguugacucgauuccugugaagugucgacagggguacugcuuaaaaaucacccaggagggacguggccauguaaagcugucaagaggcagcgaggugguccuagaugcaugugacaguuccugcgaagugaugauaccaaaggggacaggagauauccucguugacuguucugguggccagcaacacuuucugaaagauaaccuuauugaccuggggugcccgaaggugcccuugcucggaaaaauggccaucuauauuuguaggaugagcaaucauccuaagaccacuauggcguuccuguuuugguucuccuuuggcuacgucaucacaugcauagugugcaaagcuauuuucuaucugcucaucauuguagguaccuuagggaagcgguuuaagcaguaccgcgagcugaaaccacagacguguacuaucugcgaaaccacacccacuaacgccaucgaugcagagaugcacgaccuuaauuguucauauaacauuugcccuuacugugccaguagauugaccagcgacggacuggcuaggcauguuacacacugcccaaagcggaaagagaagguggaagagaccgaacuauaccucaaucuggagcgcauacccugggucgugcgaaaacuuuuacaggugucugaauccacgggcgucgcauugaagagaucaagcuggcucaucguucuguuagugcuguucgccguaagucucucuccugugcaauccgcuccaauuggccacgggaaaacuaucgagacauaucaggucagggaggaauacaccagcauaugucuuuuugugcugggaucgauuuuguucaucguuucuugccuaaugaagggucuggugaacuccgucggcaauaucuuuuucccggggcucucaauuuguaagacuugcaguaucggaagcauuaacggcuuugagauagaaucccauaaauguuauugcucucugcuuugcugucccuacugccggcacuguagcgccgaucgugagauccaucagcugcacuugucaauuugcaagaaacgcaagacagguaguaaugugaugcucgcgguauguaaaagaaugugcuucagggcaaccguugaaguguccaacaaggcccugagcauccggucuaucauuaauacgaccuucgucguguguauauuaauccuggcugucugcgugguuucaacaagugccguggagauggagagccuaccugcagggacuugggaacgagaggaagaccucaccaacuuuugucaccaggagugccaaguaacagaaacugagugucugugcccauaugaggcucuugucuugcgcagaccccuguuccucgauuccauugugaagggcaaaaagaaccugcuuaauucuaccucgcuggaaaccagcuuguccaucgaggccccuuggggagcgauuaacguucagucaacauacaaaccaacugugagugccgcaaauaucgcucucucuuggagcuccgucgaacauaggggcaacaagauacuggugucagggcggagcgagucuaucaugaaauuagaggaacgcacgggaauuuccugggaccuggguguagaggaugccagugaaagcaagcuacucacagugucuguuauggaccugucccagauguauucacccgucuuugaguaccuuaguggcgauagacaaguggaagaguggccgaaggcuaccugcacuggggacuguccugagaggugcggauguaccagcucgacaugcuugcacaaagaauggccccauucccguaauuggcgguguaacccaaccuggugcuggggcguggguacuggguguacaugcuguggccuggaugucaaggaccucuucacggauuacauguuuguuaaauggaagguggaguauaucaaaaccgaagccauugugugcguagagcugacuucucaggaacgacaguguagcuuaaucgaggcaggaacaagauucaaucugggcccugucaccauaacacuuucagagcccaggaacauucagcaaaaguugccacccgaaaucauuacucuccacccucgcaucgaggaaggguuuuucgaccugaugcaugugcagaagguucuaagugccuccaccgugugcaaacugcagucuugcacgcacggagucccaggugaccuccagguguaccacauaggcaaucugcuuaagggggauaaaguuaacggacauuugauccacaagauugagccgcauuuuaauaccagcuggauguccugggacggcugugaucuggacuauuacugcaacaugggugauuggcccucauguacauauacuggggugacccaacacaaucacgcuagcuucaucaacuuacucaauauugaaacagacuacacuaaaaguuuucauuuccacucuaagcggguaaccgcgcauggcgauacgccucagcuggaccuuaaagcaagaccaaacuauggagccggcgagaucacaguccugguggagguggcugauauggaauugcacaccaagaagauagagauuuccgggcucaaauuugccagccugacuugcacaggauguuacgcaugcucgucaggcaucucuuguaaggucaggauccauguugacgaacccgaugagcuaaccgugcacguaaaaagugacgauccugacguggucgccgcuuccagcucucugauggcccgcaagcucgaguucgguacugacagcaccuucaaagcauuuuccgcgaugccaaagacaucacugugcuucuacauuguggaacgagaguauuguaagaguugcagcaaagaagauacgcagaaguguguuaacaccaaacuugagcacccccagucuaucuugauugaacauaaggggacuauaaucggaaaacaaaauaacacaugcaccgcuaagacauccugcuggcuggagucagugaaguccuuuuucuacggccugaaaaauaugcucagcgguauuuuuggcaacgucuucguggggaucuuucuguuccuugccccguuuauucugcuaauccucuucuuuauguucggauggcggauacuguuuuguuucaagugcugucguagaacuaggggcuuguuccgcuauaaacaccuggaggacgaugaagagaccggguaccggagaaucauugaaagguuaaauaacaagaaaggaaagaauaagcuccuggacggcgagcgacuugcagaucgccggaucgccgaacuguuuuccacgaaaacacauauuggu

SEQ ID NO: 10524 - RNA, 3495 nt, Artificial Sequence
  derived and/or modified CDS sequence (opt3) from CCHVF(CCHVF K229_194)__KX013463.1__Gn-NSm-Gc
agcgaggagcccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaagggcaaccuuaucgaucuggggugcccccauauuccuuugcucggaaaaauggccaucuacauauguagaauguccaaucacccaaggacaaccauggcguuucuguucugguuuucuuucggcuaugugauuacgugcaucuuuugcaaggcucuguucuacagccucauuaucaucgguacuuuagggaaaaagauuaagcaguaucgggaacugaaaccccagaccuguacaauaugcgagacugccccuguuaacgcaaucgacgccgagaugcaugaucuuaauuguuccuacaacauuugcccauauugugcuucacgcuugaccagugacggacuggcaagacacgugacacagugccccaagaggaaagaaaaggucgaggaaaccgagcuauaccucaaucuggaacggaucccuuggauagugcgcaaacuucugcaaguaagcgagucuacgggcguugccuugaagcgauccucauggcucauugugcuguuaguccugcucacugugagccuuaguccagugcagucugcuccggucggccacgggaaaacaaucgagaccuaccagacuagagaaggauuuacaaacaucugucuguucauguuggguuccauucuauuuaucguuagcugccuggugaagggccucguagacucggugucugauuccuucuuucccgggcugucagucuguaagaccugcaguauuggaagcauaaauggcuucgagaucgaaucccauaaauguuauugcucucuuuucugcuguccuuacugcaggcacuguagcgccgaccgggagauucaucagcugcacuuggguaucugcaagaaacguaagacggggucaaacgugaugcucgcgguuuguaaacgcaugugcuuuaaggcaaccaucgaagccaguagaagggcucuguuaauucgguccauaaucaauacaacuuucgugauuuguauccugacccuagccauuugcgucgugagcacaucugcaguagagauggagaaccucccagcuggcacuugggaacgagaggaagaucugaccucauuuugucaccaagagugccagguuacagaaaccgagugucuuugccccuaugaggccuuggugcugcgcaagccucucuuccuggacaguaucgucaaaggaaagaaaaaucuucugaacagcacuuccuuggaaacgucucucucgauagaggcgccauggggcgccaucaacgugcagagcacauuuaagcccaccgucuccacugcaaauauugcucugucauggaguucuguggaacauagagggaacaaaaucuuaguuaccggaaggagcgaguccauuaugaagcuggaggaacggacaggugugucaugggaucuaggcguagaggacgccagcgaaucuaagcuccugaccgucuccaucauggaucuuagucaaauguacagcccgguguucgaguauuugucuggggaccgccagguugaagaguggccuaaagcuacuugcacaggagauugucccgagagaugcggcuguacguccucaaccugccugcacaaggaauggccacauaguaggaauuggcguuguaacccuacuuggugcugggguguggggacaggcuguaccugcuguggagucgacgugaaagaucucuuuacagaccacauguucauaaaguggaaaguagaguacauuaagacugaagccaucgugugcguugagcugaccagccaggaacggcaguguucguuaauugaggcaggcacgcgauuuaaucuggggcccgucaccaucacacuuuccgagccaagaaacauacaacagaaguugcccccugaaaucauuacucuccauccaaaaaucgaggaaggauucuuugaccugaugcacgugcagaaggugcuaucugccagcaccgucugcaaacugcagucaugcacacacgguauuccgggcgaucuccaaaucuaucauauagggaaucugcuuaagggagacagguugaacggccaccugauucauaaaaucgagccccacuucaauacuagcuggauguccugggaugguugugacuuagauuacuacugcaacaugggggacuggccuucuuguaccuauacgggcguuacacagcacaaucaugcugcguuugugaaccuccugaauaucgaaaccgauuacacuaagacauuccacuuccauagcaaacgcgugaccgcacacggagacacuccacagcuugaucugaaggcccggcccaccuauggcgcuggggagauuacaguauuggucgagguggccgacauggaacuccauacgaagaaaguugagaucuccggacugaaguuugcaucacuagccugcaccggcuguuacagcugcaguucugguauuuccuguaaagugagaauacacgucgaugaaccugacgagcugacugugcacguuaagagcucggauccagacgugguagcugccucaacaucucucauggcaaggaaacuggaguucgggaccgacaguacauuuaaggcguucuccgcuaugcccaagacuagccuuugcuuuuauaucgucgaacgcgaguacuguaaaucuugcagcgaagaugacaccaagaaauguguggauacgaaguuggagcagccgcaauccauucugaucgaacauaaaggaacaauuaucggcaagcagaacgauaccugcacugccaaggcaucaugcugguuagagagugugaaaaguuucuuuuauggucucaagaauaugcugggcucugucuucgggaacuuuuucguuggaauacuucuguuucuagccccuuucgugcuccugguauuguuuuucauguucggcuggaaaauccuguuuuguuucaagugcugucgacggacccguggguuauuuaaauacagacaccucaaggacgacgaggaaacaggauacaggaagauuaucgagcgccugaacuccaaaaagggcaaaaaucggcuucuggauggugaaagauuggcugacaggaagauugccgaacucuucucaacuaaaacccauaucggg

SEQ ID NO: 10525 - RNA, 3495 nt, Artificial Sequence
  derived and/or modified CDS sequence (opt3) from CCHVF(CCHVF K229_243)__KX013466.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaagagauccucauggcucauaguccuguuagugcugcucacggugagccuuaguccgguccagucugcucccguuggccacggcaagacuauugagacauaccagaccagggaaggguuuacuuccaucugucuguucauguugggaagcauccuauuucuggugucgugccucguaaaaggucugguggauucugucuccgacucauucuuuccuggccuuaguguguguaagacaugcagcauuggguccaucaacggauucgagauugaaucucauaaguguuauugcagccuguucugcuguccauacugccggcacuguucagccgaucgugagauacaucaguugcaccucaguaucugcaaaaagcgcaaaaccggcuccaauguuaugcuggcgguguguaagagaaugugcuuuagggcaacgauugaagccagccggcgagcuuuacugauccgcucuaucauuaacaccacauucgucauauguauccuaacucucaccauuugcgugguaucaacaagugccguugagauggagaaucugcccgcagguacuugggaaagagaggaagaccuuaccaacuuuugucaccaagagugccaggugacagaaaccgaguguuugugcccuuaugaggcucugguccucaggaaaccacuguuccuugauagcaucgugaaggggaugaagaaucuguugaacuccacuucucucgaaacgucgcugagcauugaggcccccuggggcgcgaucaacguccaguccacauuuaaaccgaccgugucaacugccaauauagcauuaaguuggucuagcguugaacaucggggaaacaagauccuggugaccggccgcuccgagucaauuaugaaacuagaggaaagaacagggguaagcugggaccucggagucgaggaugcuucugaauccaagcugcuuaccgugaguaucauggacuugagccaaauguacucuccuguuuucgaguaucuguccggugaucgucagguggaagaguggcccaaagccacuugcacaggcgacuguccagagaggugcggguguacgucaaguaccugccuccacaaggaauggccucauagccggaauuggcgauguaaccccacuuggugcuggggagucggcacagguuguaccugcugugggguggauguaaaggaccuguuuacagaccacauguucgugaaauggaagguugaguacauuaaaacugaagcuaucgucugcguggaguuaaccucgcaggaaagacaguguucccugauagaggccggcacgagguuuaaucuuggaccagugaccauuacauugucugagccccgcaacauccaacagaagcucccuccagaaauuaucacucugcauccgaaagucgaggaaggcuucuuugaucuaaugcacguucagaaggugcugagcgcaucaaccgugugcaagcuccagaguugcacacacgggauacccggagaccugcaaguauaucauaucgguaaucuuuugaaaggcgaucgggucaacgggcaccugauucauaagaucgagccucacuucaauacuuccuggaugucuugggacggaugugauuuagacuacuacugcaacaugggcgauuggccaagcuguaccuauacgggugugacacagcacaaucaugccgcuuuuguuaaccuccugaauauugaaaccgacuacacuaaaacauuccacuuccauuccaagagagugaccgcgcacggggauacuccccagcuugaccugaaagcaaggccuaccuauggcgccggagagaucacagucuugguggagguugcugauauggaacuccauacgaagaaaguggagauaucaggccugaaguuugccagccuagcaugcaccggguguuacgccugcaguucuggaauuuccuguaagguacgcauccacgucgacgaaccagaugagcugacugugcacgugaaaagcucggaccccgacgucguugcugccucaacaucucucauggcacgaaagcuggaguucggcaccgauaguacauuuaaagcguucuccgcuaugccgaagacuagccuuugcuuuuauaucguggaaaaagaguacuguaagucuugcagcgaagaggacacccagaaguguguagauacgaaauuggaacaaccucaguccauucugaucgagcauaaggguacaauuauagggaaacagaacgauaccugcacugccaaggcaucaugcugguuagagagugugaaaucuuucuuuuauggacucaagaauaugcugggcagcgucuucgguaacuuuuucaucggcauucuucuguuucuaaccccauucgugcuccugguuuuguuuuucauguucggguggaagauccuguuuuguuucaaaugcugucggcguacaagaggauuacucaaguacaggcaccugaaagacgacgaagagacuggcuaccgccggauuaucgaaagacuuaacaauaagaaagggaagaacaggcuguuggauggagagcgacucgccgaccgcaagauagcugaacuguuuuccaccaaaacacauaucggc

SEQ ID NO: 10526 - RNA, 3495 nt, Artificial Sequence
  derived and/or modified CDS sequence (opt3) from CCHVF(CCHVF K315_14)__KX013469.1__Gn-NSm-Gc
agcgaggaacccggcgacgauugcaucuccagaacccagcugcucaagacagagacugccgaaauucacgacgauaacuacgggggaccuggugacaaaauaacgaucuguaauggcucuaccguggucgaucaaaggcuugggucagagcugggaugcuauacaauuaaccggguuaagaguuucaaauuguguaagaauagcgcuacuggcaaaaccugcgaaaucgacuccacaccagugaagugucgccaggguuuuugcuuaaagauuacccaggaggggcgaggacauguaaaacugucucguggcucggaggugguccuagaugugugugacucaagcugcgaaaucaugauaccgaagggcacuggggauauccucguugacuguaguggaggucagcaacacuuccugaaagauaaccuuauugaccugggcugcccccauaucccuuugcucgggaagauggcaauuuacaucuguagaauguccaaucacccaaggacaaccauggccuuucuguucugguuuucuuucggauaugugauaacgugcaucuuuugcaaagcgcuguucuacagccucauuauuaucggcacuuuagguaagaagaucaaacaguaucgggagcugaagccccagaccuguacaauuugcgaaacugcuccugucaacgccauagaugcagagaugcaugaccuuaauuguuccuacaacaucugcccauauugugccucacgcuugaccagugaggggcuggcuagacacgugacacagugccccaaaaggaaggaaaaaguagaggaaaccgagcuauaccucaaucuggaacggauuccuuggaucguucgcaaacuucugcaagugagcgagucuacgggagucgcauugaaacgauccucauggcucauagugcuguuagugcugcucacugucagccuuaguccaguucagucugccccggugggccacggcaagacaauugagaccuaccagacuagagaaggguuuacauccaucugucuguucauguugggaagcauccuauuuauuguaucgugccuggugaagggucucgucuauucuguguccgacucauucuuucccggccugaguguuuguaaaaccugcagcaucggguccauuaacggauucgagauagaaucucauaaguguuacugcagccuuuucugcuguccuuauugcaggcacuguucagcugaucgggagauccaucagcugcacuugaguauuugcaaaaagcguaaaacgggcuccaaugugaugcucgccgucuguaagcgcaugugcuuuaaggcgaccaucgaagcaagcagaagggcccuguuaauccggucuauuauaaacacaacuuucgugaucuguauucugacccuagcuaucugcguaguuucaacaagugccguggagauggaggaccucccagcagguacuugggaacgagaggaagaucugaccaauuuuugucaccaagagugccaggucacagaaaccgagugucuuugccccuacgaggcuuuggugcugcgcaaaccucucuuccuggacagcauugucaaggggaugaaaaaguuacugaacuccacuucuuuggaaacgucgcucagcaucgaggccccauggggcgcgauaaaugugcaguccacauuuaaacccaccguuucaacugccaacaucgcacugaguuggucuagcguggaacauagaggaaacaagauuuuaguaaccggcagguccgagucaaucaugaagcuggaggaacggacaggggucagcugggaucuaggaguggaggacgcuucugaauccaaacuccugaccguuaguauuauggaucuuagccaaauguauucuccgguguucgaguacuuguccggugaccgccaggucgaagaguggccuaaggccacuugcacaggcgauugucccgagagaugcggguguacgucaaguaccugccugcacaaagaauggccacauagcaggaauuggcguuguaacccuacuuggugcuggggagugggcacagguuguaccugcugugggguagacgugaaggaucucuuuacagaccacauguucaucaaauggaagguugaguauauaaagacugaagcuauugucugcguggagcugaccucgcaggaacggcaguguuccuuaaucgaggccggcacgcgauuuaaucugggacccgugaccauuacacuuucugagccaagaaacauccaacagaaauugcccccugaaauaaucacucuccauccaaagauugaggaaggcuucuuugaccugaugcacguccagaaaguucuaagcgcaucaaccgugugcaagcugcagaguugcacacacgggaucccgggagaucuccaaauuuaccauaucgguaaucugcuuaaaggcgacagggugaacgggcacuugauacauaagauugagccccacuucaauacuuccuggaugucuugggauggaugugaccuggauuacuauugcaacaugggcgacuggccuagcuguaccuacacggguguaacacagcacaaucaugccgcuuuugucaacuuacucaauaucgaaaccgauuauacuaaaacauuccacuuccauuccaagcgcgugaccgcgcacggggacacuccacagcuggaucuuaaggcacggcccaccuacggcgccggagagaucacaguucugguggaggucgcugacauggaauugcauacgaaaaagguggagauuucaggccucaaauuugccagccugaccugcacuggguguuaugcaugcaguucuggaaucuccuguaagguuaggauucacguggaugaaccugacgagcuaacaguacacgucaaaagcucggauccagacgugguggccgcuucaaccucucugauggccagaaagcucgaguucggcacagacaguacuuuuaaggcauucuccgcgaugcccaaaaccagccugugcuuuuacauagucgaacgcgaguauuguaagucuugcagcgaagaugacacgaaaaaguguguugauacaaaacuugagcagccgcaauccaucuugauugaacauaaggguaccaucauugggaagcagaacgacacuugcaccgcuaaagccucaugcuggcuggagaguguaaagagcuucuuuuacggacuuaaaaauaugcucggcucuguguucgguuccuuuuucgugggcauccugcuuuuucuggcaccuuucguccuacucgugcuguuuuucauguucggguggaagauauuguuuuguuucaaaugcugucgacggacacguggacuguuuaaguacagacacuuaaaggaugacgaggaaacuggcuauaggcgcaucauugagcggcucaacucaaagaaggggaaaaauagacugcuugauggagaaaggcuggccgaccgaaagaucgcugaguuguucaguaccaaaacacauauuggc

SEQ ID NO: 10527 - RNA, 3495 nt, Artificial Sequence
  derived and/or modified CDS sequence (opt3) from CCHVF(CCHVF K323_27)__KX013472.1__Gn-NSm-Gc
agcgaggagcccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuaccucuuaauuaucaucggcacucuggguaaaaagauuaagcaguaucgggaacuuaaaccccagaccuguacaauaugcgagacugccccuguuaacgcaaucgaugccgagaugcaugacuugaauuguagcuacaacauuugcccauauugugcuucccgccugaccucagacgggcuagcaagacacgugacacagugccccaagaggaaagaaaaggucgaggaaaccgagcucuaccugaaucuugaacggaucccuuggauagugcgcaaacuguugcaaguaagugagagcacgggaguugcccucaagcgaucuuccuggcugacuguguuacugguccuccuuacagugucacugagcccagugcagagugcuccggucggccacggcaacaccauugagacuuaccagacaagagaaggguuuaccucuaucuguuuguucaugcuaggauccauccuguuuauuguuagcugccucgugaaaggucugguagauucggugucugacuccuucuuucccggccuuucagucuguaagacgugcaguaucgggagcauuaauggauucgagauagaaucccauaaguguuauugcucucuguucugcuguccucacugcaggcaucggagcgccgaucgugagauccaccaguugcaccucucaauuuguaaaaagcgcaaaaccggcaguaacgugaugcuggcgguuugcaagagaauguguccaaaagcaacaaucgaagccuccaggcgggcuuuacccauccgaagcauuauaaauacuacccuggugaugugcauccuaacacucgccauuugugucgugucuacuucagcaguagagauggaggaccugccugcugguaccugggaacgcgaggaagaucuuacaaacuuuugccaucaagagugucagguuaccgaaacugagugcuuguguccauacgaggcccuggugcucagaaagccccuguuccuugacaguaucgcgaaggggaugaaaaaucuguugaacagcacgucccucgaaacaucucugucgauugaggccccguggggcgcaaucaacguccagagcaccuuuaagccuacuguguccaccgcuaauauagccuuaucauggaguucugucgaacacaggggaaacaaaauccuggugacaggccggagcgaguccauuaugaagcuagaggaacgcaccgggguuucaugggaucucggaguggaggacgcuagcgaaucuaaacugcuuacuguauccaucauggauuugagucaaauguauagccccgucuucgaguaccugucuggugacagacagguggaagaguggccaaaggccacaugcacgggcgauugcccugagaggugugggugcaccuccucaacuugucuccauaaggaauggccccacagucguaauuggcggugcaacccaacaugguguuggggaguuggcaccgguugcacauguugcgggguggacgucaaagaccuguuuacugaucauauguucauuaaguggaaaguggaguauaucaagaccgaagcaauaguauguguggaguuaacgggccaggaacgacagugcagccugauugaggccggaaccagauuuaaucuuggccccguuacaaucacuuugucggagccuaggaacauucaacagaaacucccaccggaaaucauaacccugcaccccaagaucgaggaaggguucuuugaccuaaugcacguccagaaggugcuguccgcuucuacaguguguaaacuccagagcugcacucaugguauuccuggagaucugcaaaucuaccacauuggcaaucuuuugaagggggaccgcgucaacggacaucugauccacaaaauagagccacacuucaauaccucauggaugaguugggauggcugcgacuuagauuauuacuguaacaugggugacuggcccuccugcacguacacagggguuacccagcauaaucacgcggcauuugugaaccuccugaauauugaaacugauuauacaaagaccuuccauuuucacucuaaacgggugacugcccauggcgacaccccucagcuugaucugaaggcuagaccaacauacggagccggcgagaucacgguauuggucgagguggcagacauggaacuccacaccaaaaagguugagaucagcgggcugaaguucgccucccuaacuuguacaggaugcuaugcuuguucaagcggcauuaguugcaaagugaggauccacgucgaugaacccgacgagcugaccgugcauguuaagucuuccgacccggaugugguagccgcaagcacaucgcucauggcgcgcaaacuggaguucgguacugacucaaccuuuaaggcuuucucugccaugccuaaaacgagucuuuguuuuuacauugucgaacgagaguauugcaaguccuguagcgaagaugacacaaagaaaugcguggauaccaaguuggagcagccacaaucuauacugaucgaacacaaagggacuauuaucggaaagcagaacgacaccuguacagcaaaagccagcugcugguuagaguccgugaagucauucuuuuacggccucaagaauaugcuggguagugucuucggcagcuuuuucguugggauucuucuguuucuagcucccuucgugcuccugguauuguuuuucauguuuggauggaaaauccuguucugcuucaaguguugccggcguacuagaggcuuauuuaaauauaggcaucucaacgaugacgaggaaaccggguaccgccggauaaucgagagacugaacucuaagaaaggaaagaauaggcuucuggauggcgaacgauuggccgaccgcaagauugcagaacucuucuccacaaaaacgcacaucggu

SEQ ID NO: 10528 - RNA, 3495 nt, Artificial Sequence
  derived and/or modified CDS sequence (opt3) from CCHVF(CCHVF K340_6)__KX013475.1__Gn-NSm-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggugaagaguuucaaauugugugaaaauagcacuaccggcaagacaugcgagauugacuccaccccaguuaaaugucgccaggguuuuugcuuaaagaucacucaggaggggcgaggacaugugaagcugucucguggcucggaaguagugcuagaugcuugugacucaagcugcgagauaaugaucccgaaaggcacaggggauauucucgucgacuguaguggaggucagcaacacuuccugaaggauaaccuuaucgaccugggcugcccccauauuccuccauuggggaaaauggcaaucuacauauguagaauguccaaucaccccaggaccacgauggccuuucucuucugguuuucuuucggauaugugauuacuugcaucuuuugcaaggcgcuguucuacagccugauuaucaucggcacccucgguaaaaagauuaagcaguaucgggaauuaaaaccucagacauguacuauaugcgagaccgcuccaguuaacgccaucgaugcagagaugcaugaccugaauuguuccuacaacauuugccccuauugugccucacgccuuacaagugacggguuggcuagacacgugacccagugcccuaagaggaaagaaaaggucgaggaaacggagcuguaccuaaaucucgaacggaucccauggauagugcgcaaacugcuucaaguaagcgagucuacuggaguugcacugaagcgauccucaugguugauugugcuccuggucuuacugacagugagccucaguccggugcagucugcccccgucggccacggcaaaaccaucgagacuuaccagacaagagaaggguuuaccuccaucugucuuuucaugcugggaagcauuuuguuuaucguuucgugccuagugaagggucugguagauucuguguccgacucauucuuuccuggccucagugucuguaagacgugcagcauuggguccauaaacggauucgagaucgaaucucauaaauguuauugcagccuguucugcuguccauacugcaggcacuguucagcugaucgggagauucaucagcuucaccugaguaucugcaagaaacguaagaccggcuccaaugugauguuggccguuuguaaacgcaugugcuuuaaggcgacaaucgaagcaagcagaagggcccuccugauucggucuauaaucaacacuaccuucgugauguguauuuuaacacuggcuaucugcgucgugucaacaagugccguagagauggaggaccuacccgcagguaccugggaacgagaggaagaucucacaaauuuuugucaccaagagugccagguuaccgaaacugagugucugugcccuuaugaggcucuuguguugcgcaagccacugagccucgacuccauugucaaagggaugaagaaccugcuuaauucuacgucgcuggaaacuagcuuguccaucgaggcccccuggggcgcgauaaacgugcagucaaccuucaaaccgacugucaguaccgccaacaucgcacucucuuggagcuccguggaacauagaggaaauaagauucugguuacaggcaggucagagagcaucaugaaauuagaggaacggaccggggugucuugggaucugggaguagaggacgcuuccgaaaguaagcuacucacugucagcauuauggaucugucucaaauguacuccccuguguuugaguaucuuucaggugaccgccagguugaagaguggcccaaggccacaugcacgggcgauuguccagagagaugcggguguaccaguagcacuugcuugcacaaagaauggccucauucgaggaacuggcguuguaaucccacauggugcuggggagugggcaccgguuguacaugcuguggggucgacgugaaggaccuguucacugaucacauguuuaucaaauggaagguagaguacauaaaaaccgaagcuauugugugcguugagcucacgucccaggaacggcaguguucucugaucgaggccggcacccgauucaacuuaggaccagucacaauuacucugagcgagcccagaaauauccaacagaaacuuccuccagaaauaaucaccuugcauccgaagauugaggaaggcuuuuucgaccucaugcacgugcagaaggugcugucagcaaguacagucugcaagcuacaguccugcacucacgggauccccggagaucugcaaauuuaucauaucgguaaccuccugaaaggcgacaggguuaaugggcaccuuauacauaagauugagccucacuuuaacaccucuuggaugagcugggauggaugugacuuggauuacuacugcaauaugggcgacuggccauccuguacguauacaggugugacccagcacaaccaugccgcuuucgugaaucuguuaaacaucgaaacugauuacacaaaaaccuuucacuuccauucaaagcgcguaacugcgcacggggacacuccccagcucgaucugaaagcacggccuacauauggcgccggagagaucacgguccuuguggagguuaccgacauggaacugcauacuaagaagguggagauuagcggcuugaaauucgcuagucucacaugcaccggguguuacgccuguucuuccggaaucagcugcaaggucaggauucacguggaugaaccagacgagcugacaguucacgugaaaucgucagaccccgauguagucgcagccucuaccagucuaauggcuagaaagcuggaguuuggcaccgacuccacguucaaagccuuuagcgcaaugccgaagacaucucucugcuucuauauaguggaacgcgaguacuguaagagcugcuccgaagaugacaccaaaaaguguguggauacuaaacuggagcagccucaaucaauccuuauugaacauaaggguaccaucauugggaaacagaaugacacaugcacugcgaaggcuaguugcugguuggagagcgucaaguccuuuuucuauggacugaaaaacauguuaggcucuguuuuugguucauucuuugugggcauccuccuguuccuugccccauuuguacugcuaguccucuucuuuauguucggguggaagauacuguucuguuuuaaaugcugucgacggacccguggauuguucaaguacagacacuuuaaagaugacgaggaaacaggcuacaggcgcaucauugagcggcugaauaguaagaaggggaaaaacagauuacucgauggagaaaggcuggcagaccgaaagaucgccgagcuuuucagcacgaaaacccauauuggc

SEQ ID NO: 10529 - RNA, 3495 nt, Artificial Sequence
  derived and/or modified CDS sequence (opt3) from CCHVF(CCHVF Mamon)__KX013478.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugucagaugcaugugacagcaguugcgaggucaugauaccgaagggcacuggggauauccuaguggacuguuccggaggucagcaacacuuccucaaagauaaccugauugaccuuggcugcccccauaucccucuguuggggaagauggccauuuacaucuguaggaugucuaaucacccacggacaaccguugcguuucucuucugguuuagcuucggauaugugauaacgugcaucuuuugcaaagcucuguucuacucccugauuauuaucggcacucucgguaagaaaaucaagcaguaucgcgaauuaaagccccagaccuguacaauuugcgagacugccccugucaacgcaauagaugccgagaugcaugaccugaauuguucauacaacaucugcccauauugugcuaguagacuuaccagcgacggguuggcaaggcacgugccccagugcccuaaacggaaggaaaaaguagaggaaacagagcuguaccuaaaucucgaacgcauuccauggaucguucgaaagcugcuucaagugucugaguccaccggagucgcccugaaaagaucaagcugguugauagugcuccugguguuacugacggucagucucucuccgguucaguccgcucccgugggccacggcaagacuauugagacauaccagaccagggaaggguuuacuagcaucugucuuuucaugcugggaucgaucuuguuucuaguaucuugccuggugaaaggucucgucgauuccgugucagacaguuucuuuccuggccugagcguuuguaagacaugcuccauugggucuaucaacggauucgagauugaaagccauaaguguuauugcucacuuuucugcuguccauacugccggcacuguagugccgaucgugagauacaucagcugcacuuguccaucugcaaaaagcgcaaaaccggcagcaaugugaugcucgcggucuguaagagaaugugcuuuagggcaacgauugaagccucucggcgagcucuguuaauccgcucaaucauuaacaccacauucgugauauguauccugacucuaaccauuugcguaguuaguacaagcgccguggagauggagaaucuccccuccgguacuugggaaagagaggaagaccugaccaacuuuugucaccaagagugccaggucacagaaaccgagugucuuugcccuuaugaggcauuggugcugaggaaaccacucuuccuggauucuaucgucaaggggaugaagaaucuucugaacucgacuagcuuggaaacgucccucucaauugaggcucccuggggcgccaucaacgugcagaguacauuuaaaccgaccguuucuacugcgaauauagcccugagcugguccucaguggaacaucggggaaacaagaucuuaguaaccggccgcagcgagucuauuaugaaacuggaggaaagaacaggggucuccugggaccuaggaguggaggaugcaagugaaagcaagcuccugaccguuucuaucauggaccuuucccaaauguacucaccuguguucgaguauuugaguggugauaggcaggucgaagaguggcccaaagcuacuugcacaggcgacuguccagagcguugcggguguacgagcucgaccugccugcacaaggaauggccucauucccggaauuggcgauguaaccccacuuggugcuggggagugggcacagguuguaccugcugugggguagaugugaaggaccucuuuacagaccacauguucguuaaauggaaggucgaguacauuaaaacugaagccaucgugugcguggagcugaccucucaggaaagacaguguagcuuaauagaggcuggcacgagguuuaaucugggaccagucaccauuacacuuucagagccccgcaacauccaacagaaguugccuccagaaauuaucacucuccauccgaaaguugaggaaggcuucuuugaucugaugcacgugcagaaggugcuaagugccuccaccguaugcaagcugcagucuugcacacacgggauacccggagaccuccaagucuaucauaucgguaaucugcuuaaaggcgaucgggugaacgggcacuugauucauaagaucgagccucacuucaauacuagcuggauguccugggacggaugugaucuggacuacuacugcaacaugggcgauuggccaucauguaccuauacggguguuacacagcacaaucaugcagccuuugugaacuuacucaauauugaaaccgacuacacuaaaacauuccacuuccauagcaagagagucaccgcucacggggauacuccccagcuggaccuuaaagcgaggccuaccuauggcgcaggagagaucacagugcugguugagguggccgauauggaauugcauacgaagaaaguagagauaaguggccucaaguuugcuucucuggccugcaccggguguuacgcaugcuccagcggaauuucguguaagguccgcauccacguggacgaaccagaugagcuaacugugcacgucaaaucaucugaccccgacguuguggccgcuaguacaucccugauggcccgaaagcucgaguucggcaccgauagcacauuuaaagcauucucugcgaugccgaagacuagccugugcuuuuauaucguagaacgggaguacuguaaauccugcucagaagaggacacccagaaguguguggauacgaaacuugaacaaccucagaguauuuugaucgagcauaaagguacaauuauagggaagcagaacgauaccugcacugcuaaaaccagcugcuggcuggagucugucaaguccuucuuuuauggauuaaagaauaugcucggcucaguguucgguaacuuuuucaucggcauucugcuuuuucuggccccauucguucuacucgugcuguuuuucauguucggguggaagaucuuguuuuguuucaagugcugucguagaacaaggggacuguuaaaauaccgccaccucaaggacgacgaagagacuggcuaccggagaauuaucgaaaggcugaacaauaaaaaggggaaaaaccgacuucuggauggagagcgcuuggcagaccggaagauagccgaacucuuuaguaccaagacacauaucggc

SEQ ID NO: 10530 - RNA, 3495 nt, Artificial Sequence
  derived and/or modified CDS sequence (opt3) from CCHVF(CCHVF Min)__KX013481.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaagagauccucauggcucauaguccuguuagugcugcucacggugagccuuaguccgguccagucugcucccguuggccacggcaagacuauugagacauaccagaccagggaaggguuuacuuccaucugucuguucauguugggaagcauccuauuucuggugucgugccucguaaaaggucugguggauucugucuccgacucauucuuuccuggccuuaguguguguaagacaugcaccauugggagcaucaacggauucgagauugaaucccauaaguguuauugcucucuguucugcuguccauacugccggcacuguagcgccgaucgugagauacaucaguugcaccucucaaucugcaaaaagcgcaaaacgggcaguaauguuaugcuggcgguguguaagagaaugugcuuuagggcaaccauugaagccucccggcgagcuuuacugauccgcagcaucauuaacacaacuuucgucauauguauccuaacccucacaauuugcgugguaucuacuucagccguugagauggagaaucugcccagugguaccugggaaagagaggaagaccuuacaaacuuuugucaccaagagugccaggugaccgaaacugaguguuugugcccuuaugaggcacugguccucaggaaaccacuguuccuugauagcaucgugaaggggacgaagaaucuguugaacuccacaucucucgaaaccucgcugagcauugaggcucccuggggcgccaucaacguccaguccacuuuuaaaccgaccgugucaacagcgaauauagccuuaaguuggucuagcguugaacaucggggaaacaagauccuggugaccggccgcuccgagucaauuaugaaacuagaggaaagaacugggguaagcugggaccucggagucgaggaugcaucugaauccaagcugcuuacagugaguaucauggacuugagccaaauguacucuccuguuuucgaguaucuguccggugaucgucagguggaagaguggcccaaagcuacgugcaccggcgacuguccagagaggugcggguguacuucaaguacaugccuccacaaggaauggccucauagccggaauuggcgauguaaccccaccuggugcuggggagucggcacagguuguacuugcugugggguggauguaaaggaccuguuuaccgaccacauguucgugaaauggaagguugaguacauuaaaacggaagccaucgucugcguggaguuaaccucgcaggaaagacaguguucccugauagaggcuggcacaagguuuaaucuuggaccagugacuauuaccuugucugagccccgcaacauccaacagaagcucccuccagaaauuaucacacugcauccgaaagucgaggaaggcuucuuugaucuaaugcacguucagaaggugcugagcgccucaacugugugcaagcuccagaguugcacccacgggauacccggagaccugcaaguauaucauaucgguaaucuuuugaaaggcgaucggauuaacgggcaccugauccauaagauugagccucacuucaauacguccuggaugucuugggacggaugugauuuagacuacuacugcaacaugggcgauuggccaagcuguacauauaccggugucacucagcacaaucaugcagccuuugugaaccuccugaauaucgaaacagacuacaccaaaacuuuccacuuccauuccaagagaguuaccgcucacggggauacaccccagcuugaccugaaagcgaggccuacguauggcgcaggagagauaaccguguuggucgagguggccgauauggaacuccauacuaagaaaguugagauuucaggccugaaguuugcuagccuagccugcacaggguguuacgcaugcaguucuggaaucuccuguaaggugcgcauccacguagacgaaccagaugagcugaccguccacgugaaaagcucggaccccgacguggucgccgcuucaacaucucucauggcccgaaagcuggaguucggcacugauaguaccuuuaaagcauucuccgcgaugccgaagacgagccuuugcuuuuauauuguugaacgggaguacuguaaaucuugcagcgaagaggacacacagaaguguguggauaccaaguuggaacaaccucaguccauccugauugagcauaaagguacuauaaucgggaagcagaacgauaccugcacagcuaaagccucaugcugguuagagaguguaaagagcuucuuuuauggacucaaaaauaugcugggcucuguguucgguaacuuuuucauuggcauccuucuguuucuagcaccauucguccuccugguguuguuuuucauguucggguggaagauucuguuuuguuucaagugcugucguagaacuaggggauuacucaaauaccgccaccugaaggacgacgaagagaccggcuaccggagaaucauagaaaggcuuaacaauaaaaaggggaaaaaccgacuguuggauggagagcgccucgccgaccggaagaucgcugaacuguuuuccacaaagacgcauauuggc

SEQ ID NO: 10531 - RNA, 3495 nt, Artificial Sequence
  derived and/or modified CDS sequence (opt3) from CCHVF(CCHVF Nakiwogo)__KX013484.1__Gn-NSm-Gc
gccgagggcgugagcaacgacugcgucuccagaacccagcugaucaagacagaaguugcugagauucacgaagauucuuacgggggacccggugagaaaauaacuaucuguaauggcucaacgauuguggaccaaaggcucgggagugaacuuggaugcuauaccaucaaccggguaaagacauacaaacugugugagaauagcgcaacugagaagggcugcgaaauugauuccgugccugucaaauguaagcaggguuucugcuugaaggugacccaggaggggcgcggacauguuaaauuaucucgaggcacagaaaucgugcuggacgucugugauaccucgugcgagcuaaugauaccaaagggcacuggggacauccucguggauuguucaggaggucagcaacacuuucugcaggacaaccuuauugaucugggcugcccgaauguacccuugcucgggaaaauggccaucuauauuugucguaugagcaaccauccuaagacaaccauggcguuccuguuuugguucaguuuuggauacguuaucacgugcguggucugcaaagugcuguucuaucucuuaauagugauuggcacucuggguaagaaacuuaaacaguacagagaguugaagccacagaccuguaucgucugcgaauccauucccguuaaugugaucgacgcugagaugcacgaacugaacuguaauuauaacaucugcccuuacugugccucuaggcuaacaagcgaugggcucguacggcaugugacucaaugcccaaaacgcaaggagaaagucgaagagaccgagcuguaccuuaaucuggaaaggauucccugguuggugagacggcuccugcagguuuccgagucaacaggaauggcauuaaagcgcaguuguuggaugaccacgcugcucauacuucugguggucagcuugucuccugugcaguccgccccaguaggccaggaaaaagcuaucgagguuuaucaagugcgagaaucauacacuagcaugugccuauuuguccugggcaguguccucuucgcagugucuuggcuggugaaggggcuuauugacggaaucgguaacuccuuuuucccgggccugagcguuuguaagacaugcucgauagggucuauuaauggauuugagaucgagucccacaaauguuauugcucauuguucugcugucccuacugcagagccuguaguagcgauaagaucacccacaggaugcaucucaacauuugcaaacggcguaaggugggcuccaauguaaugcuggcugucuguaaacgcaugugcuuuaaggccacuguggaagcgucuaacagcgcauuacugaucagaucaauuauaaacaguacauucguuaucugugugcuaauucucgucaucugcgugguauccaccagcgccguggacauggagaaucugccugcugguaucugggaaagggaggaagaccuuacgaacuucugucaccaggagugccagguuaccgagacagaauguuugugcccauaugaggcccugauucuccggaagccccuguaccuugauucuauagcaaaagggaugaagucacuguugaauaguacuaaccucgaaaccagccuguccaucgaggcuccuuggggcgccauuaauguccaaucuacauuuaaaccaacugugucggcggccaacaucgcauuaagcugguccucaguggagcaucgaggaaauaagauucuggucaguggccgcucugaaagcaucaugaaacuagaggaaagaaccgggauauccuggucacucggaguugaggacgcuagcgaaucuaagacacugaccguguccgugauggaucuuagucagauguauagccccguauucgaguacuugucuggugacaggcaggucgaggaauggccgaaggccacuugcacgggcgauuguccugagcggugcggguguacauccucaaccugccugcacaaagaauggccccacagucgcaacuggagauguaauccaacuuggugcuggggagugggcaccgguuguacaugcugugggcucgacguuagggaucuguuuaccgacuacaugauggugaaguggaaagucgaguaugugaagacugaagcuaucaugugcguugaguuaacaagccaggagcgucaauguucgcugauugaagccggcacgcgguucaaccuuggaccugugaccaucacuuuguccgagccccgaaauguacagcagagacucccaucugaaauugucacacugcaucccaaaaucgaggaaggcuuuuucgaucuaaugcacgugcagaaggugcuguuuugcaagcauagccuccaagcaaccucaugcacacacggggucccuggagaccugcagguuuaccauguggguaaccuuuugaaaggcgauaagguaaaugggcacaguauacacaaaauugagucccauuucaacacuucuuggaugagcugggacggaugugaccuggauuauuuuugcaauaugggcgacuggccauccuguaccuacacgggugugacccagcacaacagggccgcuuucgucaacauguuaaauaucgagacagauuauacuaagaccuuucauuuccacucaaaacgcgugacagcgcacggggacacuccgcagcucgaucugaaggcacggcccaccuacggcgccggagaaguuacggugcuugucgagguggcugaccuggaauugcauacaaagaagauugagguuagcggccucaaguuugccagucugaccugcucuggguguuaugcaugcuccagcggaaucucguguaaagugagaauacacgucaacgagccugaugaguucacuguacaugugaagucaaaugacccagauguuguggccgcuggcucuagucuaauggccaggaaaaucgaacugggugcagacuccacauucaaggcguuuagcucuaugcccaaaaacagccucugcuucuacauugucgaacgcgauuacuguuccucaugcaccgacgaugacacucaaaagugugugaauaccaagcuggagcacccucagaguauccuuauugaacauaaagggacaaucauaggaaagcagaacgacacgugcccaaccaaaacuagcugcugguuggagucuguaaaguccuuuuucuauggccugaaaaauauguuagguggcauuuuugggaacguguuccucggaaucuuucuguuccuugcucccuuugcccugcuaauccucuucuuuuucuuuggcuggcgacuguuguucugucugaagugcugucggcguacaagaggguuacucaaguacaaacagcugaaggaugaggaagaggcaggauauaaaaagauuaucgaaaggcuuaaugacaaaaagggcaagucacgccuguucgauggugagcgguuggccgacagaaaaauugcugaacucuuuaguaccaagacacacauaggg

SEQ ID NO: 10532 - RNA, 3495 nt, Artificial Sequence
  derived and/or modified CDS sequence (opt3) from CCHVF(CCHVF Saf)__KX013487.1__Gn-NSm-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuaccugaaagauaaccuuauugaccugggcugcccccauaucccuuugcucgggaagauggccauuuauaucuguaggauguccaaucacccacggacaaccauggcguuccuguuuugguucucuuuuggauacguuauaacgugcauuuucugcaaagcucuguuuuauagccucaucauuaucggcacuuuagguaagaaaaucaagcaguaccgcgaacugaagccccagaccuguacaauuugcgagacugccccugugaacgcaauagaugccgagaugcaugaccuuaauuguuccuauaacaucugcccauacugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaaaagauccucauggcucauaguccuguuagugcugcucacggugagccuuaguccgguccagucugcucccguuggccacggcaagacuauugagacauaucagaccagggaaggguucacuuccaucugucuguuuauguugggaagcauccuauuccuggugucgugccucguaaaaggucugguggauucugucuccgacucauuuuucccuggccuuaguguguguaagacaugcagcauuggguccaucaacggauuugagauugaaucucauaaguguuacugcagccuguucugcuguccauauugccggcacuguucagccgaucgugagauacaucaguugcaccucaguaucugcaaaaagcgcaaaaccggcuccaauguuaugcuggcgguguguaagagaaugugcuucagggcaacgauugaagccagccggcgagcuuuacugauccgcucuaucauuaacaccacauuugucauauguauccuaacucucaccauuugcgugguaucaacaagugccguugagauggagaaucugcccagcgguacuugggaaagagaggaagaccuuaccaacuucugucaccaagagugccaggugacagaaaccgaguguuugugcccuuacgaggcacugguccucaggaaaccacuguuuuccgauucuaucgugaaggggaugaagaaucuucugaacucgacuagcuuggaaacgucccucucaauugaggcucccuggggcgccaucaacguccagaguacauucaaaccgaccgugucuacugcgaauauagcccugagcugguccucaguugaacaucggggaaacaagaucuuagugaccggccgcagcgagucuauuaugaaacuggaggaaagaacagggguauccugggaccuaggagucgaggaugcaagugaaagcaagcuccugaccgugucuaucauggaccuuucccaaauguauucaccuguuuuugaguacuugaguggugaucgucagguggaagaguggcccaaagcuacuugcacaggcgacuguccagagaggugcggguguacgagcucgaccugccugcacaaggaauggccucauucccggaauuggcgauguaaccccacuuggugcuggggagucggcacagguuguaccugcugugggguggauguaaaggaccucuucacagaccacauguuugugaaauggaagguugaguauauuaaaacugaagccaucgucugcguggagcugaccucucaggaaagacaguguagcuuaauagaggcuggcacgagguucaaucugggaccagugaccauuacacuuucagagccccgcaacauccaacagaaguugccuccagaaauuaucacucuccauccgaaagucgaggaaggcuuuuucgaucugaugcacguucagaaggugcuaagugccuccaccgugugcaagcugcagucuugcacacacgggauacccggagaccuccaaguauaccauaucgguaaucugcuuaaaggcgaucgggucaacgggcacuugauucauaagaucgagccucacuuuaauacuagcuggauguccugggacggaugugaucuggacuacuauugcaacaugggcgauuggccaucauguaccuacacgggugugacacagcacaaucaugcagccuucguuaacuuacucaauauugaaaccgacuauaugaaaacuuuucacuuccauagcaagagagugacagcucacggggauacuccccagcuggaccuuaaagcgaggccuaccuacggcgcaggagagaucaccguccugguggagguugccgauauggaauugcauacaaagaaaguggagauaaguggccucaaguucguaucucuggcuugcacgggguguuaugccugcuccagcggaauuucguguaagguccgcauccacguggacgaaccagaugagcuaaccgugcacgucaaaucaucugaccccgacguuguggcagccaguacuucccugauggcucgaaagcucgaguuuggcacagauagcaccuucaaagccuuuucugcaaugccgaagacaagccugugcuucuacaucguagaacgggaguauuguaaauccugcucagaagaggacacucagaaguguguggauaccaaacuugaacaaccucagaguauuuugaucgagcauaaggguacgauuauagggaagcagaacgacacaugcaccgcgaaagcuagcugcuggcuggagucugucaaguccuuuuucuacggauuaaagaauaugcucggcucaguguuugguaacuucuuuaucggcauucugcuuuuccuggccccauuuguucuacucgugcuguucuuuauguucggguggaagaucuuguucuguuuuaagugcugucguagaacuaggggacuguuaaaauaccgccaccucaaggaugacgaagagaccggcuaucggagaauuaucgaaaggcugaacaauaaaaaggggaaaaaccgacuucuggauggagagcgcuuggcagaccggaagauagccgaacucuucaguacaaagacucauaucggc

SEQ ID NO: 10533 - RNA, 3495 nt, Artificial Sequence
  derived and/or modified CDS sequence (opt3) from CCHVF(CCHVF Ast199)__KX056051.1__Gn-NSm-Gc
agcgaggagcccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuacagccucauuaucaucggcacuuuagguaaaaagauuaagcaguaucgggaacugaaaccccagaccuguacaauaugcgagacugccccuguuaacgcaaucgaugccgagaugcaugaccuuaauuguuccuacaacauuugcccauauugugcuucacgcuugaccagugacgggcuggcaagacacgugacacagugccccaagaggaaagaaaaggucgaggaaaccgagcuauaccucaaucuggaacggaucccuuggauagugcgcaaacuucugcaaguaagcgagucuacgggaguugccuugaagcgauguuccuggcucauugugcuguuaguccugcucacugugucacuuagcccagugcagagugcuccggucggccacggcaaaacaaucgagaccuaccagacuagagaaggguuuacaaacaucugccuguucauguugggaucuauucuauuuaucguuuccugucuggugaagggucucguagauagcgugucggacucuuucuuucccggccuguccgucugcaagaccuguucaauugggaguauaaauggauucgagaucgaaagccauaaaugcuauugcucccuuuucuguugcccuuacuguaggcacugcucugccgaucgggagauucaucagcugcacuugggcaucuguaagaaacguaagacggguagcaacgugaugcucgcgguuugcaaacgcauguguuuuaaggcaaccaucgaagccucaagaagggcucuguuaauucggaguauaaucaauacaacuuucgugauuugcauccugacccuagccauuugugucguguccacaagcgcaguagagauggagaaccucccagcugggacuugggaacgagaggaagaccugaccaauuuuugccaccaagagugucagguuacagaaaccgagugccuuugccccuaugaggccuuggugcugcgcaagccucucuuccuggauucuaucgucaaaggcaugaagaaccuucugaacucaacgaguuuggaaacuagccucuccauagaggcgccauggggagccaucaaugugcagucuacauuuaaacccaccgucucgacugcaaacauugcucugagcugguccucaguggaacauagaggcaauaagaucuuaguuaccgggaggagugagucuauuaugaaacuggaggaacggacaggagugagcugggaccuagguguagaggaugccuccgaaucaaagcuccugaccgucagcaucauggaccuuucucaaauguacuccccgguguucgaguauuugaguggcgaucgccagguugaagaguggccuaaggcuacuuguacaggggacugccccgagagauguggaugcacgagcucuaccugucugcacaaagaauggccacauuccaggaacuggcguugcaauccuacuugguguuggggcguggguacagggugcaccuguugcggcgucgaugugaaggaccucuuuacagaccacauguucauaaaauggaagguagaguacauuaaaacugaagccaucguguguguugagcugaccucacaggaacggcagugcaguuuaauugaggcaggaacgcgauuuaaccugggccccgucaccaucacacuuagcgagccaagaaauauacaacagaaguugcccccugaaaucauuacucuccauccaaagaucgaggaaggguucuuugaucugaugcacgugcagaaagugcuaucggccuccaccgucugcaagcugcagucuuguacacacgguauuccgggagaccuccaaaucuaucauauaggcaaccugcuuaaaggggauagguugaauggacaccugauucauaagaucgagccccacuucaacacuagcuggaugucaugggacggcugcgauuuagacuacuacuguaauaugggugauuggccuaguugcaccuauacggggguuacacagcacaaccaugcugcguuugugaaucuccugaacaucgaaaccgacuacacuaaaacauuccacuuccauuccaagcgcgugaccgcacacggcgauacuccacagcuugaccugaaagcccggcccaccuauggagcuggcgagauuacaguauuggucgagguggccgauauggaacuccauacgaagaagguugaggugucugggcugaaauuugcaagccuagccuguaccggaugcuacgcuuguuccucaggcaucagcugcaaggucaggauucacguggacgaaccugaugagcugacuguucacgugaaaaguucugacccagacguagucgccgcauccacaagccucauggcgagaaagcuggaguucgguaccgauucgacauuuaaggcuuucucagccaugcccaaaacuucucuuuguuuuuauauaguggaacgcgaguacugcaagaguuguuccgaagacgauaccaaaaagugcguggacacgaaauuggagcagccgcaaagcauccugauugaacauaaggggacaaucauuggaaaacagaaugauaccugcacugcaaaggccucuuguugguuagagagcgucaaguccuucuuuuauggccucaaaaacaugcuggguucaguuuucggcaacuuuuucguggggauccuucuguuucuagcuccuuucguacuccugguguuguuuuucauauucggauggaagauccuguuuugcuucaaauguugccgacggacccguggcuuauuuaaguacagacaccucaaagacgaugaggaaacaggguacaggaagauuaucgagcgccugaauaguaagaaaggaaagaaccggcuucuggacggcgaaagauuggccgauaggaaaauugcagaacucuucagcacuaagacccauaucggu

SEQ ID NO: 10534 - RNA, 3495 nt, Artificial Sequence
  derived and/or modified CDS sequence (opt3) from CCHVF(CCHVF Ast149)__KX056054.1__Gn-NSm-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuacagccucauuaucaucggcacuuuagguaaaaagauuaagcaguaucgggaacugaaaccccagaccuguacaauaugcgagacugccccuguuaacgcaaucgaugccgagaugcaugaccuuaauuguuccuacaacauuugcccauauugugcuucacgcuugaccagugacgggcuggcaagacacgugacacagugccccaagaggaaagaaaaggucgaggaaaccgagcuauaccucaaucuggaacggaucccuuggauagugcgcaaacuucugcaaguaagcgagucuacgggaguugccuugaagcgauccucauggcucauugugcuguuaguccugcucacugugagccuuaguccagugcagucugcuccggucggccacggcaaaacaaucgagaccuaccagacuagagaaggguuuacaaacaucugucuguucauguugggauccauucuauuuaucguuagcugccuggugaagggucucguagauucggugucugacuccuucuuucccggccugucagucuguaagaccugcaguauugggagcauaaauggauucgagaucgaaucccauaaauguuauugcucucuuuucugcuguccuuacugcaggcacuguagcgccgaucgggagauucaucagcugcacuugggcaucugcaagaaacguaagacggguucaaacgugaugcucgcgguuuguaaacgcaugugcuuuaaggcaaccaucgaagccaguagaagggcucugccaauucgguccauaaucaauacaacuuucgugauuuguaucuuaacccuggccauuugcgucgugagcacaucugcaguagagauggagaaccuacccgcugggacuugggaacgagaggaagaccucaccaauuuuugucaccaagagugccagguuacagaaaccgagugucugugcccuuaugaggcccuuguguugcgcaagccacuguuccucgauucaaucgucaaaggcaugaagaaccugcuuaacaguacuagccuggaaacguccuugucuauagaggcgcccuggggagccaucaaugugcagucgacauuuaaaccgaccgucagcacugcaaacauugcucucuccuggucaaguguggaacauagaggcaauaagauccugguuaccgggaggucugagagcauuaugaaauuagaggaacggacaggaguguccugggaccuggguguagaggaugccucagaaagcaagcuacucaccgucucuaucauggaccugucccaaauguacaguccuguguucgaguaucuuagcggcgaucgccagguugaagaguggcccaaggcuacuugcacaggggacuguccagagagaugcggauguacgucuaguaccugcuugcacaaagaauggccucauucaaggaacuggcguuguaaucccacuuggugcuggggcguggguacaggguguaccugcuguggcgucgaugugaaggaccuguuuacagaccacauguucauaaaauggaagguagaguacauuaaaacugaagccaucgugugcguugagcucaccagucaggaacggcaguguagccugauugaggcaggaacgcgauuuaacuuaggcccagucaccaucacacugucggagcccagaaauauacaacagaaacuuccuccagaaaucauuacuuugcauccgaagaucgaggaaggguucuuugaucucaugcacgugcagaaagugcuguccgccucuaccgucugcaagcuacagagcugcacacacgguauucccggagaccugcaaaucuaucauauaggcaaccuccugaaaggggauaggcuuaauggacacuugauucauaagaucgagccucacuucaacacuucauggaugaguugggacggcugugaucuggacuacuacugcaauaugggugauuggccauccuguaccuauacggggguuacacagcacaaccaugcugcguuugugaauuuacucaacaucgaaaccgacuacacuaaaacauuccacuuccauucuaagcgcgugaccgcacacggcgauacuccccagcuggaccuuaaagcccggccuaccuauggagcuggcgagauuacaguacuggucgagguggccgauauggaauugcauacgaagaagguugaggugagcgggcucaaauuugcaucccuggccugcaccggauguuacgcuugcucaagcggcaucaguuguaaggucaggauucacguggacgaaccagaugagcuaacuguucacgugaaaucuuccgaccccgacguagucgccgcaagcacaucgcugauggcgagaaagcucgaguucgguaccgauucaacauuuaaggcuuucucugccaugccgaagacuucccugugcuuuuauauaguggaacgcgaguacuguaaguccugcagcgaagacgauaccaaaaaguguguggacacgaaacuugagcagccucaaucuaucuugauugaacauaaggggacaaucauuggaaaacagaaugauaccugcacugcaaaggccagcugcuggcuggaguccgucaagucauucuuuuauggccucaaaaacauguuagguaguguuuucggcaacuuuuucguggggauccugcuuuuucuggcuccauucguacuacucgcccuguuuuucauauucggauggaagaucuuguuuuguuucaaaugcugucgacggacccguggccuguuuaaguacagacacuuaaaagacgaugaggaaacaggguacaggaagauuaucgagcgccucaauagcaagaaaggaaagaaccggcugcuugacggcgaaagacuggcagauaggaaaauugcugaguuguucucuacuaagacccauaucggu

SEQ ID NO: 10535 - RNA, 3495 nt, Artificial Sequence
  derived and/or modified CDS sequence (opt3) from CCHVF(CCHVF Ast137)__KX056057.1__Gn-NSm-Gc
agcgaggagcccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccauccacauauguagaauguccaaucauccaaggacaaccauggcguuucuguucugguuuucuuucggauacgugauuacgugcaucuuuugcaaggcucuguucuauagccucauuaucaucggcacuuuagguaaaaagauuaagcaguaccgggaacugaaaccccagaccuguacaauaugcgagacugccccuguuaacgcaaucgaugccgagaugcacgaccuuaauuguuccuauaacauuugcccauacugugcuucacgcuugaccagugacgggcuggcaagacacgugacacagugccccaagaggaaagaaaaggucgaggaaaccgagcuauaucucaaucuggaacggaucccuuggauagugcgcaaacuucugcaaguaagcgagucuacgggaguugccuugaagcgauccucauggcucauugugcuguuaguccugcucacugugagccuuaguccagugcagucugcuccggucggccauggcaaaacaaucgagaccuaccagacuagagaaggguuuacaaacaucugucuguucauguugggauccauucuauuuaucguuagcuaccuggugaagggucucguagauucggugucugacuccuucuuucccggccugucagucugcaagaccuguaguauugggagcauaaauggauucgagaucgaaucccacaaaugcuauuguucucuuuucugcugcccuuacuguaggcauugcagcgccgaucgggagauucaccagcugcacuugggcaucuguaagaaacguaagacggguucaaacgugaugcucgcgguuugcaaacgcauguguuuuaaggcaaccaucgaagccaguagaagggcucuguuaauucgguccauaaucaauacaacuuucgugauuugcauccugacccuagccauuugugucgugagcacaucugcaguagagauggagaaccucccagcugggacuugggaacgagaggaagaccugaccaauuuuugccaucaagagugucagguuacagaaaccgagugccuuugucccuaugaggccuuggugcugcgcaagccucucuuccuggauucaaucgucaaaggcacuaagaaccuucugaacaguacgagcuuggaaacaucccucucuauagaggcgccauggggagccaucaaugugcagucgaccuuuaaacccacugucagcaccgcaaacauugcucuguccuggucaaguguggaacacagaggcaauaagaucuuaguuacagggaggucugagagcauuaugaaacuggaggaacggaccggaguguccugggaccuagguguagaggaugccucagaaagcaagcuccugacugucucuaucauggaccuuucccaaauguacaguccgguguucgaguauuugagcggcgaucgccagguugaagaguggccuaaggcuacaugcacgggggacugccccgagagauguggaugcaccucuuccacuugucugcauaaagaauggccacacucaaggaacuggcguugcaauccuacaugguguuggggcguggguaccgggugcacauguugcggcgucgaugugaaggaccucuuuacugaccauauguucauaaaauggaagguagaguacauuaaaaccgaagccaucguguguguugagcugacgagucaggaacggcagugcagcuuaauugaggcaggaacccgauuuaaccugggccccgucacaaucacucuuucggagccaagaaauauacaacagaaguugcccccugaaaucauuacccuccacccaaagaucgaggaaggguucuuugaucugaugcacgugcagaaagugcuauccgccucuacagucuguaagcugcagagcugcacucaugguauuccgggagaccuccaaaucuaucacauaggcaaccugcuuaaaggggauagguugaauggacaucugauucacaagaucgagccccacuucaacaccucauggaugaguugggacggcugcgauuuagacuacuacuguaauaugggugauuggccuuccugcacguauacagggguuacccagcauaaccacgcugcguuugugaaucuccugaacaucgaaacugacuacacaaaaaccuuccauuuccacucuaagcgcgugacugcacauggcgauaccccacagcuugaccugaaagcccggcccacauauggagcuggcgagauuacgguauuggucgagguggccgauauggaacuccacaccaagaagguugaggugagcgggcugaaauuugcaucccuagccuguacuggaugcuacgcuuguucaagcggcaucaguugcaaggucaggauucacguggacgaaccugaugagcugacaguucaugugaaaucuuccgacccagacguagucgccgcaagcaccucgcucauggcgagaaagcuggaguucgguacagauucaacuuuuaaggcuuucucugccaugcccaaaaccagucuuuguuuuuauauaguggaacgcgaguacugcaaguccuguagcgaagacgauacgaaaaagugcguggacacaaaauuggagcagccgcaaucuauccugauugaacacaaggggaccaucauuggaaaacagaaugauacuuguaccgcaaaggccagcugcugguuagaguccgucaagucauucuuuuauggccucaaaaacaugcuggguaguguuuucggcaacuuuuucguggggauccuucuguuucuagcuccuuucguacuccugguguuguuuuucauauucggauggaagauccuguuuugcuucaaauguugccgacggacacguggcuuauuuaaguacagacaucucaaagacgaugaggaaacuggguacaggaagauuaucgagcgccugaauagcaagaaaggaaagaaccggcuucuggacggcgaaagauuggccgauaggaaaauugcagaacucuucucuaccaagacacacaucggu

SEQ ID NO: 10536 - RNA, 3495 nt, Artificial Sequence
  derived and/or modified CDS sequence (opt3) from CCHVF(CCHVF Ast133)__KX056060.1__Gn-NSm-Gc
agcgaggaacccgacgaugacugcaucuccagaacccagcugcucaagacagagacugccgaaauucacgaugacaacuacggcgggccuggagauaaaauaacgaucuguaaugguucuaccauuguggaccaaaggcuuggcucagagcuggggugcuauacaaucaaccgggucaagaguuucaaauugugugaaaauagcgcuacuggaaagaccugcgagauugauuccacaccaguuaaaugucgccagggcuuuugcuuaaagaucacccaggagggucgagggcaugugaagcugucucguggaucggaaguagugcuagacgcaugugauucaagcugcgagauaaugaucccgaaaggcacuggcgacauucucgucgauuguagugggggacagcaacacuuccugaaggacaaccuuaucgaucuggguugcccccauauuccuuugcucggcaaaauggccaucuacauauguagaauguccaaucacccaaggacaaccauggcguuucuguucugguuuucuuucggguaugugauuacgugcaucuuuugcaaggcucuguucuaccucuuaauuaucaucggaacucugggcaaaaagauuaagcaguaucgggaacuuaaaccccagaccuguacaauaugcgagacugccccuguuaacgcaaucgacgccgagaugcaugacuugaauuguagcuacaacauuugcccauauugugcuucccgccugaccucagauggucuagcaagacacgugacacagugccccaagaggaaagaaaaggucgaggaaaccgagcucuaccugaaucuugaacggaucccuuggauagugcgcaaacuguugcaaguaagugagagcacggggguugcccucaagcgaucuuccuggcugauuguguuacugguccuccuuacugugucacugagcccagugcagagugcuccggucggacacggcaaaacaaucgagaccuaccagacuagagaaggcuuuacaucuaucuguuuguucaugcuaggguccauucuguuuaucguuagcugccucgugaagggacugguagacucggugucugauuccuucuuucccggucuuucagucuguaagaccugcaguauuggcagcauaaacggguucgagaucgaaucccauaaauguuauugcucucuguucugcuguccuuacugcaggcacuguagcgccgaccgggagauucaucaguugcaccucucaaucugcaagaaacguaagacgggaaguaaugugaugcuggcgguuuguaaacgcaugugcuuuaaggcaaccaucgaagccuccagaagggcuuuacugauucggagcauaaucaacacaacuuucgugauguguauucuaacccucgccaucugcgucgugucuacaucagcaguagagauggaggaucugccagcuggcacuugggaacgagaggaagaccuuaccaauuuuugucaccaagagugccagguuacagaaaccgaguguuugugccccuaugaggcccuggugcuccgcaagccucuguucagugauagcauugucaaagguaugaagaaccuuuuaaauuccacuucuuuggaaacgucgcucagcaucgaggcgccauggggcgccauaaacgugcaguccacauuuaaacccaccgucucaacugcaaacaucgcucugaguuggucuagcguggaacauagagggaauaagauuuuaguuaccggaagguccgagucaaucaugaaacuggaggaacggacaggcgugagcugggaccuagggguagaggaugccucugaauccaagcuccugaccgucaguauuauggaccuuagccaaauguacucuccgguguucgaguauuuguccggagaucgccagguugaagaguggccuaaggcuacuugcacaggugacugucccgagagaugcggcuguacgucaaguaccugccugcacaaagaauggccacauagcaggaacuggcguuguaauccuacuuggugcuggggaguggggacaggcuguaccugcuguggugucgacgugaaggaucucuuuacagaccacauguucaucaaauggaagguagaguacauaaaaacugaagccauugugugcguugagcugaccucgcaggaacggcaguguuccuuaaucgaggcagggacgcgauuuaaccugggccccgucaccauuacacuuucugagccaagaaauauccaacagaaguugcccccugaaauaaucacucuccauccaaagauugaggaaggauucuuugaucugaugcacgugcagaaagugcuaagcgccucaaccgucugcaagcugcagaguugcacacacggcaucccgggggaccuccaaauuuaucauaucggaaaccugcuuaaaggugauaggguuaauggccacuugauacauaagauugagccccacuucaacacuuccuggaugucuugggacgggugugaucuggacuacuacugcaauaugggagauuggccuagcuguaccuauacgggcgugacacagcacaaccaugcugcguuugugaauuuacucaacaucgaaaccgacuacacuaaaacauuccacuuccauuccaagcgcguaaccgcacacggugauacuccacagcuggaccuuaaagcccggcccaccuauggggcuggcgagaucacaguccugguggagguugccgauauggaauugcauacgaagaagguggagauuucaggacucaaauuugcaagccugaccugcacuggcuguuacgccugcaguucugggaucuccuguaaggucaggauucacguggacgaaccugacgagcuaacaguucacgugaaaagcucggauccagacguagucgcugccucaaccucucugauggcaagaaagcucgaguucggaacagauaguacuuuuaaagcguucuccgcuaugcccaagaccagccugugcuuuuauauaguggaacgcgaguacuguaagucuugcagcgaagacgauacgaaaaaguguguggacacaaaacuugagcagccgcaauccaucuugauugaacauaagggcaccaucauugguaaacagaaugauacuugcaccgccaaggcaucaugcuggcuggagagugucaagagcuucuuuuaugggcugaaaaacaugcucggaucuguuuucggcuccuuuuucguggguauccugcuuuuucuggccccuuucguacuacucgugcuguuuuucauguucggcuggaagauauuguuuuguuucaaaugcugucgacggacacgugggcuguuuaaguacagacacuuaaaagacgaugaggaaacuggauacaggcgcaucauugagcggcucaauucaaagaagggcaaaaacagacugcuugacggggaaaggcuggcugaucgaaagaucgccgaguuguucaguagcaaaacccauauugga

SEQ ID NO: 10537 - RNA, 3495 nt, Artificial Sequence
  derived and/or modified CDS sequence (opt3) from CCHVF(CCHVF SK/2015/human)__KX458183.1__Gn-NSm-Gc
agcgaggaauccggcgacgauugcaucucuagaaccaggcugcuccggacagagacugccgaaauucacggggacucauacggaggucccggcgauaagauaacgaucuguaacgggaguaccauuguggaccagcgccuuggaagcgagaugggcugcuauacaaucaaucgagucaaauccuucaagcugugugaaaacucugcuacugguaaaucgugcgagauugauucaaucccuguucguuguagacaaggguacugcuugaagauaacccaggagggaaggggccaugugaaauuaagccggggcagugaaguagugcuggacgcaugugauuccucuugcgaggucaugaucccaaaggggacaggagacauucuaguggauuguagcgguggccagcagcacuuucucaaggacaaucugaucgaucuugggugcccgaacauuccccuguugggaaaaauggccaucuauauaugucgcauguccaaucauccuaagaccacuauggcguuccucuuuugguucucauuuggcuacguuauuacaugcauccugugcaaagcuauuuucuaucugcucaucaucguggguaccuuagggaagagauuuaaacaauacagggaacugaagccacagacguguacuauuugcgagaccacacccgccaacgcaauagacgccgagaugcacgaucuuaauuguaguuauacuaucugcccuuacugugcuagccgguugaccucugacggacuggcacgccaugucacacagugcccaaagcgaaaagaaaagguggaggaaaccgagcuauaccucaaccuggaacguauucccuggguaguuaggaaacuucuccagguguccgagucaacgggcgucgccuugaagcggagcaguuggcucaucgugcuguuagugcuguucacugucucucucuccccuguucaaagcgcuccaauaggccacgggaaaacaauugagaccuaucaggcccgugaagaguacacuggaaucugucuuuuugugcuggguucgaucuuguucauuguaucuugccuagugaagggccuggucgacggggugggaaauaucuuuuucccgggccucuccauuuguaaaacaugcucaauagguaguaucaacggguuugaaauugagagccacaaguguuauugcucccugcuuugcugucccuacugccgccauuguucugcggauagagaaauccaccagcugcauuugagcaucugcaagaaaaggaagaccggcucaaauguuaugcucgcaguguguaaacggaugugcuuccgagccacgauggaggucaguaacaaggcucuguuaauucgcuccauaaucaauaccacauucgugguauguauucugauccuagccguuugcguggucagcacuucugcaguggagauggaaucacucccugcuggaaccugggagagagaagaggaccugacaaacuuuugucaccaggaaugccaagucacugagaccgagugucuuugcccauaugaagccuuggugcugaggcggccccucuuccuggauaguauuguucgcggcaugaaaaaucuucugaacagcacauccuuggagaccucucucucgaucgaagcgccuuggggagccauaaacgugcagagcacuuacaagccaacgguauccacagcaaauaucgcucugucauggaguucugucgagcacagagggaacaagauuuuagugagcgguagguccgagucaaucaugaaacuggaagagagaaccggcguuagcugggaccuagggguggaagaugccucugaguccaagcuccugacugucagugugauggaccuuagccagauguauucucccguauuugaauacuuguccggagaucggcaaguggaggaguggccgaaagcuaccugcacaggcgacuguccugaacgaugcgguuguaccacuucaacaugccugcauaaggaguggccccacaguagaaauuggagguguaacccaacguggugcuggggcguugggaccggauguacuugcuguggccucgaugucaaagaccuguucacagauuacauguuugugaaguggaagguggaauauauuaaaaccgaggccaucgucugcguugaauuaacaagccaggggcgccaguguucgcugauagaggcaggaacucgguucaaucuugguuccgugaccauuacguugucugagccuagaaacauccagcauaagcugcccccagaaauuaucacccugcaccccaggauagaggaaggcuuuuucgaccuaaugcaugugcaaaaaguacugagcgccucaacagucugcaagcuccagaguugcacucacggggugccuggagaccugcagguuuaccacaucggcaaucuuuugaaaggugauaaggugaacgggcaucugauucacaagaucgagccacauuuuaauaccuccuggaugucuugggacggcugugauuuagacuauuacugcaacaugggagauuggccgagcuguacauauacuggcgucacccagcacaaucacgcuuccuucgugaaccuccugaauauugaaacggacuacaccaaaaacuuucauuuccacucaaagcgcguuaccgcgcauggggauacuccccaacuugaccugaaagcacgaccuacauauggagccggcgagaucaccguguugguagaggucgcugauauggaacuccacacuaagaaaauagagauuagcggucugaaguuugccagucuaaccugcacaggguguuacgcauguucuuccggaaucagcugcaaagugcggauccauguggacgaaccagaugagcugacgguccacguuaagucggacgaucccgacgugguagccgcuucaucuagucucauggcccguaagcuggaguucggcaccgacuccacuuucaaagcauuuagcgcgaugccuaagacaucucuuugcuucuacauuguggaaagagaguauuguaaaagcugcuccaaggaagauacccagaaaugugucaauacaaaguuggagcagccacagucaauccugauugaacacagggguacuauaaucggcaagcaaaacaacacaugcauugcuaaagccaguugcugguuagagagcgugaaguccuuuuucuacgggcucaaaaauaugcugucuggaaucuuuggcaaccuuuuccuggggauuuuucuauuccucgcacccuuuauccuguugauacuguucuuuauguucggauggcgcaucuuauuuuguuucaagugcugucggagaacgaggggccucuucaaauaucgacaucugaaggacgaugaggaaacagguuaccgccggauuaucgagagacuuaauaacaagaaagggaagaauaaacuguuggacggagaaaggcucgccgaucgucgcauugcugagcuguuuucaaccaagacucacaucggc

SEQ ID NO: 10538 - RNA, 3495 nt, Artificial Sequence
  derived and/or modified CDS sequence (opt3) from CCHVF(CCHVF YL16070)__KY354081.1__Gn-NSm-Gc
gccgagggcgggagcuccgacugcaucucuagaacccagcuggugaagacagaagucgcugagauucacgaagauucauacggaggucccggcgagaaaauaacuaucuguaacgggaguacgauuguugaccagaggcucggaagcgaacuuggcugcuauaccaucaaucgggugaaguccuacaaacugugugagaacucugcaucggguaagucaugcgagauugauagcaucccuguaaaauguaagcagggguucugcuugaagauaacacaggaaggacgcggccaugugaaauuaagucgaggcacugagaucguccuggacgugugugauuccucuugcgaacuaaugauuccaaaggggaccggagacauccucguugauuguagcgguggccagcaacacuuucugcagaauaaccuuauugaccuggggugcccgaaugugcccuugcucggaaaaauggccaucuaugucugucguauguccaaccauccuaagacaaccauggcguuccuguuuugguucucauuuggcuacgugauaacuugcauuguaugcagaguucuguucuaucucuuaaucgcuauugguacaguggggaaaaagcugaagcaguacagggagcuuaaaccacagaccuguaucgucugcgagagugugcccgugaaugccaucgaugcagaaaugcacgaguugaacuguagcuauaauauuugcccuuacugugccucucggcuguccacggacggacuaauacgccaugucacucaaugcccaaagagaagggaaaaaguugaggaaaccgagcucuuucugaaccuugagcggauccccuggcuggugcgcaaguugcuccagguaucagaaagcacaggcauggcucugaaacgaaguuguuggaugauuacuuuacugauccuccuucuggugucuauguccccuguccagagcgcaccagugggcaaggagagagccauagaaaccuaccaggcuagggaggccuauacagggauuugcuuguucguucuaggaucggugcuguuugcggucucuuggcucaccaaagcacugaucgaugguaucggcaauuccuucuuuccggggcuuucaguguguaagacgugcaguauuggaagcaucaacggcuucgaaauugagucccacaaguguuacugcucucuguuuugcugucccuauugccgggccuguagcucagacaaaaauacucaccguaugcauuugaacguaugcaagaaacgcaagauggguaguaauguuaugcucgcuguguguaaaagaaugugcuucagggccacaauagaggcauccaacaaggcucuguuaauccggagcauuaucaacucuaccuucgucaucuguauucugauacuaacuaucugcguggucucaacaagugccguggauauggaaaaucucccugcggggauuugggagaaggaagaggaccugaccaacuuuugucaccaagaaugccagguuacggagaccgagugucuuugcccauacgaagccaugguguugcgaaaaccccuguuccucgacagcaucgcaaagggcaugaaaucccugcuuaauucuacaucgcuggagacuagcuuguccauugaagcuccuuggggagccaucaacguacagucaaccuuuaagccaacagucagugcugccaauauagcacucucuuggagcuccguggagcaucgcggcaacaaaauccugguuucagggagaagcgagucuauuaugaaguuagaagagaggacuggaguguccuggaaucugggugucgaagaugccagugagagcaagacccuaacagugucuguaauggaccucucccaaauguauucacccguguucgaauaccugaguggcgaucggcagguugaggaguggccgaaagcuaccugcacuggggacuguccugaacgcugcggauguacgagcucgacaugccuucacaaggaguggccccacuccagaaacuggagguguaauccaaccuggugcuggggcgucgguacuggguguaccugcuguggcuuggaugugaaagacuuuuucacagauuauaugcuggugaaguggaaagucgaauacaucaagaccgaggcgauuguuugcguggaacucacuucucaggagcgucaguguagccugaucgaggcaggaacacgguuuaacuuaggcccugugacgauaacccugucagaaccccgaaauguacaacagagacuuccacccgagauugucacuuugcauccuaagaucgaagagggguucuuugaccucaugcacgugcagaaaauucugagugccuccacaguuugcaagcuacagucuugcacccauggagugccaggugauuuccaagucuaccacgugggcaaccugcucaggggugacaaaguuaauggacauagcauccacaagauagaaccgcacuuuaacacauccuggaugucaugggauggcugugaccuggacuauuucugcaauaugggugauuggcccagcuguacuuacaccggggugacgcagcauaaccgcgcugccuuuaucaacaugcuuaauauugagaccgacuauacaaaaacuuuccacuuccauaguaagcggguaaccgcacacggcgauacaccucaguuggaccugaaagccagaccagcuuacggagccggcgaggucacuguguuaguggaagucgcagaucucgagcugcacaccaagaaacuugaaguuucugggcugaaaaucgcguccuugacgugcagcggauguuaugcuugcucgucaggcauuucuuguaaggugaggauccauguaaacgagcccgacgaguuuacagugcacguccgcaguuccgauccugacgugguugccgcagguagcucucucauggcccgaaaaauagaauuuggggcugauagcaccuuuaaggccuucuccucaaugccaaaagacagucugugcuuuuacauuguggagaaggauuauuguagcucuugcacugacgaugacacacagaagugugucaauaccaaacuagaccauccccaauccauccugaucgaacacaagggaacuauuaucggcaaacagaacgauaccugcucaacaaagacgaguugcuggcucaagagcuucaagggguuuuucuacggccugaagaauaugcuuuccgggauuuuuggaaacguguucuugggcauacuguuauuucucgcaccguucguucugcuuaucuuuuucuucuuuuucggguggcggcugcuauuuugucucaaaugcuguaagaaaaccaagggacuguugaaauacaagcaucugaaggacaaagaggaagcuggcuauaagaaaauuaucgagcguuuaaaugguaagaaagggaagucucaacucuucgauggagagagacuggccaacaggaaaauugcggaacuuuucucgacuaagauccacauaggc

SEQ ID NO: 10539 - RNA, 3495 nt, Artificial Sequence
  derived and/or modified CDS sequence (opt3) from CCHVF(CCHVF Oman_812956)__KY362518.1__Gn-NSm-Gc
agcgaggaauccggcgaggacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaagagcuucaaauugugugaaaauuccgcuacugguaaaucuugcgagauugacaacaccccuguuaaguguaaacagggguuuugcuuaaagaucacacaggaaggacgaggccaugugaagcugucgcgugauucagagguagugcuagacgcaugugauagcaguugcgaaauaaugaucccaaaaggcaccggggacauucucgucgauuguuccggaggucagcaacacuuccugaaggacaaucuuaucgaucugggcugcccgaacauucccuugcucgggaaaauggccaucuacauauguagaaugucuaaucauccuaagacuacaauggcguuucuguucugguuuagcuucggauaugugauuaccugcauccugugcaaaguuaucuuuuaccucuuaauuguggucggcacgcuggguaagaaguucaaacaguauagggagcuuaagccacagacuuguaccaucugcgagacaacucccgugaacgcuauugacgccgaaaugcacgauuugaauuguuccuacaacauaugcccuuauugugcaucacggcugaccagugacgggcuagcccgccauguaaugcagugcccaaaaagaaaggagaaaaucgaagagacagaacucuaccugaaucuugagaggauucccuggguugugcggaagcuguugcaagucagcgagucuaccggaguggcucucaaacgcuccucauggcugaucguguuacugguccuccuuacgguuagccugaguccugugcagucugcaccaauaggccacggcaagacuauugaaacauaccagacccgagagggguauacuuccaucuguuuguuuguacuaggaagcauccuguucauugugucgcaccucaugaagggucuggucgacucugugggcaacuccuuuuucccggggcuuucaaucugcaaaacauguaguauuggaagcauaaauggcuuugaaaucgagucccauaagugcuacuguucucuguucugcugccccuauuguagacacugcagcgccgauaaagaaauucauaaguugcaccucucaaucuguaaaaagaggaaggcugguaguaacguuaugcuggccgugugcaaacggauguguuuccgugcgaccauggaggucuccaauaaggcauuacugauccgcagcgugauuaacacgaccuuuguaguuugcauacuaauccucgccgugugugucgugucuacaucagcugucgagauggaaagucugccugccgggacuugggagagagaagaggaccuuaccaacuucugccaccaggaaugucaagugacagagacugagugcuuguguccauacgaagcacugguucucaggaaaccccuguuuuucgauagcauugcuaagggcaugaaaaaucuucugaacuccaccucuuuggagacaucgcucagcaucgaagccccuuggggagcgauuaaugugcaguccaccuuuaagccaacuguaucaacggccaacaucgcacugaguuggucuagcgucgagcaucggggcaauaagauauuaguguccgggcgaucagagagcaucaugaaacuggaggagcgcacaggaauuucuugggaccuagguguugaagaugcuuccgagaguaagcuccugaccgugagcgucauggaccuuucucagauguauucccccguguucgaauacuugucaggcgauagacaaguagaggaguggccgaaagccacuugcaccggggacugcccugaaagguguggaugcacaaguagcaccugucugcacaaggaguggccccauucgcggaacuggcgcugcaauccaacuugguguuggggcguggguacagggugcacguguugcggccucgauguuaaagaccuguuuaccgauuauauguucgucaaguggaagguggaauacaucaaaacugaggcuauugugugugucgaauuaacaucccaggagagacagugcucucugaucgaggccggaaccagguuuaaccuuggcccuguuacaauaacuuugagcgaaccccguaauauucagcaaaagcucccacccgagaucgugacccugcacccucggauugaagagggguucuuugaccuaaugcaugugcagaaaguacugucagcaaguacggucuguaagcuccaguccugcacccacggagugccaggugaccugcagguuuaccacaucggcaaccuuuugaaaggggauaaggugaauggacaucugauacacaaagucgaaccgcauuucaacacaucuuggaugagcugggacggcugcgauuuagacuauuacuguaauaugggugauuggcccuccugcacuuauaccggggugacacaacacaaccacgccgcuuuuguuaaucuccugaacaucgagacugacuacaccaagaacuuccauuuccacucaaagcgagugacggcgcauggcgauacaccucagcuugaccugaaagcaagaccaaauuauggagccggcgagauuaccguauuggucgaaguggcugauauggagcuccacacuaagaaaaucgaaauuagcgggcugaaguuugccagucuaacauguaccggaugcuacgcauguucuuccggcaucagcugcaaagugaggauacaugucgacgagcccgaugagcugacuguucacgugaagucggaagacccugauauuguagccgcuucaucuagucucauggcccgcaagcuggaguucgguaccgacuccacauuuaaagcauucagcgcgaugccaaagacgucucuuuguuuuuauaucguggaacgggaguacugcaaaagcuguuccaaggaagacacccagaaaugcgucaacgcuaaguuggagagaccccagucaauccugauugagcacaaggggacuaucauuggaaaacaaaaugauacauguaccgccaaggcaaguugcugguuagaaagcgugaaaucuuucuuuuacggccucaagaacaugcuguccgguauauucggcaauguuuuuaucgggauuuuccuuuuucuggccccguucauccuacucauucuguuuuucauguucggauggaggaucuuguuuugcuucaaauguugccgccgaacacggggccuguuuaaguaucgucauuuaaaggacgaugaggaaacuggguacagaaaaauaaucgagaggcucaacaauaagaaaggaaagaacaaacugcuugacggcgaacgccuggcugaucggaagauugccgaguuguucucaaccaaaacgcacaucggu

SEQ ID NO: 10540 - RNA, 3495 nt, Artificial Sequence
  derived and/or modified CDS sequence (opt3) from CCHVF(CCHVF UCCR4405)__KY484029.1__Gn-NSm-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgaggucaugauaccgaaaggcacuggggauauccucguggacuguaguggaggucagcaacacuuccugaaggauaaccuuauugaccugggcugcccccauaucccuuugcucgggaaaauggccauuuacaucuguagaauguccaaucacccaaggacaaccauggcguuucuguucugguuuucuuucggauauguuauaacgugcaucuuuugcaaggcucuguucuacagccucauuauuaucggcacuuuagguaaaaagaucaagcaguaucgggaacugaaaccccagaccuguacaauuugcgagacugccccugugaacgcaauagaugccgagaugcaugaccuuaaguguuccuacaauaucugcccauauugugcuucacgcuugaccagugacgggcuggcaagacacgucacacagugccccaaaaggaaggaaaaaguggaggaaaccgagcuauaccucaaccuggaacggauuccuuggaucguacgcaagcugcugcaaguuagcgagucuacgggaguggccuugaaacgauccucauggcucauaguccuguuagugcugcucacugugagccuuaguccaguccagucugcuccgguuggccacggcaagacaauugagaccuaccagacuagagaaggguuuacauccaucugucuguucauguugggaagcauccuauuuauugugucgugccugguaaagggucucguggauucugucuccgacucauucuuucccggccugaguguguguaaaaccugcagcaucggguccauuaauggauucgagauagaaucucauaaguguuauugcagccuuuucugcuguccuuacugcaggcacuauucagccgaucgggagauccaucagcugcacuugaguauuuguaaaaagcguaaaacgggcuccaacguuaugcucgcggugugcaagcgcauguguuuuaaggcaaccaucgaagccagcagaagggcucuguuaauccggucuauuauaaauacaacuuucgucaucugcauucugauccuagccauuugugugguaucaaccagugcaguugagauggagaaccucccagcugguacaugggaacgagaggaagaccugacuaauuuuugccaccaagagugucaggugaccgaaacagagugccuuugucccuacgaggccuugguccugcgcaaaccucucuuccuggauagcaccgugaaggggaugaaaaaccuucuuaauuccacuucuuuggaaacgucgcucagcaucgaggcgccauggggcgccauaaacguccaguccacauuuaagcccaccgugucaacugcaaacaucgcucugaguuggucuagcguugaacauagaggaaauaaaauuuuagugaccggcagguccgagucaaucaugaagcuggaggaacggacagggguaagcugggaccuaggagucgaggaugccucugaauccaagcuccugaccgugaguauuauggaccuuagccaaauguauucuccgguuuucgaguacuuguccggugaucgccagguggaagaguggccuaaagcuacuugcacaggcgacugccccgagagaugugggugcacgucaaguaccugucugcacaaggaauggccacauagcaggaacuggcguugcaauccuacuugguguuggggagucggcacagguugcaccuguugcgggguggauguaaaagaccucuuuacagaccacauguucgugaaguggaaaguugaguauaucaagacugaagccauagucuguguggagcugaccucgcaggaacggcagugcuccuuaauugaggcaggcacgcgauuuaaccugggacccgugaccaucacacuuucugagccaagaaauauucaacagaaguugcccccugaaaucauaacucuccauccaaaaaucgaggaaggcuucuuugaucugaugcacguccagaagguucuaagcgccucaaccguguguaaacugcagaguugcacacacgggauuccgggagaccuccaaaucuaccauauugguaaccugcuuaagggcgauagggugaaugggcacuugauccauaaaauagagccccacuucaacacuuccuggaugucuugggacggaugcgaucuggacuacuauuguaauaugggcaacuggccuagcugcaccuacacggguguaacacagcacaaucaugcugcguuugucaacuuacucaauauugaaaccgauuauacuaagacauuccacuuccauuccaaacgcgugaccgcacacggggacacuccacagcuggaucuuaaggcccggcccaccuacggcgcuggagagaucacaguucugguggaggucgccgacauggaauugcauacgaagaaaguggagaucucaggccucaaguuugcaagccugguuuguaccgggugcuaugccuguaguucuggaauuuccugcaaagugagaauccacguagaugaaccugacgagcuaacuguccacgucaagagcucggauccagacgugguggcugccucaacaucucugauggcaaggaaacucgaguucggcaccgacaguauuuuuaaggcguucuccgcuaugcccaagacaagccuguguuuuuacauaguugaacgcgaguauugcaaaucuuguagcgaagaugacacuaagaaaugcguggauaccaaacuugagcagccgcaauccaucuugauugaacauaaagguacgaucauugggaagcagaacgacacauguaccgccaaggcaucaugcuggcuggagaguguaaagagcuucuuuuacggauuaaagaauaugcucggcucuguguucgguaacuuuuucgucggcauccugcuuuuucuggccccuuucgugcuacucguucuguuuuucauguucggguggaaaauauuguuuugcuucaaguguugccgacggacucguggacuguuuaaauacagacacuuaaaggaugacgaggaaaccggcuauaggcgcaucauugagcggcucaacuccaagaaagggaagaauagacugcuugauggagaaaggcuggcugaccgaaaaaucgccgaguuguucucaacaaagacucauauuggc

SEQ ID NO: 10541 - RNA, 3495 nt, Artificial Sequence
  derived and/or modified CDS sequence (opt3) from CCHVF(CCHVF UCCR4459)__KY484032.1__Gn-NSm-Gc
agcgaggaauccggcgacgauugcaucucuagaacccagcuuucaaggacagagacugccgaaauucacagugacaacuacgggggacccggugauaagauaacgaucuguaauggcagcaccauuguggaccaacggcucggguccgagcuuggaugcuauacaaucaaccgcgucaaaucuuucaagcugugugaaaauucggcuacuggcaaaucaugcgagauugauagcaccccuaucaagugucgacaggguuuuugcuugaaaauaacacaggaggggcguggacauguuaaguuaaguagaggcuccgaagugguacuggacgcaugugauucuagcugcgagaucaugauuccaaagggcaccggggacauccuaguggauuguuccggaggucagcaacacuuccucaaagacaaccugauugaucuuggcugcccgaauaucccccuguuggggaagauggccauauacauuuguaggaugucaaaccauccuaaaacuacaauggcguuucucuucugguuuaguuucggauaugucauuaccugcauccugugcaaggugaucuuuuaccugcucaucguugugggcacguuagguaaaaaguucaagcaguaucgggaacugaaaccacagacuuguaccauuugcgagacaacucccgucaaugcuauagacgccgagaugcacgaucuuaacuguagcuacaauaucugcccuuauugugcaucucgcuugaccuccgacgggcuggccagacaugugaugcagugcccaaagaggaaagaaaagguagaggaaacagagcuauaccucaaccuggaacggauucccuggguugugcgcaaacuucugcaagucucagagagcaccggaguggcuuugaagcgaaguucuuggcucgugguccuguuaguucugcucacggugucccuuagcccuguacagucggcaccaaucggccacggcaaaacuguggagacauaccagaccagagaaggguauacuucuauaugucuguuugucuugggauccauucuauucaucgugucaugccugaugaagggucucguugacagugugggcaauagcuuuuucccggggcuguccaucuguaagacaugcucuauuggaagcaucaacggcuuugagauugaaucacacaaauguuacugcagucuuuucugcugucccuauugcaggcauuguuccgccgaucgggagauacacaagcugcauuugagcaucugcaaaaagcguaaaaccgguucuaaugucaugcucgcuguguguaagcgcaugugcuucagagccacgguagaaguuucaaacaaggcgcuguuaauuaggaauaucaucaacaccacauuuguggucuguauucugauacuagcagugugcgucgugaguacuagcgccguugagauggagucccucccugcugggaccugggaacgggaggaagaccugacaaacuucugucaccaggagugccaagugacugaaaccgagugucuuugcccauacgaggccuugguacugcgaaaaccccucuuuucugauucgaucgucaagggcaugaaaaaucugcuuaacagcacaucccuggaaaccucauugaguauugaggcaccuuggggagcuaucaaugugcagucuacuuucaagccaacgguuagcgccgcgaacauugcccucuccuggucaagcguggaacaccgcggcaauaaaauccuggucucugggagauccgagaguauaaugaaguuagaggaaaggacaggaaucagcugggaccuggguguggaggaugcaucugaauccaagcuacucaccguaucaauuauggaccugagucagauguauagccccguguuugaguaccuuucgggcgaucggcaaguugaagaguggccgaaagcuacuugcaccggggacuguccugagcgcugcggauguacauccucuaccugcuugcauaaggaauggccccacagcagaaacuggagguguaauccaacuuggugcuggggcgucgguacaggguguacgugcuguggccuggaugugaaagaccucuucaccgauuauauguuugugaaguggaaagucgaguacaucaagacugaagccauuguuugcguggagcugacaucacaggaacgucaguguaguuuaaucgaggcuggaacccgguucaaccugggcccugugacaauaacucuuuccgagccccgaaauauucagcaaaaguugccacccgaaaucguaacccuccauccuagaauugaggaaggguuuuucgaccugaugcacgucaaaaaggugcuaucugccagcacgguuugcaaacugcaguccugcacccauggagugccaggugaccuccaggucuaccacaucggcaaccugcuuaagggggauaaagugaauggacacuugauacauaagaucgagccgcacuuuaacacaucauggaugagcugggacggcugugaucuggacuauuacugcaauaugggugauuggcccaguuguucuuauacugggguuacccagcauaaccacgcagccuucgugaauauguuaaacauugaaacagacuacacuaaaaucuuucacuuccauuccaagaggguaaccgcucacggcgauacgccucaacucgaccugaaggcgcgcccaacauauggagcaggcgagauuaccguccuuguggagguggccgauauggaacugcauacuaaaaagaucgagauaagcggguugaaauucgcuucgcucacaugcaccggauguuacgccugcucaucuggcauuaguuguaagguccggauccacguugacgaacccgaugagcugacugugcauguaaaauccgaggacccugauaucguggcagccagcucuagccuaauggcuagaaagcuggaauuugguaccgacuccacauucaaggccuuuucagcaaugccaaaaacgagucucugcuucuauauugucgagagggaauacuguaagagcugcucuaaagaggacacccagaagugugugaacacuaaacuggaacagccccaguccauccuuauugagcacaaggggacaauaaucggaaagcaaaaugauaccugcacaucaaaagcgggcugcugguuggagaguguuaagagcuuuuucuacggucugaaaaacauguuauccggcauuuuugggaauguguucaucggaauuuuucucuuccuggcuccguuuauccuucugauacuauucuuuauguucggcuggcgcauccucuucuguuuuaagugcugucgacggacucgugggcuguucaaauauagacacuugaaggacgaugaagagaccggauacaggaagauuaucgaacgccugaacaauaaaaagggcaaaaacaaguuacucgacggugagcggcuggccgauagaaaaauugcagaacuguuuucuacgaagacacauaucggg

SEQ ID NO: 10542 - RNA, 3495 nt, Artificial Sequence
  derived and/or modified CDS sequence (opt3) from CCHVF(CCHVF UCCR4401)__KY484035.1__Gn-NSm-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcguccgaucuuucaaauugugugaaaauuccgcuacuggcaagaacugcgagauugauucuguuccagugaaaugucgucaggguuacugcuuaagaaucacccaggaggggaggggacauguaaagcugucgcggggcucagaagugguccuagacgcaugugauacaagcugcgagauaaugaucccgaaaggcaccggggacauucucguggauuguaguggaggucagcaacacuuucugaaggacaaucuuaucgaucugggcugccccaagauuccuuugcucgggaaaauggccaucuauauaugucgcauguccaaccauccaaagacuacaauggcguuccuguuuugguucucuuuuggauacguuauuaccugcauccugugcaaagcuauuuucuaucucuuaaucaucgugggcacgcuggguaagagacuuaaacaguacagggaauugaagccccagacuuguaccauuugcgagacaacuccugucaaugccauagacgcagagaugcacgaucugaacuguagcuauaauaucugcccauacugugccucccggcuaaccucagacgggcucgcucgccaugugauucagugccccaagcgaaaagaaaagguagaggaaacagagcuguaccuuaaccuggaaagaaucccuuggguugugaggaaauugcuccaagucagugagagcaccggaguggcacugaagcggucuuccugguuaauagugcugcucguccuuuuuacgguuucacugagcccagugcagagugccccgauuggccagggcaaaacuaucgaggcuuaucgugcccgcgaaggguacacaucuaucuguuuguucguacuaggauccauucuguuuaucgugagcugccucaugaagggucuggucgacucggugggcaauucuuucuuucccgggcuuuccauuuguaaaaccugcucaauaaguagcaucaacggauucgagauugaaucccacaaguguuauugcucucuguuuugcuguccuuacugcagacacuguagcacugauaaggagauccauaaauugcaccucucaaucugcaagaaaaggaagacaggcaguaauguuaugcuggcgguguguaaauuaaugugcuuccgggcaaccauggaagucuccaaccgagcccuguucauucgcagcauaaucaauacgaccuuugugcuauguauucucauccuggcuguaugcguugugucuacaucagccgucgagauggagaaccuuccagcagguacuugggaaagagaggaagacuugaccaacuucugucaucaggagugccaagugacagaaacugagugucugugccccuaugaggcucucguccugaggaagccucuuuuucuggauaguaccgccaaggggaugaaaaauuugcucaacagcacaucccuggaaaccucuuuaucgauugaggcgccauggggcgccaucaaugugcagagcacuuacaagcccacgguuuccacagcaaacauagcucugucauggaguucuguggaacaccggggaaauaaaauccuaguaagcggccgcuccgagucaauuaugaagcucgaggaaagaaccgggaucagcugggaccugggagucgaggaugccucugaauccaaacuuuugacugugaguguuauggaccugagccagauguauucuccgguguucgaguaccucuccggugauaggcaagucgaagaguggccuaaggcuaccugcacaggcgacugucccgagcguugcggguguaccucaaguacuugccugcacaaggaauggccacauagccggaacuggcgauguaauccuacauggugcuggggagugggcacggguuguaccugcuguggguuagauguaaaagaccuguuuacugauuacauguucgugaaguggaaaguugaguauauuaagacagaagccaucgucugcguggagcuuaccucgcaggaaagacaguguuccuugauagaggcaggcacaagguuuaaccucggacccgugacuauuacccugucugagccacgcaauauccagcaaaaacuacccccugaaauuaucacgcugcacccacggauagaggaaggcuucuuugaccucaugcauguccagaagguucugagcgccucaaccgugugcaaacuucagaguugcacacacggggugccgggagacuugcagguauaccauaucgguaaccuguuaaagggcgauaaggucaaugggcaccucauucacaaaaucgagccccauuucaacacuuccuggaugucuugggacggaugugaucuggacuauuacugcaauaugggcgauuggccuagcuguaccuauacaggugugacucaacacaaccaugcuuccuuuguuaaucuucugaacauugaaaccgacuacacgaagaacuuccacuuucacucaaaaagagugacagcgcauggggauaccccacaguuggaccucaaggcaaggcccacuuauggcgccggagagaucacaguccugguggagguugcugauauggaacuacacaccaaaaagauagagauuagcggccugaaguucgccagucucgcaugcacuggguguuacgccugcagcuccggaaucagcuguaaagugcgcauccauguagacgaaccugaugagcugaccguccacgugaagucggacgauccagacguggucgcugccucaucuagucuuauggcacgaaaauuggaguucggcacagacuccacguuuaaggcguucagcgcuaugcccaaaaccucucugugcuuuuacauuguugaacgggagcauuguaagagcugcuccgaagaggauacuaagaaaugugugaauacaaaguuagaacagccgcagucaauccucauugagcacaaagguaccauaaucgggaagcaaaacaguacaugcacugccaaagcaagcugcuggcuggagucuguaaaguccuucuuuuauggacuuaagaauaugcugucaggcauuuucgguaacguguuuaugggcaucuuccuauuucucgccccuuucauucuguugauccuguuuuucauguuuggguggcguauauuauucuguuucaaaugcuguagaaggacccgcggacucuuuaaguaccggcaccugaaagacgaugaagagacgggcuauagaaggaucauugaaaaacuuaauaacaagaaggggaagaauaaacuguuggacggagagcgacucgcugaucgccggaucgccgaacuguucaguacaaagacccauauuggc

SEQ ID NO: 10543 - RNA, 3495 nt, Artificial Sequence
  derived and/or modified CDS sequence (opt3) from CCHVF(CCHVF UCCR4448)__KY484042.1__Gn-NSm-Gc
agcgaggaaaccuccgacgauugcaucucuagaacacagcugcucaggacugagacggccgaaauucacggcgacaacuacgggggacccggugauaagauaaccaucuguaauggcucaacaauuguggaccagcggcuugggagugagcugggaugcuauacuaucaaccgcgucaaaucuuucaaguugugugaaaauuccgcuaccggcaaaucuugcgagauugauucgguuccugugaagugucgacaggguuacugcuuacguaucacacaggaggggagaggacauguaaaacugucaaggggcagcgaagugguccuagacgcaugugauaccaguugcgagauaaugaucccaaagggcacuggggacauucucguggauuguuccggaggucagcaacacuuucugaaggacaaccuuaucgaucugggcugcccgaaaauucccuugcucgggaagauggccaucuauauaugucggaugucuaaucauccuaaaacaaccauggcguuccuguuuugguucagcuuuggauacguuauuacgugcauccugugcaaggcuauuuucuaucucuuaaucaucauuggcacucuggguaaacgcuuuaagcaguacagagaacuuaagccacagaccuguacaauaugcgagacuacccccgugaacgccaucgacgcagagaugcacgauuugaauuguuccuauaacauuugcccuuacugugccucaaggcugacaagugacgggcuagcucggcaugucacccagugcccaaaacgcaaggaaaaaguggaggaaacggagcucuaccugaaucuugaacgaauccccuggguaguuagaaagcuguugcaagugagcgagucuacuggagucgcacucaaaagguccucauggcugauaguguuacuggugcuguucacaauuagccuuaguccuguccagucugccccaaucucccacggcaagaccaucgaggcuuaucgggcccgugaaggcuacacuagcauuugucuguuuguuuuggggucgauccuauucauugugucuuaucugaugaaaggacucguagacuccguggguaacucauuuuucccgggccugaguauaugcaagacauguagcaccuccucuaucaauggguuugagauugaaagccacaagugcuacuguucacuuuucugcugccccuauugucgccauugcagugcggauaaagagauccacaagcugcauuuguccaucuguaaaaagagaaaaacgggaagcaacgucaugcucgcagugugcaagaggauguguuuccgggccaccauggaaguuucuaaucgagcucuguuuauucgcucaauaaucaacacaacuuucguguuaugcauucugauccuagccgucugugugguaaguaccagcgcaguugagauggagaaucucccugcuggcacaugggaaagagaggaagaccugacuaacuuuugccaccaggagugucaggugaccgaaacagagugccuuuguccauacgaggccuugguccugaggaagccccucuuccuggauuccauugugaaagguaugaagaaccuucugaauagcaccucguuggaaacuagccucuccaucgaggcgccuuggggcgccauaaacguccaaucaacguauaaaccaacagugaguaccgcaaauaucgcucugucuuggagcuccguugaacaccgggggaacaagauuuuagugucaggacgcagcgagucuaucaugaaacuggaggaaaagacuggcauuuccugggaccuagggguagaggaugccagugaaagcaagcuccugaccgucucugugauggaccuuucccagauguacucacccguuuuugaguacuugaguggagauagacagguggaagaguggccgaaagcuacaugcaccggugacugcccugagagguguggcugcacuagcucgacaugucugcauaaggaauggccccacucccguaauuggcggugcaacccaacgugguguuggggagucgggaccggcugcacuuguugcggucucgaugugaaagaccuguucacagauuauauguuuguaaaguggaaaguggaguacaucaagaccgaagccauaguuugugucgaguuaacaucucaagaacgacagugcagccugauugaggcagggacuagauucaaucuuggcccugugaccaucacguugucagagcccaggaacauucagcagaagcucccacccgaaaucauaacccugcauccucgcaucgaggaaggauuuuucgaccuaaugcacgugcaaaaaguccugagugccuccacaguuuguaagcuccagucuugcacucauggcgugccaggggaccuccagguguaucacauuggaaaucuuuugaaaggugauaagguaaacggccaccugauccauaaaauugagccgcacuuuaauaccagcuggauguccugggacgggugcgauuuagacuacuauuguaacaugggagauuggcccucaugcacauacacuggcgucacccagcauaaucacgcuagcuucgugaaccuccugaauaucgaaacggacuauacaaagaacuuucacuuccauaguaaacggguuaccgcgcacggugauacuccucaacuugaccugaaggcaagaccaacauacggggccggcgagauaaccguguuggucgagguggcugauauggaacuccauacuaagaaaauugagaucucuggacugaaguucgccucccuaaccuguacaggcugcuacgcauguagcucggggaucucaugcaaaguuaggauucacguggacgaacccgaugagcugacgguacaugucaagucugacgauccugacgugguggccgcuaguuccagccucauggcccgcaaacuggaguuuggaaccgacucuacuuucaaggcauuuagcgcgaugccaaagacaucccuuuguuucuauaucgucgaacgagagcacugcaaaucauguagugaagaggauaccaagaaaugcguuaacacaaaguuggaacagccccagagcauucugauagagcacaaaggcacuaucauugguaagcaaaauucuaccuguacggcuaaggccuccugcugguuagagucagugaaaaguuucuuuuacgggcucaagaacaugcugagcggaaucuuuggcaauguauucauugguaucuuucuuuuccuggcaccguuuauacuacucauccuguucuuuauguucggcuggaaaauuuuguucugcuuuaaguguugccggcguacaagagggcuguucaaauauaggcauuuaaaggacgaugaagagaccggauaccgccggaucauugaaagacucaacaauaagaaaggcaagaacaaacugcuugacggggagauccuggccgauaggcgaauagcugaauuguuuuccacuaagacccacauugga

SEQ ID NO: 10544 - RNA, 3495 nt, Artificial Sequence; identical to SEQ ID NO: 10460
  derived and/or modified CDS sequence (opt3) from CCHVF(CCHVF SPU4/81 )__DQ157175.1__Gn-NSm-Gc

SEQ ID NO: 10545 - RNA, 3495 nt, Artificial Sequence; identical to SEQ ID NO: 10481
  derived and/or modified CDS sequence (opt3) from CCHVF(CCHVF Sudan Al-Fulah 9-2008)__HQ378185.1__Gn-NSm-Gc

SEQ ID NO: 10546 - RNA, 3495 nt, Artificial Sequence; identical to SEQ ID NO: 10475
  derived and/or modified CDS sequence (opt3) from CCHVF(CCHVF NIV161064)__KY213713.1__Gn-NSm-Gc

SEQ ID NO: 10547 - RNA, 3495 nt, Artificial Sequence; identical to SEQ ID NO: 10497
  derived and/or modified CDS sequence (opt3) from CCHVF(CCHVF 5180-R-2011)__KR814874.1__Gn-NSm-Gc

SEQ ID NO: 10548 - RNA, 3495 nt, Artificial Sequence; identical to SEQ ID NO: 10505
  derived and/or modified CDS sequence (opt3) from CCHVF(CCHVF 4574-ST-2008)__KR814870.1__Gn-NSm-Gc

SEQ ID NO: 10549 - RNA, 3495 nt, Artificial Sequence; identical to SEQ ID NO: 10457
  derived and/or modified CDS sequence (opt3) from CCHVF(CCHVF 3010)__DQ019222.1__Gn-NSm-Gc

SEQ ID NO: 10550 - RNA, 3495 nt, Artificial Sequence; identical to SEQ ID NO: 10457
  derived and/or modified CDS sequence (opt3) from CCHVF(CCHVF UG3010)__DQ211637.1__Gn-NSm-Gc

SEQ ID NO: 10551 - RNA, 2916 nt, Artificial Sequence
  derived and/or modified CDS sequence (opt3) from CCHFV(10200, Artificial)__U39455.2__Gn-4aa-Gc
agcgaggaacccuccgacgauugcgugucuagaacccagcugcucaggacagagacugccgaaauccacggcgacaacuacgggggaccuggugauaagauuacgauauguaauggcucaaccaucgucgaccaacggcuugggagugagcugggaugcuauacaauuaaccgcguucgaaguuucaaauugugugaaaauuccgcuacuggcaagaacugcgagaucgauucugugccaguaaaaugucgucaggguuacugcuuaagaauuacccaggaggggaggggacaugugaagcugucgcggggcucagaagucgugcuagacgcaugugauacaagcugcgagaucaugauaccgaaaggcaccggggacauccucguugauuguaguggaggucagcaacacuuucugaaggacaaucuuauugaucugggcugccccaagaucccuuugcucgggaaaauggccauuuauaucugucgcauguccaaccauccaaagacuacaauggcguuccuguuuugguucucuuuuggauacgugauaaccugcauucugugcaaagcuaucuucuaucucuuaauuaucgucggcacgcuggguagaaggcuuaagcaguaccgggaauugaaaccccagacuuguaccaucugcgagacaacuccugugaaugccauugacgcagagaugcacgaucugaacuguagcuauaauauaugcccauacugugccucccgccuaaccucagacgggcucgcucgacauguaauccagugccccaagagaaaggaaaaaguugaggaaacagagcuguaccuuaaccuggaaaggauuccuugggugguccggaaguugcuccaagugagugagagcaccggaguggcacugaaacguucuuccugguuaaucguccugcucguucuuuuuacggugucacugagcccaguacagagugccccgauaggccgcaagcccuuguuccuagacucuacugcuaaaggcaugaagaaucugcucaacuccacaagccuggagaccucgcuuucuauugaagccccuuggggugcgaucaaugugcaguccacuuauaaaccaacagucucaaccgcaaacaucgcccugaguuggagcuccguggagcacagaggaaauaagauuuugguuucugguaggagcgaaucaaucaugaagcucgaggaacggacgggcauuaguugggaucuggggguggaggacgcuuccgagagcaaauuacugaccgucucugugauggaucuaucacagauguacagucccguauuugaauaucucagcggagaccgacaaguugaggaauggccuaaggccacauguacuggcgauugcccagagcgcugugguugcaccuccucuacaugucugcacaaagaauggccccauucgagaaacuggaggugcaacccgacuuggugcuggggcguggggaccggauguacaugcuguggccuugacgucaaggauuuguucaccgacuacauguuugugaaauggaaggucgaguauauaaagacugaggcaaucgugugcguugaacugacgagccaggagcggcaguguucccucauugaagcugggacacgcuucaaucugggaccugugaccaucacucuuucagagcccagaaacauccaacagaaacugccaccugagauuauaaccuugcaccccaggaucgaagagggguuuuucgaucucaugcauguacagaagguccugagugccucuacagugugcaaauuacagagcuguacccacggcguuccaggggaccugcaaguguaccacauuggaaaucuacucaagggcgauaaagucaacggucaucugauccacaagauugaaccccauuucaauacuuccuggaugucaugggacgggugcgaccuugauuauuacuguaacaugggcgacuggccuagcugcacauacacgggagugacccagcacaaucaugcgucuuuuguaaacuugcugaauaucgagacugauuauacaaagaacuuccacuuucacuccaaacgugugaccgcccauggcgacacaccacagcucgaucugaaggcacggccgacuuacggggcuggagaaauaaccguuuuagucgagguggccgacauggagcugcacacgaaaaagaucgaaauuaguggucuuaaauucgcuagcuuggccuguaccggcugcuaugcauguucuuccucaaucaguugcaaggugcgaauccaugucgaugagcccgacgaacucacaguucacguaaagagcgaugacccugaugugguggccgcuucguccucucugauggcgagaaaacuagaguuugggacugacagcaccuucaaggcauuuucagccaugccaaaaacaagucugugcuucuacauugucgaaagggagcacuguaaguccugcucugaggaagauacuaaaaagugugugaauaccaaacucgagcagccccaaagcauacugauugaacauaagggaacgaucauuggcaagcagaacuccacaugcaccgcuaaagccucauguuggcuugagagcguuaagagcuuuuucuaugguuugaaaaauaugcugucugggaucuuuggcaacguguucaugggaauauuuuuauuccucgcaccuuucauccugcuuauucuguuuuucauguuuggcuggcgcaucuuguucugcuuuaaguguugccggagaacuagggggcuuuucaaauaccgccaccugaaggacgacgaagagacaggauaucgacggauuaucgagaagcuaaauaacaaaaagggcaaaaacaagcugcucgauggugaacgucuggccgacgggagaauagcugagcucuuuuccaccaaaacucauauugga

SEQ ID NO: 10552 - RNA, 2916 nt, Artificial Sequence
  derived and/or modified CDS sequence (opt3) from CCHFV(IbAr10200, Artificial)__AF467768.2__Gn-4aa-Gc
agcgaggaacccuccgacgauugcaucucuagaacccagcuucucaggacagagacugccgaaauucacggcgacaacuacgggggaccuggugauaagauaacgaucuguaauggcucaaccauuguggaccaacggcuugggagugagcugggaugcuauacaaucaaccgcguccguagcuucaaauugugugaaaauuccgcuacuggcaagaacugcgagauugauucuguuccagugaaaugucgacaggguuacugcuuaagaaucacccaggaggggaggggacauguaaagcugucgcggggcucagaagugguccuagacgcaugugauacaagcugcgagauaaugaucccgaaaggcaccggggacauucucguggauuguaguggaggucagcaacacuuucugaaggacaaucuuaucgaucugggcugccccaagauuccuuugcucgggaaaauggccaucuauauaugucgcauguccaaccauccaaagacuacaauggcguuccuguuuugguucucuuuuggauacguuauuaccugcauccugugcaaagcuauuuucuaucucuuaaucaucgugggcacgcuggguaagagacuuaaacaguacagggaauugaagccccagacuuguaccauuugcgagacaacuccugucaaugccauagacgcagagaugcacgaucugaacuguagcuauaauaucugcccauacugugccucccggcuaaccucagacgggcucgcucgccaugugauucagugccccaagcgaaaagaaaagguagaggaaacagagcuguaccuuaaccuggaaagaaucccuuggguugugaggaaauugcuccaagucagugagagcaccggaguggcacugaagcggucuuccugguuaauagugcugcucguccuuuuuacgguuucacugagcccagugcagagugccccgauuggccguaaacccuuguuccuagacucuacugcuaagggcaugaaaaaucugcucaacuccacaagccuggagaccucgcuuucuaucgaagccccuuggggagcgaucaauguacaguccacuuauaagccaacagugucaaccgcaaacauugcccugaguuggagcuccgucgagcaccgcgggaauaagaucuuggugucugguagaagcgaaucaauuaugaaacucgaggaaaggacgggcauaaguugggaucuggggguugaggacgcuuccgagagcaaguuacugaccgugucugucauggaucuaucacagauguacagucccguguuugaauaucucagcggagaccggcaaguaggcgaguggccuaaagccacauguacuggugauugcccagaacgaugugggugcaccuccucuacaugucugcacaaggaguggccccauucgcgcaacuggagaugcaacccgacuuggugcuggggcguuggaaccggcuguacaugcugugggcuugacgugaaagauuuguucaccgacuacauguuugucaaguggaagguggaauauaucaaaacugaggcaauugucugcguggagcugacgagccaggaaaggcaguguucccucaucgaggcuggaacacgguucaaucuggguccuguuaccaucacucuuucagaaccccgcaacauucaacagaagcugccaccugagauaaucaccuugcaccccagaauugaggaaggcuuuuucgaucucaugcaugugcagaaaguacugagugccucuacagucugcaaguuacagagcuguacccacggggugccaggagaccugcaaguuuaccacaucggcaaucuacucaaaggugauaaggugaacgggcaucugauucacaagaucgagccccauuucaauacuuccuggaugucaugggacggcugcgaccuugauuauuacuguaacaugggagacuggccuagcugcacauacacgggcgucacccagcacaaucaugcgucuuuugugaacuugcugaauauagaaacugauuauaccaaaaacuuccacuuucacuccaagaggguaacagcccauggggacacaccacagcucgaucugaaagcacguccgacuuacggagcuggugagaucaccguguuaguugaagucgccgacauggagcugcacacgaagaaaauugagaucaguggccuuaaguucgcuagcuuggccuguaccgggugcuaugcaugcucuagcggaauuucauguaaggugcggauccauguggaugaacccgacgagcucacaguccacguuaaaagugaugacccugaugugguggccgcuagcucgucccugauggcgcgaaagcuagaauuuggcacugacucuaccuucaaagcauuuagcgccaugccaaagacaucacugugcuucuacauaguagagagagaacacuguaaaaguugcuccgaggaggauacuaagaaaugugucaauaccaagcucgaacagccccaaucuauucugaucgagcauaaggguacgauuaucgggaaacagaacagcacaugcaccgcuaaggccuccuguuggcuugaaucagugaaauccuuuuucuauggcuugaagaauaugcugaguggaauauuuggcaacguuuucauggggaucuuuuuauuccucgcaccuuucauucugcuuauccuguuuuucauguuuggauggaggauuuuguucugcuuuaaauguugccgccggacuagaggccucuucaaguacaggcaccugaaggacgacgaggaaacagguuaucgccgaaucauagagaaacuaaauaacaagaaagggaagaacaaacugcucgauggagagcggcuggccgaccguagaauugcugaacuguuuucuaccaagacucauaucggc

SEQ ID NO: 10553 - RNA, 2916 nt, Artificial Sequence
  derived and/or modified CDS sequence (opt3) from CCHFV(Turkey-Kelkit06, Artificial)__GQ337054.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguuguguaaaaauagcgcuacuggcaagaccugcgaaguugacuccacaccagugaaaugucgacaggguuuuugcuuaaagauuacccaggaggggcguggacauguaaagcugucuagaggcucggaggugguccuagaugcaugugacucaagcugcgaagugaugaucccgaaaggcacuggggauauacucguugacuguaguggaggucagcaacacuuccugaaggauaaccuuaucgaccugggcugcccccauauuccuuugcucgggaggauggccaucuacauuugucggauguccaaucacccacgcacaaccauggcguuucuguucugguuuucuuucggauaugugaucacgugcauauuuugcaaagcucuguucuacagccucauuaucauuggcacuuuagguaagaaaaucaagcaguauagagagcugaagccccagaccuguacaaucugcgaaacugccccugucaacgcaauugaugccgagaugcaugaccuuaauuguuccuacaacauaugcccauauugugcuucaagguugaccagugacgggcuggcacggcacgugacacagugccccaaacgcaaggagaaaguagaagagaccgaacuauaccucaaucuggagcgaaucccuuggauuguuagaaaacuucugcaagugagcgaaucuacgggagucgccuugaagagguccucauggcucaucgugcuguuagugcugcucacugucagccuuaguccaguucagucugcuccggugggccggaagccccuguuuuuggauuccauaguaaaaggcaugaagaaccuacugaauagcacaucgcucgagaccucucuguccauugaggccccuuggggagcgaucaacgugcagucaacuuucaagccaacagucaguaccgcaaauaucgcccuuagcugguccucugugguucaccgugggaacaaaauucuggugacgggucgcagcgaaucaaucaugaaguuggaggaaagaaccggcgucaguugggaccucgggguggaggaugcuuccgaaagcaaacuguuaacaguaucuauuauggaccugucacagauguacagucccguuuuugaguaucuaagcggagauaggcaaguggaggaauggccuaaggccacuuguaccggcgacugcccagagcggugugguugcacauccucuacuugucuccauaaagaauggucgcacagccgaaauuggcgcugcaaccccaccuggugcuggggcgucgggacaggauguaccugcuguggcguggaugucaaggaccuguucacugaucauauguuugugaaguggaaaguugaguacauaaagacggaagcaaucgugugcguagcucuuacaucccaggagagacaguguucauugauugaggccgggaccagguucaaccugggaccggucacuaucacccucagugaaccucggaauauccaacagaaacugcccccagagauuauaacacuucacccuaagaucgaagaggguuucuuugaccugaugcacgugcagaaaguuuugucugcgagcaccgugugcaagcuccaguccuguacucauggcauucccggggaucugcaagucuaucacaucggaaacuuacugaagggcgaccgcgugaauggucaucuaauucacaaaaucgagucacauuucaacacaagcuggaugucuugggacgggugcgaucucgacuacuauuguaauaugggcgauuggccauccugcacguacaccggaguaacucagcacaaccacgccgcauuugugaaucugcuuaacauagaaacagacuauaccaagacauuccauuuucacaguaaaagaguuacugcucauggcgauacaccccaguuggaccugaaggccaggccuacguacggggcuggagguaucaccguccucguggagguggccgauauggaacugcacaccaaaaaggucgagauuagcggcuuaaaguucgcaucucuggccuguacugggugcuacgcuugcuccucaggaaucaguuguaaaguucguauucacguggacgaaccagaugagcuuaccgugcauguaaagagcucggacccggaugucguggcggcauccacaucuuugauggcccggaaacucgaguuuggcacugacagcaccuucaaggcuuuuucagccaugcccaaaacgagucugugcuucuauaucguugaacgagaguacuguaaguccugcucugaagaugacacacagaaauguguggacaccagacuagagcaaccucagagcauacugauugaacacaaggguacuaucauugggaagcagaaugauacaugcaccgcaaaagccuccuguuggcucgagucagucaagagcuuuuucuauggccugaaaaacaugcuuggaaguguguuuggcaauuuguucaucgggauacuguuauuccucgcuccauuuguucugcuugugcuguucuuuauguucggauggaagaucuuguuuugcuucaaauguugcaggcgcacucggggccucuuuaaguacagacaucugaaggacgaugaggaaaccgguuauaggcgcauuaucgagcgacuaaacucuaaaaaggggaaaaaucggcugcucgacggagaucgucuggccgacagaaagauugcagaacuuuucuccacaaaaacgcacaucggc

SEQ ID NO: 10554 - RNA, 2919 nt, Artificial Sequence
  derived and/or modified CDS sequence (opt3) from CCHFV(SR3, Artificial)__AJ538199.1__Gn-4aa-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugcguagcuucaaauugugugaaaauuccgcuacugguaagucuugcgagauugauucgaucccuguaaaauguaagcagggguacugcuuaaaaauuacccaggagggacgaggccaugugaagcugucaagaggcagcgaagucgugcuagacguuugugauaguuccugcgaggugaugaucccaaaggggacaggagacauacucgucgauuguucugguggccagcaacacuuucugaaagacaaccuuguggaucuggggugcccgaagauccccuugcucggaaaaauggcaauuuauaucuguaggaugagcaaucauccuaagaccacuauggccuuccuguuuugguucuccuuuggcuacguaauuacaugcauccugugcaaagcgauauucuuucucuuaauuaucuucgguacccuggggaagcgguuuaagcaguaucgcgaacuuaaaccacagacguguacuauuugcgagaccacacccguuaacgcuaucgacgccgagaugcacgauuugaauuguucauacaacaucugcccuuauugugcaaguagacugacuagcgacggacuagccaggcaugugacccagugcccacggcgcaaggaaaaagucgaggaaacagagcucuaccugaaucuugaacgaauacccuggguggugagaaagcuguugcaagucucugaguccaccggcacgguucucaaaaggucaagcuggcugauuguguuacugguacucuucacugugagucuuucuccuguccaguccgcuccaaucggccugcggcguccguuguuucuagacagcauugugaaggggaugaaaaaccugcucaauucgacaucucuggagaccucccuuucaaucgaagcacccuggggagccauaaacguucagaguacuuacaagccuacagugagcaccgcuaauauugcccuguccuggucuagcgucgagcaccgcgguaacaagguguugguaucaggcagaagugaauccaucaugaaacucgaggaaaggacggggaucagcugggaucugggaguugaggacgcgucugagucaaaguuacugaccgugagugucauggaucuaagccagauguauuccccaguguucgaauaccucucuggcgaccggcaagucgaggaauggcccaaagcaacauguacuggugauugcccugagcgaugugggugcaccucgagcacaugucugcacaaggaauggccacauucccgcaauuggagaugcaaccccacuuggugcuggggcgugggaaccggcuguacaugcugugggcuugacguuaaagauuuguuuaccgacuauauguucgugaaguggaagguagaguacauuaaaacugaggccaucgucugcguggaacugacgucacaggagaggcaguguagucucauugaagcuggaacacgguucaaccuggguucuguuaccauaacucuuagcgagccgcgcaauauccaacagaagcugccucccgagauuaucaccuugcacccaaaaaucgaagagggcuuuuucgaucucaugcaugugcagaagguccuguccgccucaacagugugcaaauuacagagcuguacccacgggguaccuggagaccugcaaguguaucacauuggcaaccuacucaagggugauagaguuaaugggcaucugauacacaagaucgaacagcauuuuaacacuucuuggauguccugggacggcugcgaccuugauuacuauuguaauaugggagacuggcccaguugcacauacacgggcgucacccagcacaaccaugcuagcuucgugaauuugcugaacauugagacugauuacacaaaaaccuuucacuuccacucuaagagggugacagcacauggggacacuccacagcucgaucugaaagcccgucccaccuauggagcgggugaaaucacggucuuaguugagguggccgacauggagcugcacaccaagaaaauugaaaucuccggccuuaaguuugcaggguugacauguacuggaugcuacgcuugcucaaguggcauaagcuguaaggugcggauccauguagaugagccugacgaacucaccguccacgugaaaucggaugacccagauguuguggccgcuuccucuagccugauggcccgaaagcuagaguucgguacagacucaacuuuuaaagcauucagugccaugccgaagaccucccugugcuuuuauauugucgaaagagaguacuguaaaucuugcaauaaggaggauacgcaaaaaugugugaacacaaagcucgaacagccccagagcauccugauugagcacaaggggaccaucauaggcaaacagaauaacacuugcacagcuaaggcguccuguuggcuugaaucaguuaagagcuucuuuuauggauugaaaaauaugcugggcgggauuuucggaaacguguucaucggcauuuuuaccuucuuaacuccuuuuauccuccugauacuuuucuuuauguucgguuggaggauccuguuuugcuucaaauguugccgccggaccagaggguuguuuaaguacaggcaucucaaggacgacgaggaaacaggauaucgcaaaauuaucgagcgacugaauaacaagaaaggcaagaaccggcuacuggauggugagcgucucgcagacagaaaaauugccgaacuguucaguacgaagacccacaucggc

SEQ ID NO: 10555 - RNA, 2919 nt, Artificial Sequence
  derived and/or modified CDS sequence (opt3) from CCHFV(UCCR4413, Artificial)__KY484038.1__Gn-4aa-Gc
agcgaguccucugccucaggcugcaucaguagaacccagaugauuaagagcgaaacagcugagauacacgacgauaucuacgggggacccggugaaaaacugacuauuuguaacggcacgaccguggucgaccaaaggcucggguccgagcuuggaugcuauacaaucaaucggauuaagacuuacaaacugugugaaaacucuguuaaggagaaaaccugcgagaucgauucggugccuguaaagugucgccagggcuugugcuuaaagauaacacaggaaggucgagggcaugugaaacugucacguggaagcgagaucguccuagacauuugugauaguuccugcgaacucaugaucccaaagggcaccggcgacauucugguggauuguucugggggacagcaacacuuccuucaggacaaucugguugauuuggguugcccgaacaucccccuccugggcaaaguggcaauauauauuuguagaaugagcaaucauccuaagacuacaauggccuuucuguucugguuuuccuucggguacgucauuaccugcauccucugcaaaaucuuauuuuaucugcuuaucauuacgggaacuuugggcaagaagcugaaacaguacagggagcuaaagccacagaccuguacaauaugcgagucaacucccgugaacgcgaucgacgcugaaaugcacgaucucaauuguaguuauaacauuugcccuuacugugccagccggcugaccucugacggucuuauccgccauguaaaucugugcccaaaaagaaaggagaaaguugaagagacagaauuguaccucaaccuggagaggauacccugguucgugcggaaguuacugcaagucuccgagucaaccgggguggcacucaaacgcagcaguuggcuucugauuuuggugauccuacugacggucucuauguccccuguucagagcgccccaaucaaucgaaagccgcucuuucugucgucuauugugaagggaaagaagaaccuucugaauagugcuucauuggaaacuucccucagcaucgaggcacccuggggcgccauuaacgcucaguccacauucaaaccuaccauaucuacugccaauaucgcgcugagcuggucaaguguagaacacagaggcaacaagguguuagucuccgggaggagcgagucuauuaugaaacuggaggagcggacaggaaucucauggaaccuagguguggaggaugcaagugaaagccguaugcucaccguuuccgugauggaccugucucagauguaucuuccagucuuugaguacuugucgggcgaccgccaaguggaagaguggcccaaggccacguguaccggggauugcccugaaagauguggaugcacaagcuccacuugucugcacaaggaguggccacauucaaggaauuggcggugcaaccccaccuggugcuggggcguagguacaggguguacuugcuguggccucgacguuaaagaucuguucaccgacuauauguuugugaaguggaaagucgaguacaucaagacagaagcuauugugugcgucgagcuuaccagucaggaacgacaguguucucugauagaggccggaacucgcuucaauuugggcccggugacgaucacacucagcgagccuagaaacauucaacagaaacugcccuccgaaaucguuaccuuacacccaaagauugaggaaggguuuuucgaucugaugcaugugcagaagguacuaucagcaagcacugucugcaaacuccagucuuguacccacggaguggcuggugaccugcaaguuuaucacgugggcaaucuuuugaagggggauaaaaucaacggacauuccauacacaagaucgagccucaucugaauacaaguuggaugagcugggacggcugcgaucucgacuacuauuguaacaugggugauuggcccucuugcaccuacacuggggucacacagcacaaucaugccgcguucgugaaccuguuaaauauugaaacggacuacaccaaauccuuucacuuccacucaaagaggguaacugcccauggcgacacaccacagcuggaucuuaaggcacggcccauguauggagcuggcgagaucaccguguugguugaggucgccgacauggaacuccacaguaaaaacauugagaucagcgggcugaaguuugcuucgcuaacauguuccggaugcuacgccugcucuagcgguauaucauguaaagugcgcauucauguggaugaaccugacgagcuggcaguccacguuaagagugaugaccucgaugugguggccgcuuccucuagccugauggcgagaaaaaucgaguucggcacugacuccaccuuuaaggcauucucaagcaugccaaaagaaagucuuugcuuuuauauuguagagagggauuucuguaagucuugcgccgcugaagacacgcagaagugugucaaagccaaguuggagcaaccgcaguccauccugauagaacacaaagggaccaucauuggaaagcagaaugauacaugcagcacuaaaaccucguguugguuagagucauuuaagucuuucuuuuacggccucaagaacaugcugagugguguguucggguccgcaaucaugggcauucuucuguuuuuggcccccuucauccuccugauacuauucuuuuucuuuggauggcguauucuguucugccuccgguguugccgaagaacaaggggccuguuuaaauauaagcauaucaaagacgaugaagaggcuggguacaagaaaaucauugagaaacuuaauaacaagaaaggaggcacuagcaaguugcuggacggugaacgcuuagccgaccggaaaaucgcagaacucuucucuaccaaggcgcacauuggg

SEQ ID NO: 10556 - RNA, 2916 nt, Artificial Sequence
  derived and/or modified CDS sequence (opt3) from CCHFV(66019, Artificial)__AB069669.1__Gn-4aa-Gc
agcgaggaauccggcgacgauugcaucucuagaacccagcugcucaggacagagacugccgaagugcacggggacaacuacggaggucccggcgauaagauuacgauauguaaugggucaaccaucgucgaccaacggcuuggaagugagcugggcugcuauacaauuaaccgcguuaagagcuucaaauugugugaaaauuccgguacugggaaaucuugcaagaucgauaacaccccugugaaaugucgacagggauuuugcuuaaagauuacacaggagggccguggccauguaaagcugucgagagggucagaggugguccuagacgcuugugauagcaguugcgaaaucaugauaccaaaaggaaccggugacauccucguggauuguuccggcgggcagcaacacuuccugaaggacaaucuuguugaucugggaugcccgaacauucccuugcucggcaaaauggcaaucuacauuuguaggaugucuaaucauccuaagacuacaauggccuuucuguucugguuuagcuucgguuaugugauaaccugcaucuuuugcaaaauuaucuucuaccugcucauugucguggggacguuaggaaagaaguuuaaacaguaucgggagcugaagccacagacuuguaccaucugcgaaacaacucccaccaacgcgaucgacgcugagaugcacgaucuuaaauguuccuacaauauuugcccuuauugugccucacgcuugacaagugacggccuggcaagacauguaacccagugcccaaagaggaaagagaagguugaagagacggaacuauaccucaaccuggagcggauacccuggaucgugcgcaaacuucugcaagucagcgaaucuacuggcguggccuugaagcgauccucauggcucauugugcuguuaguccugcucacaguuagccuuaguccugugcagucugcuccaaucgggagaaagccgcuguucuccgacagcauaguaaaaggaaugaagaauuugcuaaacucgaccucucuggagacuucccucucaauugaggcacccuggggugccaucaaugugcagaguacauuuaaaccuaccgucagcacggcuaacaucgcccuguccuggucuagcguggaacacaggggcaauaagauucuuguuucagggcggagugaguccaucaugaaacuggaggagcguaccggaauuagcugggauuugggcguggaagacgcgucugagucaaagcuccugacagucagugugauggauuuaagccagauguacuccccaguauucgaguaucugucuggugaccgccaaguugaagaguggcccaaggcaacuuguaccgggaacugcccugauagauguggcugcacaucgagcacuugucuacacaaagaauggccacauuccaggaacuggcggugcaaucccaccuggugcuggggagugggcacaggguguaccugcuguggacucgacgucaaggaucuguuuacugacuacauguucgugaaauggaaggucgaguauauaaaaacggaagccaucgugugcguugagcuuaacucacaggagcgacaguguaguuugauugaagcugguacacgcuucaaucugggcccggugaccaucacucucucugagccuagaaacauccaacagaagcugcccagcgaaauuauaacccuucacccaaggaucgaggagggguuuuucgaucugaugcauguacagaaggucuuguccgccucaacagugugcaaacuccagagcuguacccacggaguuccuggcgaccugcaaauuuaccacaucgguaauuuacugaagggggaucgggugaacggccaucuaauucacaaaaucgaaccccauuuuaauacuucuuggauguccugggacggaugcgaccucgauuauuacuguaacaugggcgacuggccaaguugcacauauacgggggucacccagcacaaucaugcagcuuucgugaaccugcuuaauauagagacugauuacacaaagaacuuucacuuccacagcaaacgcguaaccgcccauggagacacaccccaguuggaucugaaggcgagaccuacuuacggugccggcgaaaucaccgugcucguugaggucgcagacauggaacugcacacgaagaaaauugcuaucucuggguuaaaguuugccucccugaccuguacaggaugcuaugcuugcucaaguggcauuagcuguaaagugaggauccauguggaugagccagacgagcuuacuguccacguuaagucggaagauccggacauaguggccgcauccucuagcuugauggcccguaaacucgaguucgguaccgauucaacauuuaaggcuuucagugcgaugcccaaaacuucccugugcuuuuacauuguggaacgggaguauugugaaucuugcagcaaggaggacacccagaaguguguaaauacgaaacuagagcaaccucaguccauccugauugaacacaaggggacaaucauaggcaaacagaacgauaccugcacugcaaaggccucauguuggcucgagagcgucaaaaguuucuuuuacggacugaagaauaugcuuucuggcaucuucgggaacguguucauuggaaucuuuuuguuccuggcuccauuuauuuuacucauccuguucuuuauguucggcuggcgaauacuguuuugcuucaaguguugcagaaggacacgcggucuuuuuaaauaucgguacuugaaggacgacgaagaguccggguauagaaggauuaucgaacgccucaacaauaaaaagggcaaaaacaagcugcuagauggagagcgacuggccgaccggcguaucgcagaacucuucagcaccaagacucauauuggu

SEQ ID NO: 10557 - RNA, 2916 nt, Artificial Sequence
  derived and/or modified CDS sequence (opt3) from CCHFV(7001, Artificial)__AB069670.1__Gn-4aa-Gc
gccgagggcgggagcuccgacugcaucucuagaacccagcuggugaagacagaagucgcugagauucacgaagauucauacggaggucccggcgagaaaauaacuaucuguaacgggaguacgauuguugaccaaaggcucggaagcgaacuuggcugcuauaccaucaaucgggugcgcuccuacaagcugugugagaacucugcaucggguaaaucaugcgagauugauagcaucccuguaaaguguaaacagggguucugcuugaagauaacacaggaaggacgaggccaugugaaguuaagucguggcacugagaucguccuggacgugugugauuccucuugcgaacuaaugauuccaaaagggaccggagacauccucguugauuguagcgguggccagcaacacuuucugcagaauaaccuuauugaccuggggugcccgaaugugcccuugcucggaaagauggccaucuaugucuguagaauguccaaccauccuaaaacaaccauggcguuccuguuuugguucucauuuggcuacgugauaacuugcauugcuugcaggguacuguucuaucucuuaaucgccauugguacaguugggaagaaacugaagcaguaccgggagcuuaagccacagaccuguaucgugugcgagaguguccccgugaaugcaaucgaugccgaaaugcacgaguugaacuguagcuauaauauuugcccuuacugugcuucucgccuguccacggacggacuaauaagacaugugacucaaugcccaaaaaggcgggaaaaggucgaggaaaccgagcucuuucugaaccuugagcgcauccccuggcugguucgaaaauugcuccaggugucagaaagcacaggcauggcacugaagagaaguuguuggaugauuacuuuacugauccuccuucugguaucuauauccccugugcagagcgccccagucggcaggaaaccguuguuccuagauaauauugcuaaggggaugaaaucgcugcucaacucuaccucccuggagacaucacuuaguaucgaagcccccuggggagcgaucaaugugcagagcaccuuuaagccuacgguuuccgcagccaacauugcucugucuuggagcucaguggagcaccgggguaauaagaucuuggucaguggccguuccgaaagcauuaugaaacucgaggagcgcacuggggugucuuggaaccugggaguagaagacgccucagagaguaagacauuaaccguuagcgugauggaucugucccaaauguacucuccagucuucgaauaucuaucgggcgacagacagguggaggaauggcccaaagcaacuugcacaggugacuguccugagaggugcggguguaccagcuccacgugccuccacaaggaguggccacauucacggaacuggcgaugcaaucccaccugguguuggggcgucggaacaggcugcacuuguugcgggcuggaugugaaagacuuuuucaccgauuacaugcuuguuaaguggaagguggaauauauaaaaacagaggcuaucguaugugucgaauugacaagucaggagcgccaaugcucucugauugaggccggaaccagauuuaaccucgguccggugacaaucacccugagcgaaccuaggaauguucagcagcggcuucccccagagaucgugacucugcacccuaagauugaagagggcuucuucgacuugaugcauguccagaaaauacucuccgcgucaacgguguguaagcugcaaagcugcacacacgggguacccggagauuuucagguguaccacguuggcaacuuacugcgcggugacaaagucaaugggcauucuauccacaagauugaaccacauuucaacaccuccuggaugaguugggauggcugugaccuagauuauuuuugcaauaugggagacuggcccagcuguacuuacaccggcgugacacagcacaacagagccgcauucaucaauaugcucaacauugagaccgauuauacuaagacauuucauuuccacucuaaaagggugacggcucacggggacaccccucagcuggaccuuaaggcccguccagcuuacggagccggugaggucacuguuuugguggaaguggcagaucuggagcuccauacuaaaaagcuggaaguauccggcuuaaaaaucgccucacugaccugcagugggugcuacgcuuguagcucgggaauauccugcaagguccggauccacgugaaugagccggacgaauuuacaguucaugugcgaucuagcgaucccgacgucguggcggcaggcucaagucuuauggccagaaagauugaguucggugcugauuccacuuuuaaagccuucucuagcaugccuaaggacuccuuguguuuuuauaucguugagaaagauuacugcucaagcuguaccgacgaugacacgcaaaagugcgugaacaccaaacucgaucacccacagaguauucugaucgaacacaaggggacaauaauuggcaaacagaaugacacuuguucuaccaagacauccugcuggcuagagagcguaaagggauucuuuuauggccugaaaaacaugcucucggggaucuucggaaaugucuuccugggcauuuuucuuuucuuggcacccuuugugcuguuaaucuucuuuuucuuuuucgguuggaggcuccuguuuugucuuaagugcugucgccggacuagagggcuguugaaauacaagcaucucaaagaugaagaggaagccggauauaagaagauaaucgagaggcugaacggcaaaaaggguaaaucacagcuauucgacggcgagcgccuggcugaccgaaagauugccgaacucuuuucuaccaaaauccacauuggg

SEQ ID NO: 10558 - RNA, 2916 nt, Artificial Sequence
  derived and/or modified CDS sequence (opt3) from CCHFV(75024, Artificial)__AB069671.1__Gn-4aa-Gc
agcgaggaauccggcgacgauugcaucucuagaacccagcugcucaggacagagacugccgaaauucacggggacaacuacggaggucccggcgauaagauaacgaucuguaaugggucaaccauuguggaccaacggcuuggaagugagaugggcugcuauacaaucaaccgcgucaagagcuucaagcugugugaaaauuccgcuacugguaaaucuugcgagauugauucgaucccuguuaagugucgacagggguacugcuugaaaauaacccaggagggacguggccaugugaaguuaucaagaggcagcgaaguagugcuggacgcaugugauaguuccugcgaggucaugaucccaaaggggacaggagacauucuaguggauuguucugguggccagcaacacuuucucaaagacaaccugaucgaucuugggugcccgagcauuccccuguugggaaagauggccaucuauauauguaggauguccaaucauccuaaaaccacuauggcguuccucuuuugguucucauuuggcuacguuauuacaugcauccugugcaaggcuauuuucuaucugcucaucaucguggguaccuuagggaaacgguuuaagcaguaccgcgaacugaagccacagacguguacuauuugcgagaccacacccgccaacgcaauagacgccgagaugcacgaucuuaauuguaguuauaacaucugcccuuacugugcuagcagauugacuucugacggacuggcaaggcaugucacccagugcccaaaacggaaggaaaaaguggaggaaacagagcuauaccucaaucuggaacgcauucccuggguaguucgaaaguugcugcaaguguccgagucaaccggcgucgccuugaaaagaagcaguuggcucaucgugcuguuagugcuguucgcuauaucucucuccccuguccagagcgccccaauuggcaggcggccgcuuuuucuggacucgaucguucgugggaugaagaaccagcuuaauucuacgucccuagagacuucacugaguaucgaagcgcccuggggagcaauuaacgugcagagcacauauaaaccuaccguauccacugccaauaucgcucucucuuggagcucaguggagcaccgcgguaacaagauucuggucaguggcagauccgaaagcauaaugaaacuugaggaaaggacagggaucucuugggaucugggaguggaggacgccucagagaguaaauugcucaccguuagcgugauggaucugucccaaauguacucuccagucuucgaauauuuaucgggcgaccgacagguggaggaauggcccaaggcaacguguaccggugauugcccugagcggugugggugcacaacuagcaccugucugcacaaagaauggccacauucccgcaauuggagaugcaaccccacauggugcuggggcguaggaacuggcuguaccugcugugggcuagacguuaaggaucucuuuacagacuacaugauugugaaauggaaggucgaguauaucaagaccgaggcuaucgugugcgucgaacugacuucacaggagaggcaauguagucuuauugaagccggaacgcgguucaacuuggguucugugacaauaacccugagcgagccgcgcaauauccagcagaaacucccucccgagauuaucacucugcacccaagaauugaagagggcuuuuucgaucuuaugcauguucagaaggugcuguccgcgucaaccguaugcaaauugcaaagcuguacacacggggucccuggagaccuccagguguaccacguuggcaaccuguuaaagggugauaaagugaaugggcaucugauccacaagauagaaccccaucuaaacaccucuuggauguccugggacggcugcgaccucgauuauuacuguaauaugggagacuggccaaguugcacuuacacaggcgucacgcagcacaaccaugccagcuucgugaaucugcuuaacaucgagaccgauuauacuaagucuuuucacuuccacuccaaaaggguaacagcacauggggacaccccacaguuggaucugaaggcucguccuacauacggagccggugaaauuacugugcucguugaggucgcugacauggaguuuacccccaaaaagaucgaaauuucaggccugaaauucgccaguuuaacguguaccgggugcuaugcaugcagcucgggaaucuccuguaaggugcggauacacguggaugagccggacgaacugacaguccauguuaagucugaugaccccgaugugguggccgcuagcucaagucuuauggcgcgaaaauuggaguuuggcacugacuccaccuucaaggcauuuucugccaugccuaaaacaagccucugcuucuacauuguagaaagagaguauuguaaguccugcucaaaagaggauacucaaaagugugucaauaccaaacuggaacagccacagagcauccuaauugagcacaaggguacgaucauagggaagcagaacaauacaugcaccgcuaaagccaguuguuggcuggaaucugugaaguccuuuuucuacggccucaaaaacaugcugagcggaaucuuuggcaaucuuuucauggggaucuuuuuguuccuggcacccuucauuuuacucauucuguuuuucauguuuggauggaggauccuuuucugcuuuaaguguugccgccggacuagaggccuguucaaauauaggcacuugaaggacgacgaggaaacagguuaccgccgaauaauugagcggcucaacaauaagaaagggaagaacaaacugcuagauggagagcgucuggccgacagaaggaucgcugaacucuuuucgaccaagacucauaucggc

SEQ ID NO: 10559 - RNA, 2916 nt, Artificial Sequence
  derived and/or modified CDS sequence (opt3) from CCHFV(7803, Artificial)__AB069672.1__Gn-4aa-Gc
agcgaggaauccggcgacgauugcaucucuagaacccagcugcucaggacagagacugccgaaauucacggggacaacuacggaggucccggcgauaagauaacgaucuguaaugggucaaccauuguggaccaacggcuuggaagugagaugggcugcuauacaaucaaccgcgucaaaaguuucaagcugugugaaaauuccgcuacugguaaaucuugcgagauugauucgaucccuguuaagugucgacagggguacugcuugaaaauaacccaggagggacguggccaugugaaguuaucaagaggcagcgaaguaauccuggacgcaugugauaguuccugcgaggugaugauuccaaaggggacaggagacauccuagucgauuguucugguggccagcaacacuuucucaaagacaaccugauugaucuugggugcccgagcaucccccuguugggaaagauggccauauauauuuguaggauguccaaucauccuaaaaccacuauggcguuccucuuuugguucucauuuggcuacgugaucacaugcauucugugcaaggcuaucuucuaucugcucaucauuguugguaccuuagggaaacgguuuaagcaguaccgcgaacugaagccacagacguguacuauaugcgagaccacacccgccaacgcaaucgacgccgagaugcacgaucuuaauuguaguuauaacauuugcccuuacugugcuagcagauugacuucugacggacuggcaaggcaugugacccagugcccaaaacggaaggaaaaagucgaggaaacagagcuauaccucaaucuggaacgcauccccugggugguacgaaagcuccugcaaguuuccgagucaaccggcguggccuugaaaagaagcaguuggcucauaguccuguuagugcuguucgcuauuucucucuccccugugcagagcgccccaaucucgaggcggccgcuuuuucuggacucuaucguccguggcaugaagaacccccuuaauuccacgucacuagagacuagccugagcauugaagcgccuuggggagcaaucaacguucaguccacauauaaaccaaccgugucuacugccaauauugcucucagcuggucaaguguagagcaccgcgggaacaagauacugguguccgguagaagcgaaucuaucaugaaguuggaggaaaggacaggcauuucaugggaucugggggucgaggacgccagugagagcaaauugcucaccguguccguuauggaucugucucagauguacucgcccguguucgaauauuuaagcggagaccggcaagucgaggaauggccuaaggcaacguguaccggcgauugcccagagcgaugugguugcacaacuuccaccugucugcacaaagaauggccccauucacgcaauuggagaugcaacccgacauggugcuggggcguggggacuggauguaccugcuguggccuagacguaaaggaucucuuuacagacuacaugaucguuaaauggaagguggaguauaucaagaccagggggauugucugcguggagcugacuucucaggaacggcaguguucucuuauagaggcuggaacgcgcuucaacuuggguagcgucacaaucacccuguccgaaccuagaaauauucaacagaaacuucccccagagaucauuacucugcacccuaggaucgaggaaggcuuuuucgaucuuaugcaugugcagaagguucugucagccagcaccgugugcaaauugcagucuuguacacacgggguacccggagaccuccaagucuaccacgugggcaaccuguuaaagggugauaaaguuaaugggcaucugauacacaagaucgagccacaucuaaacaccuccuggaugaguugggacggcugcgaccucgauuauuacuguaauaugggagacuggcccagcugcacuuacacaggcgugacgcagcacaaccaugcgucuuucgucaaucugcuuaacauugaaaccgauuauacuaaguccuuucacuuccacucaaaacgugugacagcccauggggacaccccucaguuggaucugaaggcacggccaacauacggagcuggugagaucacuguacucguggaaguugccgacauggaguuuaccccgaaaaagauugagaucaguggccugaaauucgcuagcuuaacguguaccgggugcuaugccugcucguccggaauaucuuguaagguccgaauccacguggaugaacccgacgagcugacagugcaugucaagagcgaugacccugauguuguggcagccucaaguucccuuauggcuagaaaauuggaauuuggcacugacucuaccuucaaggcguuuagcgcaaugccaaaaacaucccucugcuucuacauuguggagagggaauauuguaagucaugcagcaaagaggauacucagaaguguguaaauaccaaacuggagcaaccccagaguauucuaaucgaacacaaggguacgauaaucgggaagcagaacaauacaugcaccgccaaagcuaguuguuggcuggaguccgucaagagcuuuuucuacggccucaaaaacaugcugucgggaauuuuuggcaauuucuuuauggggaucuuccuuuucuuggccccuuuuauucuguuaauccucuucuuuauguucggauggcgcauacuguuuugcuucaaguguugccggagaacuaggggccuuuuuaaauaucgccaccugaaggacgacgaagagacagguuaccgacggauuaucgaacguuugaacaauaagaaagggaagaacaaacuccuggauggagagagacuagcagacaggcgcaucgccgagcuguucucaaccaagacucauauuggc

SEQ ID NO: 10560 - RNA, 2916 nt, Artificial Sequence
  derived and/or modified CDS sequence (opt3) from CCHFV(79121, Artificial)__AB069673.1__Gn-4aa-Gc
gccgagggcgggagcuccgacugcaucucuagaacccagcuggugaagacagaagucgcugagauucacgaagauucauacggaggucccggcgagaaaauaacuaucuguaacgggaguacgauuguugaccaaggacucggcagcgaacuugguugcuauaccaucaauagggugcgguccuacaagcugugugagaacucugcaucggggaaaucaugcgagauugauagcaucccuguaaaguguaaacagggauucugcuugaagauaacacaggaaggccgcggccaugugaaguuaagucgagggacugagaucguccuggacgugugugauuccucuugcgaacuaaugauuccaaaaggaaccggugacauccucguugauuguagcggcgggcagcaacacuuucugcagaauaaccuuauugaccugggaugcccgaaugugcccuugcucggcaagauggccaucuaugucugucguauguccaaccauccuaaaacaaccauggcguuccuguuuugguucucauuugguuacgugauaacuugcauugcuugcagaguacuguucuaucucuuaaucgccauugggacaguuggaaagaaacugaagcaguacagggagcuuaagccacagaccuguaucgugugcgagaguguccccgugaaugcaaucgaugccgaaaugcacgaguugaacuguagcuauaauauuugcccuuacugugcuucucggcuguccacggacggccuaauacgccaugugacucaaugcccaaaaagaagggaaaaggucgaggaaaccgagcucuuucugaaccuugagcggauccccuggcugguucgcaaauugcuccaggugucagaaagcacaggcauggcacugaagcgaaguuguuggaugauuacuuuacugauccuccuucugguaucuauauccccugugcagagcgccccagucgggagaaaaccguuguuccuagauucgaccgcuaagggaaugaaaucucugcucaauuccacaucacuggagaccagucuuagcauugaagcccccuggggugcgaucaacgugcaguccacguuuaagccuacuguuucugcagccaauaucgcucugagcuggucaaguguggagcacaggggcaacaagauuuuggucuccgggcggagcgaaucuaucaugaaacucgaggagcguacaggagugucauggaaucugggcguagaagacgccagugagagcaagaccuuaacuguuuccgugauggaucugucucaaauguacucgccagucuucgaauaucuaagcggugaccgccagguggaggaauggcccaaagcaacaugcaccggggacuguccugagagaugcggcuguacguccucaaccugccuccacaaggaguggccacauaguaggaacuggcggugcaaccccacaugguguuggggagucggcacugggugcaccuguugcggacuggaugugaaagacuuuuucacagauuacaugcuuguuaaguggaagguggaauauauuaaaacugaggcuauaguaugugucgaauugaccucucaggagcgacaaugcagccugaucgaggccgguacacgcuuuaaucucggcccggugaccauuacucuguccgaaccuagaaacguucagcagaggcuucccccagagaucgugacgcugcacccuaagaucgaagagggguucuucgacuugaugcauguccagaaaauucucucagcgagcacaguguguaagcugcaaucuugcacccacggaguacccggcgauuuucagauauaccacguggguaauuuacugcgcggggacaaaguuaacggccauuccauccacaagauugaaccacauuucaauaccaguuggaugagcugggauggaugugaccuagauuauuuuugcaacaugggcgacuggcccucuuguacuuacacaggggucacccagcacaaucgggccgcauucaucaacaugcucaauauugagacugauuauacaaagacguuucauuuccacuccaaaagagugaccgcucacggagacacuccucagcuggaccuuaaggccaggccagcuuacggugccggcgaggugacagucuugguugaaguggcagaucuggagcuccauaccaaaaaccuggaagugucaggguuaaagaucgccagucugacaugcagcggaugcuacgcuuguucguccggcauaucuugcaaaguacguauccacgucaaugagccggacgaauuuacugugcauguucggagcucagaucccgacguggucgcggcagguaguucccuuauggcccgaaagauugaguucggggcugauucuaccuuuaaggccuucagcuccaugccuaaagacucauuguguuuuuauaucguggagaaggauuacugcagcaguuguacggacgaugacacccaaaaaugcguuaacacaaagcucgaucacccacagucuauucugaucgaacacaaaggcacuauaauuggaaagcagaaugacaccuguuccacaaaaacuagcugcuggcuagagucggugaagggcuucuuuuaugggcugaagaacaugcucucaggaaucuucggcaauguauuccuggguauuuuucuuuucuuggcacccuuuguccuguuaaucuucuuuuucuuuuucggguggagacuccuguuuugucuuaaaugcuguaggcgcacccggggacuguugaaguacaaacaucucaaggaugaagaggaagccggcuauaaaaagauaaucgagagacugaacgguaagaaaggcaagucucagcuauucgacggggagaggcuggcugaccgcaaaauugccgaacucuuuaguacgaagauccacauugga

SEQ ID NO: 10561 - RNA, 2916 nt, Artificial Sequence
  derived and/or modified CDS sequence (opt3) from CCHFV(8402, Artificial)__AB069674.1__Gn-4aa-Gc
agcgaggaauccggcgacgauugcaucucuagaacccagcugcucaggacagagacugccgaaauucacaacgacaauuacgggggacccggugauaagauaacgaucuguaacggcucaaccguggucgaccaacggcuugggagugagcugggaugcuauacaauuaaucgcguuaagagcuucaaguugugugaaaacuccgcuacuggcaaaucuugcgagaucgauucgaccccugugaagugucgacaggguuuuugcuuaaaaauuacacaggaggggcguggacauguaaagcugucaagaggcagcgaagugguccuagacgcaugugauaguuccugcgagaucaugauaccaaagggcaccggggacauccucguggauuguucuggaggucagcaacacuuccugaaagacaaucuuauugaucugggcugcccgaacauccccuugcucgggaagauggccauuuacaucuguaggaugagcaaucauccuaaaacuacaauggcguuucuguucugguuuuccuucggauauguugugaccugcauacugugcaaggucaucuuuuaccucuuaauugugguaggcacgcuggguaaaaaguucaagcaguaucgggaacuuaaaccacagacuuguaccauuugcgagacaacucccguuaacgcuaucgacgccgagaugcacgauuugaauuguucauacaacaucugcccuuauugugcaagucgccugaccagcgacgggcuagccagacaugugaugcagugcccaaagaggaaagaaaagauugaggaaacagagcucuaccugaaucuugaacggauacccugggucgugcgcaaacuguugcaagugucugaguccaccggagucgcucucaagcgaucaagcuggcugguuguguuacugguacuccuuacggugagucugucuccuguccaguccgcaccaaucggcagaaaaccguuguuuagcgacucgauugugaagggcaugaagaaccuacucaauucuacuucccuggagacaucacugaguaucgaagcccccuggggagcuauaaacguucagagcaccuucaaaccuacuguguccgccgcgaauauugcacuuucuuggagcucagucgagcacagggggaacaagauccuggugaguggucgguccgaaagcaucaugaaauuggaggaacguacaggcauuucuugggaucucgggguagaggacgccucagagaguaagcuguuaaccguuagcgugauggaucugucccagauguacucuccagucuuugaauaucuaucgggagaccgccaaguggaggaauggcccaaagcuacguguaccggcgauugcccugagagaugugguugcacaagcuccacuugucuccacaaggaauggccacauucaaggaacuggcggugcaaucccaccuggugcuggggcgucgggacaggauguacuugcuguggccuggacgugaaggaucuuuucaccgacuacauguuuaucaaauggaagguugaguauauuaaaacagaggccauagugugcguagaauugaccagucaggagcgacaguguacucugaucgaagcagggacgcgcuucaaccucggaccggucacaauuacccugucugagccuagaaauauccaacagaaacuucccccagagaucgugacucugcacccuaggauugaagaggguuucuuugauuugaugcauguucagaaagugcucagcgcuuccaccgucugcaagcugcagucauguacacacggcgugcccggggacuuacaaguauaccacauaggaaaccugcuaaagggcgauaaagugaauggucaucucauccacaagauugaaccacauuucaacaccagcuggaugucuugggacgggugcgaccuggauuauuacuguaauaugggcgacuggcccuccugcacuuauacaggaguuacgcagcacaaccaugccgcguuugucaauaugcuuaacaucgagaccgauuacacuaaaaauuuccacuuucacaguaagcgggugacagcccauggcgacaccccucaguuggaucugaaagcacgcccaacauacggggcuggagaaauuacugugcucgucgagguugccgacauggagcugcacaccaagaagaucgaaauaagcgguuuaaaauucgcuucucugacguguaccggcugcuaugccugcuccucagggaucaguuguaaggugaggauucauguggaugagccggacgaacuuacaguacacgucaaaagcgaggaucccgacaucguggcagccucguccucuuugauggcuagaaagcucgaauuuggaacugauagcaccuucaaagcguuuucagcaaugccuaagacaagucugugcuucuacauuguugagcgugaguauuguaaauccugcucuaaggaagacacucagaagugugugaacaccaaacuagagcaaccacagagcauccugauagaacacaagggcacgauuaucgguaaacaguccaauacaugcaccgccaaggcuucauguuggcucgagagcgucaaaaguuucuuuuacgggcugaagaacaugcuuucuggcauuuuuggaaauguguucaucggcguuuucuuguuuuucgcccccuuuauacuguuaauccucuucuuuauguucggguggcggauucuguuuugcuucaaguguugccgaagaacuaggggacuuuuuaaauaucgccaucugaaggaugacgaagagacaggcuaccggaaaaucauugagagauugaacaacaagaaagguaagaauaagcuccuggacggggaaaggcuagcagaucgcaaaaucgccgagcuguucuccaccaagacucacauagga

SEQ ID NO: 10562 - RNA, 2916 nt, Artificial Sequence
  derived and/or modified CDS sequence (opt3) from CCHFV(88166, Artificial)__AB069675.1__Gn-4aa-Gc
agcgaggaauccggcgacgauugcaucucuagaacccagcugcucaggacagagacugccgaaauucacucagacaacuacgggggacccggugauaagauaacgaucuguaauggcaguaccguggucgaccaacggcuugggagcgagcugggaugcuauacaauuaaccgcguuaaauccuucaaguugugugaaaauucugcuacuggcaaaucgugcgagaucgauucaaccccugugaagugucgacaggguuuuugcuuaaaaauuacacaggaggggcguggacauguaaagcugagcagaggcagugaagugguccuagacgcaugugauuccucuugcgagaucaugauaccaaagggcaccggggacauccucguggauuguagcggaggucagcaacacuuccugaaagacaaccuuauugaucugggcugcccgaauauccccuugcucgggaagauggccauuuacaucuguaggauguccaaccauccuaaaacuacaaugggauuucuguucugguuuucauucggcuauguugugaccugcauacugugcaaggucaucuuuuaccucuuaauugugguagguacgcuggggaaaaaguucaagcaguaucgggaacuuaaaccacagacuuguaccauuugcgagacaacucccguuaaugcgaucgacgcugagaugcacgauuugaacuguaguuacaauaucugcccuuauugugccagccgccugaccucugacggacuagcaagacaugugaugcagugcccaaagaggaaagaaaagauugaggaaacagagcucuaccugaaccuugaacggauacccugggucgugcgcaaacuguugcaaguguccgagucaaccggcgucgcccucaagcgaagcaguuggcugguuguguuacugguacuccuuacggugucucuguccccuguccagagcgcuccaaucggcagaaaaccguuguuuucggacucuauugugaaggggaugaagaaucuacugaacuccacuucacucgagacaagucugagcaucgaagcacccuggggagccauaaauguucaguccaccuucaaaccuacuaugucugcugccaacauugcgcuuagcuggucaaguguggagcacagggguaauaagauccuggucuccggccggagcgaaucuaucaugaaauuggaggaacguacagggauuucauggaaccucggaguggaggaugcaagugagagcaagcuguuaaccguauccguuauggaccugucucagauguacucgccaguguuugaauaucuaagcggcgaucgccaagucgaggaauggcccaaagccacguguaccggugacugcccugagagaugugggugcacauccucaacuugucuccacaaggaauggccacauaguaggaacuggcggugcaaucccaccuggugcuggggcgugggaacaggcuguacuugcugugggcuggaugucaaggaccuuuucaccgauuacauguuuaucaaauggaagguggaguauauuaaaacagaggcuauaguuugcguggaauugaccucucaggagcgacaguguacucugaucgaagccggaacgcgcuucaaccucgguccgguaacaauuacccugagcgagccuagaaauauccaacagaaacuucccccagagaucgucacucugcacccuaggauugaagagggcuucuuugacuugaugcaugugcagaaaguucucuccgcaucaaccgugugcaagcugcagagcuguacacacgggguccccggagauuuacaaguguaccacauaggcaaccugcuaaagggugacaaaguaaaugggcaucucauccacaagauugaaccacauuucaacaccucuuggauguccugggauggcugcgaccuggacuauuacuguaauaugggagauuggcccaguugcacuuauacaggcgugacgcagcacaaccaugcugccuuuguuaauaugcuuaacaucgagaccgacuacacuaaaaauuuccacuuucacagcaagcgggucacagcgcauggggauaccccucaguuggaccugaaagcccgcccaacauacggagcuggugaaauuacugugcucguggaggucgcagauauggagcugcacaccaagaagaucgaaauaucuggcuuaaaauucgccucccugacguguaccgggugcuaugcuugcucaaguggaaucagcuguaagguuaggauucauguggacgagccggaugaacuuacagugcacguaaaaucggaggaccccgauuuggucgccgcauccucuagccucauggccagaaagcuggaauuuggcacugacucaaccuucaaggcuuuuagugcgaugccuaagacaucccuaugcuucuacaucguggagcgugaguauuguaaaucuugcagcaaggaagauacucagaaguguguuaacaccaaacuggagcaaccacaguccauucucaucgaacacaaggguacgauaauugggaaacagaauaacacaugcaccgcaaaggccucauguuggcuggagagcgugaaaaguuucuuuuacggccuuaagaauauguugucuggaaucuuuggcaacgucuucauugggguguuccuguuuuucgcucccuuuaucuuacucauacuguucuuuauguucggauggcggauccucuuuugcuucaaguguugccgaagaacuaggggccuguuuaaauaucgccauuugaaggacgaugaagagacagguuaccggaaaauuaucgagagacucaacaauaagaaagggaagaacaagcugcuagacggagaaaggcuggccgaccgcaaaauugcagagcuuuucuccaccaagacucacaucggc

SEQ ID NO: 10563 - RNA, 2916 nt, Artificial Sequence
  derived and/or modified CDS sequence (opt3) from CCHFV(BA88166, Artificial)__AF338470.1__Gn-4aa-Gc
agcgaggaauccggcgacgauugcaucucuagaacccagcugcucaggacagagacugccgaaauucacucagacaacuacgggggacccggugauaagauaacgaucuguaauggcaguaccguggucgaccaacggcuugggagcgagcugggaugcuauacaauuaaccgcguuaaauccuucaaguugugugaaaauucugcuacuggcaaaucgugcgagaucgauucaaccccugugaagugucgacaggguuuuugcuuaaaaauuacacaggaggggcguggacauguaaagcugagcagaggcagugaagugguccuagacgcaugugauuccucuugcgagaucaugauaccaaagggcaccggggacauccucguggauuguagcggaggucagcaacacuuccugaaagacaaccuuauugaucugggcugcccgaauauccccuugcucgggaagauggccauuuacaucuguaggauguccaaccauccuaaaacuacaaugggauuucuguucugguuuucauucggcuauguugugaccugcauacugugcaaggguauuuucuaccucuuaaucgucguggggacgcugggcaaaaaguucaagcaguaucgggaacuuaaaccacagacuuguaccauuugcgagacaacucccguaaaugcgaucgacgcugagaugcacgauuugaacuguaguuacaauaucugcccuuauugugccagccgccugaccucugacggacuagcaagacauguuaugcagugcccaaagaggaaagaaaagauugaggaaacagagcucuaccugaaccuugaacggauacccugggugguccgcaaacuguugcaaguguccgagucaaccggcguggcccucaagcgaagcaguuggcuggucguuuuacuggugcuccuuacgguaucucuguccccugugcagagcgcuccaaucgggagaaaaccguuguaccuagacucgauugucaagggaaugaagaaucugcucaacucuacuucccuggagacaucacuuaguaucgaagcacccuggggugccauaaaugugcagagcaccuuuaaaccuacuauguccgcugccaacauugcgcugucuuggagcucaguugagcacaggggcaauaagaucuuggugagugggcgguccgaaagcaucaugaaacucgaggaacguacaggaauuucuuggaaccugggcgucgaggaugcaucagagaguaaguuacugaccgugagcguaauggaccuaucccagauguauucuccaguuuucgaauaccucucgggugaucgccaaguggaggaauggcccaaagccacguguaccggggacugcccugagagauguggcugcacaagcuccacuugucugcacaaggaauggccacauucaaggaacuggcggugcaaucccaccuggugcuggggagucggcacaggguguacuugcuguggacuugaugugaaggacuuguuuaccgauuauauguucaucaaauggaaggucgaguacauuaaaacagaggcuauagugugcguugaacugaccagucaggagcgacaguguacucucaucgaagccgguacgcgcuuuaaccugggcccggugauuaucacacuuucugagccuagaaauauccaacagaagcugcccccagagauuguaaccuugcacccuaggauagaagagggguucuucgaccucaugcauguccagaaagugcugagcgcauccacuguuugcaaguuacagucauguacccacggagugcccggcgaucugcaagucuaucacaucgguaaccuacucaagggggacaaagugaauggccaucugauucacaagaucgaaccacauuuuaacacaagcuggaugucuugggauggaugcgaccuugacuacuauuguaauaugggcgauuggcccuccugcaccuacacugggguaacacagcacaaccaugcugccuucgugaauauguugaacauugagacggacuacaccaaaaauuuucacuuccacaguaagcggguuacugcgcauggagauacaccucagcuggaccucaaagcccgcccaaccuauggugcaggcgaaaucacaguccugguggagguggcugauauggaguuacacacuaagaagauagaaaucagcgggcugaaauuugccucucuuaccuguacgggaugcuacgcuugcuccucaggcauuaguuguaaggucagaauccauguugacgagccggaugaauugaccgugcacgugaaaagcgaggaccccgauauuguagccgcaucguccucucucauggccaggaagcuggaauuugguacagacagcacuuuuaaggcuuucucagcgaugccuaaaaccagucuaugcuuuuauaucgucgagcgugaguacuguaaauccugcucuaaggaagauacacagaagugugugaacacuaaacuggagcaaccacagagcauacucauugaacacaaggggaccaucauuggcaaacagaauaacacgugcacagcaaaggccuccuguuggcuggagucaguuaagagcuucuuuuauggacuuaaaaauauguugaguggcaucuucgggaacguguuuauaggagucuuccuguucuuugcucccuucaucuuacucauucuguuuuucauguuuggcuggcggauccuuuucugcuuuaaguguugccgaagaaccaggggucuguucaaauaccgccauuugaaggacgaugaagagacuggguaucggaaaauuaucgagagacucaacaauaagaaaggaaagaacaagcugcuagacggcgaaaggcuggccgaccgcaaaauagcagagcucuuuucuacaaagacccacauuggu

SEQ ID NO: 10564 - RNA, 2916 nt, Artificial Sequence
  derived and/or modified CDS sequence (opt3) from CCHFV(BA66019, Artificial)__AF350448.1__Gn-4aa-Gc
agcgaggaauccggcgacgauugcaucucuagaacccagcugcucaggacagagacugccgaagugcacggggacaacuacggaggucccggcgauaagauuacgauauguaaugggucaaccaucgucgaccaacggcuuggaagugagcugggcugcuauacaauuaaccgcguuaagagcuucaaguugugugaaaauuccgguacugggaaaucuugcaagaucgauaaacauccugugaagugucgacagggauuuugcuuaaagauuacccaggagggccguggccacguaaaacugucgagagggucagaggugguccuagacgcuugugauagcaguugcgaaaucaugauaccaaagggaacaggugacauccucguggauuguuccggcgggcagcaacauuuccugaaagacaaccuuguugaucugggaugcccgaauauucccuugcucggcaagauggcaaucuacauuuguaggaugucuaaccacccuaaaaccacuauggccuuucuguucugguuuagcuucgguuaugugaucacaugcauauuuugcaagauuaucuucuaccugcucauugucguggggaccuuaggaaagaaauuuaagcaguaucgggagcugaaaccacagacguguacuaucugcgaaaccacacccacuaaugcgaucgacgcugagaugcaugaucuuaaguguuccuacaacauuugcccuuauugugccucacgcuugaccagugacggccuggcaagacacguaacacagugcccaaaaaggaaggagaaaguugaagagaccgaacuauaccucaaucuggagcggauacccuggaucgugcgcaaacuucugcaagucagcgaaucuacgggcguggccuugaagcgauccucauggcucauugugcuguuaguccugcucacuguuagccuuaguccugugcagucugcuccaaucgggagaaaaccgcuguucuccgacagcauaguaaagggaaugaaaaacuugcuaaauucgacaucucuggagaccucccucucaauugaggcacccuggggugccaucaacgugcagaguacuuuuaagccuacagucagcaccgcuaauaucgcccuguccuggucuagcguggaacacaggggcaacaaaauucuuguuucagggcggagugaguccaucaugaagcuggaggagcguacgggaauuagcugggauuugggcguggaagacgcgucugagucaaagcuccugaccgucagugugauggauuuaagccagauguacuccccaguauucgaguaucugucuggugaccgccaaguugaagaguggcccaaagcaacauguacuggggauugcccugacagauguggcugcaccucgagcacaugucuacauaaggaauggccacacuccaggaauuggcggugcaaccccacuuggugcuggggagugggcaccggguguacaugcuguggacucgaugucaaagaccuguuuaccgauuacauguucgugaaguggaaagucgaguauauaaagacugaagccaucgugugcguugagcuuaacucacaggagcgacaguguaguuugauugaagcugguacgcgcuucaaucugggcccggugacaaucacccucucugagccuagaaacauccaacagaagcugcccccagaaauuauaacucuucauccuaggaucgaggagggguuuuucgaccugaugcacguacagaaagucuugagcgccuccaccgugugcaagcuccagucauguacacacggaguucccggcgaucugcaaauuuaccauaucgguaauuuacugaaaggggaccgggugaacggccaccuaauucauaagaucgaaccacacuuuaauaccagcuggaugucuugggacggaugcgaucucgacuauuacuguaacaugggcgauuggcccuccugcacuuauacaggggucacgcagcauaaucacgcagcuuucgugaaccugcuuaauauagagaccgacuacacuaaaaacuuucacuuccauaguaagcgcguaacagcccacggagauaccccucaguuggaccugaaggcgagaccaacauacggugccggcgaaaucacugugcucguugaggucgcagauauggaacugcauaccaaaaagauugcuaucagcggguuaaaauuugccucucugacguguaccggaugcuaugcuugcuccucaggcauuaguuguaaggugaggauccacguggacgagccggaugagcuuacaguccacguuaaaagcgaagaccccgauauaguggccgcaucguccucuuugauggcccguaagcucgaguucgguacugacagcaccuuuaaggcuuucucagcgaugccuaaaacaagucugugcuuuuacauuguggaacgggaguauugugaauccugcucuaaggaggauacucagaaauguguaaauaccaagcuagagcaaccacagagcauccugauugaacauaaagggacgaucauaggcaagcagaacgacacaugcaccgcaaaagccuccuguuggcucgagucagucaagagcuucuuuuacggacugaagaauaugcuuaguggcaucuucgggaacguguucauuggaaucuuuuuguuccuggcucccuuuauuuuacucauccuguucuuuauguucggcuggcgaauacuguuuugcuucaaauguugcagaaggacucgcggucuuuuuaaguaucgguacuugaaagacgaugaagagucuggguauagaaggauuaucgaacgccucaauaacaagaaaggaaagaacaagcugcuagacggcgagcgacuggccgaucggcguaucgcagaacucuucuccacaaaaacccacauuggu

SEQ ID NO: 10565 - RNA, 2916 nt, Artificial Sequence
  derived and/or modified CDS sequence (opt3) from CCHFV(BA8402, Artificial)__AF350449.1__Gn-4aa-Gc
agcgaggaauccggcgacgauugcaucucuagaacccagcugcucaggacagagacugccgaaauucacaacgacaauuacgggggacccggugauaagauaacgaucuguaacggcucaaccguggucgaccaacggcuugggagugagcugggaugcuauacaauuaaucgcguuaacagcuucaauuugugugaaaacacugcuaccggcaaauccugcgagaucgauucuacaccugugaagugucgacaggguuuuugcuuaaaaauuacccaggaggggcguggacauguaaagcugucgagaggcucagaagugguccuagacgcaugugagagcaguugcgaaaucaugauaccaaaaggcacuggggauauccucguggacuguuccggaggucagcaacacuuccugaaggauaaucuuauugaccugggcugcccgaacauccccuugcucgggaagauggccauuuacaucuguaggaugucuaaucauccuaaaacaaccauggcguuucuguucugguuuagcuucggauauguugugacgugcauacugugcaaggucaucuuuuaccucuuaauugugguaggcacucuggguaaaaaguucaaacaguaucgggagcuuaagccacagaccuguacaauuugcgagacuacccccguuaacgcuaucgaugccgaaaugcacgacuugaauuguuccuacaacaucugcccuuauugugcaucacgcccaacaagugaugggcuggccagacaugugaugcagugccccaagaggaaagagaagauugaagagaccgcucuauaccucaaucuggaacggauaccuugggucgugcgcaaacuucugcaagugagcgagucuacgggagucgcauugaagcgauccucauggcucguugugcuguuaguacugcucacugugagccuuaguccaguccagucugccccgaucggcagaaaaccccuguuuuccgacagcauugugaagggcaugaaaaacuugcuaaauucgacaucucuggagaccucccucucaaucgaagcuccuuggggagccauaaacguucagaguacuuucaagccaacagugagcgcggcaaacauugcccuguccuggucuagcgucgagcacagggggaauaagauccuugugucaggucggagugaauccaucaugaaacuggaggaacguaccggcauuagcugggacuuggggguagaggaugcuucugagucaaagcuccugacgguuagugugauggacuuaagccagauguacucccccgucuuugaauaucugucuggagaucgccaaguggaggaauggccuaaagccaccuguacaggcgacugcccagagagaugugguugcacuucgagcaccugucuacacaaggaauggccccauuccaggaacuggcggugcaauccgacauggugcuggggcgucgggacuggauguaccugcuguggccucgaugugaaagaccuguucacagauuacauguuuaucaaguggaagguugaguauauuaaaaccgaggcaauagugugcguagaacuuacuucacaggagcgacaguguacguugaucgaagcugggacacgcuucaaccugggaccugucaccauuacucucagugagcccagaaauauccaacagaagcugccaccugagaucgugacccuucaccccaggauugaagaggguuucuuugaccugaugcauguucagaaaguguugucugccagcacagucugcaagcuccaguccuguacccacggcgugccaggggaucugcaaguauaccacauaggaaacuuacugaaaggcgacaaggugaauggucaucuaauccacaagauugaaccccauuucaacacuucauggaugagcugggaugggugcgaccuccacuauuacuguaauaugggcgacuggccuucuugcacauauacgggaguuacccagcauaaccacgcggccuuugucaauaugcugaacaucgagacugauuacaccaaaaauuuccacuuucauuccaagcgggugacagcacacggcgacacaccacagcuugauuugaaagcucgcccgacuuacggggccggagaaauuaccgugcuggucgagguugcugacauggagcuccauacgaagaaaaucgaaauaaguggucugaaguucgccagcuuaaccuguacaggcugcuaugcauguucuuccgggaucucaugcaaggugaggauucacguggaugagcccgacgaacugacuguacacgucaaaagugaggauccugacaucguggccgcuagcucgucccuuauggcgagaaaguuggaauuuggaaccgauucuacauucaaagcauuuagcgccaugccaaagacuucacucugcuucuacauuguugagcgugaguauugugaaaguugcuccaaagaggacacccagaagugugugaacacgaaacuggaacaaccccagucuauccuaauagagcauaagggcacaauuaucgguaagcagagcaauaccugcacugcuaaagccuccuguuggcuggaaucagucaagagcuuuuucuacgggcucaaaaacaugcugaguggcauuuuuggaaacguguucaucggcguuuucuuguuuuucgcaccuuuuauacuucugaucuuauucuuuauguucggguggcggauucucuuuugcuucaaguguugccgaagaacaaggggacuguuuaaauaucgccaccuuaaggaugacgaggagaccggcuaccggaagaucauugaaagacugaauaacaaaaaggguaaaaauaaguugcucgauggggagaggcuggccgaccgcaaaaucgcugaacuauucucuacuaagacccauauagga

SEQ ID NO: 10566 - RNA, 2916 nt, Artificial Sequence
  derived and/or modified CDS sequence (opt3) from CCHFV(Matin, Artificial)__AF467769.2__Gn-4aa-Gc
agcgaggaauccggcgacgauugcaucucuagaacccagcugcucaggacagagacugccgaaauucacucagacaguuacgggggacccggugauaagauaacgaucuguaacggcagcaccguggucgaccaacggcuuggguccgagcugggaugcuauacaauuaaucgcguuaaaucuuucaaguugugugaaaacucggcuacuggcaaaucaugcgagaucgauagcaccccugugaagugucgacaggguuuuugcuuaaaaauuacacaggaggggcguggacauguaaagcugaguagaggcuccgaagugguccuagacgcaugugauucuagcugcgagaucaugauaccaaagggcaccggggacauccucguggauuguuccggaggucagcaacacuuccugaaagacaaucuuauugaucugggcugcccgaacauccccuugcucgggaagauggccauuuacaucuguaggaugucaaaucauccuaaaacuacaaugguuuuucuguucugguuuaguuucggauaugugauaaccugcauucugugcaaggucaucuuuuaccucuuaauugugguaggcacgcuggguaaaaaguucaagcaguaucgggaacuuaaaccacagacuuguaccaucugcgagacaacucccguuaacgcgaucgacgcugagaugcacgauuugaauuguagcuacaacauuugcccuuauugugccucucgccugaccuccgacgggcuagcaagacaugugaugcagugcccaaagaggaaagaaaagauagaggaaacagagcucuaccugaaucuugaacggauccccugggucgugcgcaaacuguugcaagugucagagagcaccggagucgcccucaagcgaaguucuuggcugguuguguuacugguacuccuuacggugucccugagcccuguccagucggcuccaauuggcagaaaaccguuguuucuagacucuaucauaaagggcaugaagaaccugcucaauuccacuucacuggagacaagucuuagcauugaagcacccuggggagccaucaacgugcaguccaccuucaaaccuacuaugucugcugccaauaucgcgcugagcuggucaaguguugagcacagggggaacaagauuuugguguccggucggagcgaaucuaucaugaaacucgaggaacguacaggcauuucaugggaucugggggucgaggacgcaagugagagcaaguuacugaccguguccguaauggaucuaucucagauguacucgccaguuuuugaauaucucagcggagaccgccaaguggaggaauggcccaaagccacguguaccggcgauugcccugagagaugugguugcacauccucaacuugucugcacaaggaauggccacauaguaggaauuggcggugcaaccccaccuggugcuggggcgucgggacaggauguacuugcuguggccuugacgugaaggauuuguucaccgacuacauguuugucaaauggaagguggaguauauaaaaacagagguuaucgugugcguagaacugaccucucaggagcgacaguguagccucauugaagcugggacucgcuucaaccugggaccggucacgaucacacuuuccgagccuagaaauauccaacagaagcugcccccagagauugugaccuugcacccuaggauagaagaggguuucuuugaucucaugcauguucagaaagugcugucagccagcacugucugcaaguuacagucuuguacccacggcgugcccggggaccugcaaguauaccacaucggaaaccuacucaagggcgauaaagugaauggucaucugauucacaagaucgaaccacauuucaacacauccuggaugaguugggacgggugcgaccuugauuauuacuguaauaugggcgacuggcccagcugcucuuauaccggaguuacucagcacaaccaugcagcuuuugucaauauguuguccauugagacagauuacacgaaaaacuuccacuuucacucaaagcgggugaccgcccauggcgacacuccucagcuggaucucaaagcgcgcccaacauacggggccggagaaaucaccgugcuggucgagguugcagacauggaguuacacacaaagaagauagaaaucaguggucugaaauucgcuagccuuacuuguaccggcugcuaugccugcucguccgggauuucuuguaaggugagaauccauguggaugagccggacgaauugacgguacacgucaaaagcgaggaucccgacauuguggcugccucaaguucccucauggcaaggaagcuggaauuuggaaccgauucuacauucaaagccuuuagcgcuaugccuaagacuucccuaugcuucuacaucguugagcgugaguauuguaaaucaugcagcaaggaagacacccagaagugugugaauacaaaacuggagcaaccacagaguauacucauugaacacaagggcacuaucauugguaaacagaacgauaccugcacggcgaaggcaucuuguuggcuggaguccgucaagagcuuuuucuacgggcuuaaaaauauguugucgggcaucuuuggaaacguguucauaggcaucuuccuguuuuuagcccccuucgcucuccugauucuguuuuucauguuuggguggcggauccuuuucugcuuuaaguguugccgaagaacaaggggauuguucaaauaucgccaucucaaggacgacgaagagaccggcuaccggaaaauuaucgagagacugaauaacaagaaagguaagaauaagcuacuggauggggaaaggcucgccgaccgcaaaauagcagagcuguuuucaacuaagacacacguugga

SEQ ID NO: 10567 - RNA, 2916 nt, Artificial Sequence
  derived and/or modified CDS sequence (opt3) from CCHFV(Baghdad 12, Artificial)__AJ538197.2__Gn-4aa-Gc
agcgaggaguccggcgacgauugcaucucuagaaccaggcugcuccggacagagacugccgaaauucacggggacucauacggaggucccggcgauaagauaacgaucuguaacgggaguaccauuguggaccagcgccuuggaagcgagaugggcugcuauacaaucaaucgagucaaauccuucaagcugugugaaaacucugcuacugguaaaucgugcaagauugauucaaucccuguuaaaugucgucaaggguacugcuugaagauaacccaggagggaagaggccaugugaaguuaagcaggggcagugagguagugcuggacgcaugugauuccucuugcgaagucaugaucccaaaagggacaggagacauucuaguggauuguagcgguggccagcagcacuuucucaaggacaaucugaucgaucuugggugcccgaacauuccccuguugggaaaaauggccaucuauauaugucggauguccaaucauccuaagaccacuauggcguuccucuuuugguucucauuuggcuacguuauuacaugcauccugugcaaagcuauuuucuaucugcucaucaucguggguaccuuagggaagcgcuuuaagcaauacagagagcugaaaccacagacguguacuauuugcgaaaccacacccgucaacgccauagacgcagagaugcacgaucuuaauuguaguuauaacaucugcccuuacugugccagcagguugacuucugacggacuggcucggcaugugacccagugcccaaagcgcaaagagaagguagaagagacagaacuauaccucaaucuggagcgaauccccuggguugugagaaaacuucugcaggucuccgaaucaaccggcguggcauugaagaggagcaguuggcucauugugcuguuaguccugcucgccguuucuuccagcccugugcaaucggcuccaauaggccggaaaccgcuuuuccuggacucuauuguaaaggggacgaagaacuugcuaaauuccacuucacuggagacaagucucagcaucgaggcccccuggggagcgaucaacgugcaguccaccuauaaaccuacugucucuacagcaaauauugcccugagcuggucaaguguggaacaccgugguaacaagauccuuguuuccggccgcagcgagucuauuaugaaacuggaagagagaaccgggauaucaugggauuugggaguggaagacgcuagugagagcaagcuccugacggucuccgugauggauuuaucucagauguacucgccaguauuugaguaucugagcggcgacaggcagguugaagaguggcccaaagccaccuguacaggugauugcccugaacggugugggugcacuaccuccacaugucuacacaaggaguggccacauucacgaaauuggcgcugcaaccccacuuggugcuggggcgugggaaccggcuguacaugcugugggcucgacgucaaggaucuguucaccgacuacauguuugugaaauggaaggucgaauauaucaaaacugaugcaauugugugcguugagcuuacgagucaagagagacaguguucuuugaucgaagcuggaacaagguucaaccuggguagcgugaccaucacucucuccgagccgcggaauauucagcaaaagcugccucccgaaauaaucacccuucacccacgcauugaggagggcuuuuucgaccugaugcauguacagaaagucuugucagccagcacagugugcaagcuccagucuuguacccacgggguuccuggagaucuucagguguaccacaucggcaacuuacugaagggugacaaagucaaugggcaucuaauucacaagaucgaaccccauuucaacacuuccuggaugaguugggacggcugcgaucucgacuauuacuguaauaugggagauuggccaagcugcacauacacgggcgugacccaacacaaccaugcgucuuuuguaaaucugcuuaacauagagacugacuauacaaaauccuuccacuuucacucaaagagagugaccgcccauggggauacaccccaguuggaccugaaaguuaggccuacuuacggagcuggugaaaucaccguccucguggagguggcugauauggaacugcacacgaagaagauugagaucaguggcuuaaaauucgccagccugaccuguacagggugcuaugcuugcucguccggaauuucuuguaagguccguauccauguugacgagccagaugaacuuacugugcacgugaaaagcgacgauccggacguagucgccgcaucaaguuccuugauggcccggaagcucgaguuuggcaccgauucuacauucaaagcauuuagcgcgaugcccaagacuucccugugcuucuacauaguggaacgagaguauuguaaaucaugcagcaaggaagacacccagaaguguguuaauacgaaacuagagcagccucaaaguauucugaucgagcacaaggguacaauuaucgggaaacagaacaauaccugcacugcaaagacaucuuguuggcucgaauccgugaaaucguuuuucuacggccugaagaacaugcuuagcggaauauuuggcaauuucuuuauggggaucuucuuguuccuggccccauuuauuuuacucauccuguucuuuauguucggauggaggauucuguuuugcuucaaguguugcagacgcacccggggccuguuuaaauauagacauuugaaggacgaugaggaaacugguuacaggcgcaucauagagcgacucaacaauaaaaaggggaaaaacaagcugcuagacggagaacggcuggcugaucguagaauugccgaacucuucucaaccaagacacacaucggc

SEQ ID NO: 10568 - RNA, 2916 nt, Artificial Sequence
  derived and/or modified CDS sequence (opt3) from CCHFV(VLG/TI29414, Artificial)__AY179961.1__Gn-4aa-Gc
agcgaggaacccggcgacgauugcaucuccagaacccagcugcucagggccgagccugcugaaauucacgacgauaacuacgggggaccaggugacaagauaacaaucuguaauggcucuacuauuguggaucaacggcuugggucagagcugggaugcuauacgaucaaccgcgucaaaaguuucaaguugugugaaaauagcgcaaccggcaaaacaugcgagauugacuccacuccgguuaagugucgacaggguuuuugcuuaaaaaucacccaggaggggcguggacaugugaagcugucuagaggcucggaaguagugcuagaugccugugacucaagcugcgaggucaugauacccaagggcacaggggauauccucguggacuguaguggaggucagcaacacuuccugaaagauaaccuuauugaccugggcugcccucauaucccauugcucgggaagauggcgauuuacaucuguaggauguccaaucacccccggaccacuauggcuuuucuguucugguuuucuuucggauauguuauaacaugcaucuuuugcaaagcccuguucuacagccucauuauuaucggcaccuuagguaagaaaaucaagcaguaucgcgaacugaagccucagacguguacuauuugcgagaccgcaccagugaacgccauagaugcugagaugcaugaccuuaauuguuccuacaacaucugccccuauugugcaucaagauugacaagugacgggcuggccaggcacgucccucagugcccaaaacggaaggaaaaaguggaggaaacugagcuauaccucaaucuggaacgcauuccguggaacguacgaaaacuucugcaaguuagcgagucuaccggaguggcuuugaagagauccucauggcucaucguccuguuagugcugcucacagugagccuuagucccguccagucugccccuguuggcaggaagccacuguuuuuggauuccauagugaaaggcaugaagaaucuacugaacagcaccaaucucgagacgucgcugucuauugaagcgcccuggggagcaaucaacguacaguccacuuucaagccuacagugucaaccgccaauaucgcucuuaguuggagcuccgucgagcaccgggggaacaaaauucuggugacuggucguucugaaagcaucaugaaguuggaggaacgcacaggcguuucaugggaccucgggguggaggaugccagugaguccaaacuguuaaccgucagcauuauggaccugucucagauguacucaccaguguuugaauaucuaaguggagauagacaaguagaggaauggcccaaggcaacguguaccggcgacugcccggagaggugugguugcacaagcuccacuugucuccauaaagaauggccucacucucggaacuggcgaugcaaucccaccuggugcugggagguugggacaggcuguacuugcuguggauggaacgugaaggaucuguucaccgaccauauguuugucaaguggaaaguggaguacauaaagacagaagcuaucgucugcguggagcuuaccucgcaggaacgccaguguagcuugauugaggccggcacuagauucaaucuggggccaguuacgaucacacucuccgagccuaggaacauccaacagaaacugcccccagaaauuauaacccuucaccccaagguggaggaaggauucuuugaucugaugcacguacagaaagucuugucagcgaguacugugugcaagcuccagucuuguacccaugguaucccuggcgaccugcaaguuuaucacauugggaauuuacugaagggagaucgggugaacggccaucuaauccacaaaauugagccacauuucaauacaagcuggauguccugggacgguugcgaccucgauuacuauuguaacaugggggacuggccgucaugcaccuacacuggcaugacacagcacaaucacgccgcauuugucaaccugcuuaauaucgaaacggauuauaccaagacuuuccauuuucacagcaaacgcgugacagcucauggagacacaccccaguuggaucugaaggccagaccuaccuacggcgcuggggagauaacuguacucguggagguugccgacauggaacugcacaccaaaaaggucgagaucucuggauuaaaguucgcaucccuggccuguacggguugcuacgcuugcaguagcggcauuucuuguaaagugaggauccacguggaugaaccagacgagcuuaccguccauguuaaguccaacgaucccgacgugauugcggcaucaacaaguuugauggcccguaaacucgaauuugggacugauagcaccuucaaggcuuuuucggccaugccuaaaacaucccugugcuucuauaucgcagagcgggaguacuguaagucuugcagcgaagaggacacucagaaauguguggauaccaagcuagaacaaccacagucaauacugauugagcacaagggaacgaucauuggcaaacagaaugacacaugcaccgccaaggcuaguuguuggcucgaauccguaaaaucuuucuuuuauggucugaagaacaugcuugggagcgucuuuggcaauuucuucaucggaauauugcuguuuuuagcccccuucgugcuccugguucuguuuuucauguuuggcuggaaaauccuuuucugcuuuaaguguugccgaagaacuaggggguugcucaaguaccgccugcuaaaagacgaugaggagacaggauaucggagaauuaucgaaaggcugaacaacaagaaaggcaagaaucgccuccuggacggugagcgacuugcagaucggaaaauugcggaauuguucuccaccaagacucauaucggg

SEQ ID NO: 10569 - RNA, 2916 nt, Artificial Sequence
  derived and/or modified CDS sequence (opt3) from CCHFV(TADJ/HU8966, Artificial)__AY179962.1__Gn-4aa-Gc
agcgaggaauccggcgacgauugcaucucuagaacccagcugcucaggacagagacugccgaaauucacggggacgauuacggaggucccggcgacaagauaacgaucuguaacgggucaaccauuguggaucaacggcuuggaagugagcugggcugcuauacaaucaaucgcgucaagagcuucaaguugugugaaaacuccgcuacugguaaaaauugcgagauugacucuguuccugugaagugucgacagggguacugcuuaaaaaucacccaggagggacguggccauguaaagcugucgagaggcucagaagugguccuagaugcaugugacagcaguugcgaggugaugauaccaaaggggacaggagauaucuccguugacuguucugguggccagcaacacuuucucaaagauaaccugauugaccuugggugcccgaagaucccccuguugggaaaaauggccauuuauaucuguaggaugagcaaucauccuaagaccacuauggcguuccucuuuugguucuccuuuggcuacgugauaacacggauucugugcaaagcuaucuucuaucugcucauuaucgucgguaccuuagggaagcgcuuuaagcaguacagagaacugaaaccacagacgugcacuaucugugagaccacacccgccaacgcaauugaugccgagaugcacgaccuuaauugcucauauaacauauguccuuacugcgcuaguagguugacuagcgacggacuggcacggcaugugacccaguguccaaagcgcaaagaacgaguagaggaaacagagcuauaccucaaucuggaaagaauccccuggauuguuaggaaguugcugcaagugucugaguccaccggcgucgccuugaaacggucaagcuggcucaucgugcuguuagugcuguucacggucagucucucuccuguucaguccgcuccaauaggccgucgcccgcuuuuucuggauagcauugugaaggggaugaaaaacccccuuaauucgacuucucuagagacaucccugucaaucgaagccccuuggggagcgaucaacguacagaguaccuauaagccaacugugagcacagcaaauauugcccucuccuggucuagcaucgagcacagagguaacaauauucuggucucaggcaggagugaauccauaaugaaacuugaggaacggaccgggaucagcggagaccugggcguggaggaugcuucugagucaaaauugcucacgguuagugugauggaccugagccagauguacucccccgucuucgaauauuuaucuggugaucgacaaguggaggaauggccuaaggcaaccugcacaggggacuguccagagcgcugcggcuguacuucgucaaccugccugcacaaagaauggccccauuccagaaacuggagguguaacccgacauggugcuggggaguaggcacugggugcaccuguugcggacuagauguuaaggaccucuuuauugauuacauguucgugaaauggaaggucgacuauaucaagacagaggccaucgugugugucgagcugaccucacaggaacggcagugcagucuuguggaggcugguacucgcuuuaauuugggcccuguuacgauuacacugucugaacccagaaacauacaacagaaacucccaccugagaucauuacccugcaccccaggaucgaggaaggguucuucgaucuuaugcaugugcagaagguacugagcgccuccacugucuguaaauugcagucaugcacccacggagugccaggcgaccuccaaguuuaccacauugguaaucuguuaaagggggacaaagagaacggccaucugauccacaagauagaaccccauuuuaauacaagcuggaugucuugggauggaugugaccuagauuauuacugcaacaugggcgacuggccuuccuguaccuacacuggggugacacagcacaaucaugcgaguuucgucaaccuccugaauaucgagacggauuauaccaagagcuuucacuuccacucuaaacgugugacugcccauggagacacaccacagcuugauuugaaggcacggccgaccuacggugcuggcgaaauuacaguacugguggagguugccgacauggagcuccacacuaaaaagaucgaaauuaccgggcugaaauuugcuuccuuaacgugcaccggauguuaugccugcucaaguggcaucagcugcaagguccgaauacauguggaugagcccgacgaacugacagugcacgucaagucggaugacccugauguuguggcagccuccucuagccuuauggcuagaaaauuggaguucgguacugacucaaccuuuaaggcguucagugcaaugccaaaaacaucccucuguuuuuacauuguggaaagggaguaucgcaagucuugcagcaaagaggacacucagaaguguguaaacaccaaacuggaacaaccccaguccauccuaauugagcacaaggggacgaucauaggcaagcagaauaacacaugcaccgccaaagcuagcuguuggcuggaaagcgucaagaguuucuuuuacggacucaaaaauaugcugucuggcaucuucgggaacguguuuguuggaauuuuccuuuucuuggccccuuuuauccuguuaauucucuucuuuauguucggcuggcggauccuguccugcuuuaaguguugcagaaggacucgcggucuucugaaacaucgacacuugaaggaugacgaggaaacaggguaucggcguauaauugagagacucaauaacaagaaaggaaagaacaaacugcuagauggcgagaggcuggcagaccgccggaucgccgaacucuucagcaccaagacucauaucggu

SEQ ID NO: 10570 - RNA, 2916 nt, Artificial Sequence
  derived and/or modified CDS sequence (opt3) from CCHFV(Hodzha, Artificial)__AY223476.1__Gn-4aa-Gc
agcgaggaauccggcgacgauugcaucucuagaacccagcugcucaggacagagacugccgaaauucacggggacgauuacggaggucccggcgacaagauaacgaucuguaacgggucaaccauuguggaucaacggcuuggaagugagcugggcugcuauacaaucaaucgcgucaagagcuucaaauuguguaaaaacuccgcuacugguaagucuugcgaaauugacucgaccccuguuaaaugucgacagggguacugcuuaaagaucacacaggagggacguggccaugugaagcugucaagaggcagcgagguagugcuagaugcaugugacaguuccugcgaagucaugauaccaaaagggaccggagauauccucguggacuguucugguggccagcaacacuuucugaaggauaaucuuauugaccuggggugcccgaggauccccuugcucggaaaaauggccauuuauaucugucggaugagcaaccauccuaagacuacaauggcguuccuguuuugguucuccuuuggcuacguuauaaccugcauucugugcaaagcuaucuucuaucucuuaauuaucguggguacgcuggggaagcgcuuuaagcaguacagagagcuuaaaccacagacuuguaccaucugcgaaacaacucccgccaaugcaauugaugccgagaugcacgacuugaacuguucauauaauauaugcccuuacugugcuaguaggcugaccagcgacggacuagcacggcaugucacacagugcccaaagcgcaaagagaagguggaagagaccgaacucuaccugaaccuugagcgaauccccuggauuguaagaaaacuguugcaaguuucugaauccacgggcguggcccucaagaggucaagcuggcugaucgucuuacugguccucuucgcugugagucuuucuccugugcaguccgccccaauaggccggcguccgcuguuuuuggauagcauuguuaaagggacuaagaaucuacugaacucgacaucucucgagaccucccugucaaucgaggcgcccuggggagcaaucaaugugcagaguacuuauaagccuacaguaagcaccgccaacauugcucuuuccuggucuagcguggaacaccgcgguaauaaaauccuggucucaggcagaagugaguccauuaugaaguuggaagagaggacggggauaagcugggaccucggaguggaagaugccucugagucaaaacuguuaaccguuagugugauggaccugagccagauguacuccccagucuucgaguaucuaucuggcgaucggcaaguggaagaguggcccaaggcaacauguacuggugacugcccugaacgaugugggugcaccucgagcacaugucuccacaaagaguggccacauucccgcaacuggagaugcaaucccacuuggugcuggggcguaggaaccggcuguacaugcugugggcuggauguuaaggaccuuuuuaccgauuacauguucgugaaguggaaagucgacuauaucaagacugaagcuauugugugcgucgaguugacgucacaggagaggcaguguagucugguggaagccggaacacgguuuaaccucgguccgguuaccaucacucugucugagccucgcaacauccaacagaaacuucccccagaaauuauaacccugcacccuagaaucgaggagggcuucuucgauuugaugcaugugcagaagguacucagcgcguccacagucugcaaacugcagucauguacccacggggugcccggagacuuacaaguuuaccacauuggcaaucugcuaaagggugacaaggugaacgggcaucucauccacaaaauugaaccacauuuuaauacuagcuggaugucuugggauggcugcgaccuggauuauuacuguaacaugggagacuggcccuccugcacauacacgggcgucacccagcacaaucaugccaguuucgugaaccuuuugaauaucgagacugauuauacaaagagcuuucacuuccacucuaaaaggguaaccgcacauggggacacaccucagcuggaucucaaggcucguccaacuuacggagccggugaaauaaccgugcugguugaggucgcugacauggaauuacacacgaaaaagaucgagauuaccggccugaaguuugccucccuuacauguacugggugcuaugcaugcucaaguggaaucagcuguaaagugcggauucauguggaugagccggacgaauugaccguccacguuaagucggaugaccccgaugugguggccgcuuccucuagccucauggcgcgaaaacuggaguucggcacagacucaacuuuuaaggcauucagugccaugccuaaaaccucccuaugcuuuuacaucguagaaagagaguauuguaagucuugcagcaaagaagacacgcagaagugugucaacacaaagcuggagcaaccacaguccauacucauugagaggaaagguaccaucauugggaagcagaauaacacuugcacagcuaaagccucauguuggcuggaaagcgugaagaguuucuuuuacggccuuaaaaauauguugucuggaaucuucggcaacguuuuuguggggauauuccuguucuuagcacccuuuauccuccugauucuuuucuuuauguucggauggcgcauccuguuuugcuucaaguguugccggagaaccaggggcuuguuuaaguauaaacaccucaaggaugacgaggaaacugguuaccgccgaauuaucgagcggcugaauaacaaaaaggggaaaaauaagcuacuggauggagaacgucucgccgacagaaggauagcugagcuguucuccaccaagacacauauuggc

SEQ ID NO: 10571 - RNA, 2916 nt, Artificial Sequence
  derived and/or modified CDS sequence (opt3) from CCHFV(Kosovo/9553/2001, Artificial)__AY675511.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucgcgaggauguccaaucacccaaaaacaaccauggcuuuucuguucugguuuucucugggauauguuauaacguguauucucugcaaggccuuauucuacagccugaucauuaucggcacucuugguaaaaagaucaagcaguaucgggaauugaaaccccagaccugcacaauuugugagacugcaccugugaacgccauagaugcugagaugcaugaccugaauugcuccuacaacaucuguccauauugcgcaucacgccuaaccagugacgggcucgccagacacgucaagcagugucccaaaaggaaggaaaaaguggaggaaacagagcuguaccuuaaucuggaacggauuccuuggguaguucgcaaguugcuccaagugagcgagucuaccggagucgcucugaaacgauccucaugguuaaucgugcugcucgugcuucugacggucagcuugaguccaguucagucugccccggugggcagaaagccccuauuucuggauuccauaguaaagggcaugaaaaaccuccugaauagcacuucgcuugagacaucucuguccauugaagcgccuuggggugcaaucaacgugcagucaaccuucaagccaacugucaguacagccaauaucgcuuugagcugguccucuguggagcacaggggaaacaaaauucucguuaccggucggagcgaaucaaucaugaagcuggaggaacguacgggcgugaguugggacuuaggggucgaggaugccuccgagagcaaacugcuaaccgugucuauuauggaccucucacagauguacagucccguauuugaauaucugagcggagaucgccaaguugaggaauggccuaaggcaacaugcacuggcgacuguccagagagaugcgguuguaccuccucuacaugccuucauaaggaauggccccacucgaggaauuggcgguguaacccgacuuggugcuggggcguggggaccggaugcacauguugcggcgucgaugugaaagacuuguucaccgaucauauguuugucaaguggaaaguggaguacauaaagacugaggcuaucguuuguguggaacugacgagccaggagcgacagugcucccucauugaagccgggacacgcuucaaccugggaccuguaaccaucacucuuucagagcccagaaauauccaacagaaacugccaccugagauuauaaccuugcaccccaagaucgaagagggguuuuucgaccucaugcacguccagaaggugcugagugcgucuacaguuuguaaauuacagagcugcacccauggcauuccaggggaucugcaaguguaucacaucggaaaccuacucaagggcgacagggucaauggucaucugauucacaaaaucgaaccccauuucaacacuuccuggaugucaugggacgggugugaucuugacuacuauugcaauaugggcgauuggccuagcuguacauacacgggagugacccagcacaaccacgccgcauuuguaaauuugcugaacauagagacugacuauacaaagaccuuccauuuucacucuaaacgggugacagcucauggcgauacuccacagcucgaccugaaggcccgcccgaccuacggggcuggagaaaucacgguuuuagucgagguggccgauauggagcugcacaccaagaaaguggaaauuuccggucuuaaguucgcaaguuuggccugcacaggcuguuacgcuugcagcucugggaucuccugcaaagucaggauucacguugacgagcccgaugaacucacugugcaugugaagucaagugacccugauguagucgcggcaagcaccucgcugauggccagaaaacuagaguuuggaacagacuccacuuucaaggcuuuuucugccaugccaaaaaccagccuguguuucuauaucguggaaaaggaguacugcaagucauguagugaggaugacacgaaaaagugcguugacacaaaacucgaacagccccaauccauacugauugagcaccguggcaccaucauugguaagccuaaugauacuuguccagcaaaaacaucuugcuggcuugaaagcgugaaguccuuuuucuauggguugaagaacaugcugggcucagucuuuggaaauuucuuuaucggcauauuacucuuccuggcccccuucuuucuuuggaugcugagcuucauguuuggguggaaaaucuuguucuguuuuaagugcugucggcgaaccagaggacucuucaaauacaggcaucugaaggacgaugaggaaacuggcuaucgccggauuaucgagagacuaaacaauaaaaaggguaagaacaggcugcucgacggggagcgccuggcugaucgaaaaauugccgaacuuuuuaguaccaagacacacaucgga

SEQ ID NO: 10572 - RNA, 2916 nt, Artificial Sequence
  derived and/or modified CDS sequence (opt3) from CCHFV(SPU41/84, Artificial)__AY900142.1__Gn-4aa-Gc
agcgaggaauccucugacgauugcaucucaagaacccagcugcucaggacagagacugccgaaauucacggcgacaacuacgggggacccggugauaagauaacgaucuguaauggcaguaccguggucgaccaacggcuugggagcgagcugggaugcuauacaauuaaccgcguuaaaacuuucaaguugugugaaaauuccgcuaccggcaaaucuugcgagaucgauucggugccuguaaagugucgacaggguuacugcuuaaaaauuacacaggaggggcguggacaugugaagcugucaagaggcagcgaagucgugcuagacgcaugugauaccaguugcgagguuaugaucccaaagggcacuggggacauacucguggauuguuccggaggucagcaacacuuucugaaagacaaccuuaucgaucugggcugcccgaagauucccuugcucgggaaaauggccaucuauauuuguaggaugucuaaucauccuaagacaaccauggcguuccuguuuugguucagcuuuggauacgucaucacgugcauaauuugcaaagugaucuucuaucugcucauuaucguaggcacuuuagguaagcgguuuaagcaguaccgcgaacugaaaccacagaccuguacaaucugcgagacuacccccguuaacgcuauugacgccgagaugcacgaucuuaauuguuccuauaacauaugcccuuacugugcaucaagauugacaagugacgggcuggccaggcaugugacccagugcccaaagcggaaagaaaaggucgaggaaacggagcuauaccucaaucuggaacgcauccccuggguggugcgaaaacuucugcaagucagcgagucuacuggaguugcuuugaagagauccucauggcucgugguacuguuagugcugcucacagucagccuuaguccugugcagucugcaccaauuuccaggcggccgcuguucuuggacagcaucguuaaaggcaugaagaaccuacugaauagcaccucucucgagacuucccugucaauagaagcccccuggggcgcuauuaacgugcagaguacauauaagccuaccgucagcacggccaauaucgcgcuuuccuggucuagcguggagcaccgugggaacaaaauccugguaucaggacgcagugaauccauuaugaaguuggaggaaagaaccgguaucagcugggaucucggcguugaggacgcaucugagucaaaacuguuaacagugagugucauggaucugagccagauguacuccccaguguuugaauaucuaucuggggacaggcaagucgaggaauggcccaaggccacuuguaccggagauugcccugagcgguguggcugcacaucgagcacuugucuccacaaagaauggccacauucccgaaauuggcgcugcaaccccaccuggugcugggguguggggacaggcuguaccugcuguggacuggacguuaaggaucuuuucacugacuacauguuugugaaguggaaaguagaguauauuaagacggaggcuauagucugcguggaauugacaucacaggagagacaguguagucugaucgaagccggcaccagguucaaccucgggccgguuacuauuacccugucugagccucggaauauccaacagaaacuucccccagagaucauuacacugcacccucgcauagaagagggauuuuucgauuugaugcaugugcagaagguccucagcgcauccaccgugugcaaacugcagucauguacucacgguguacccggcgacuuacaaguguaccacaucgggaaccugcuaaagggagauaagguuaauggccaucucguccacaaaauugaaccacauuucaacacaagcuggaugucuugggacgguugcgaccuggauuauuacuguaauaugggggacuggcccuccugcacguacaccggcgugacucagcacaaccaugcuaguuuugugaauaugcuuaacaucgagacagauuauaccaagaauuuccacuuucacagcaaaagagucacagcccauggagacacuccucaguuggaucugaaggcgaggccaaccuacggcgccggggaaauuacgguucucguggagguggcagacauggagcugcacaccaaaaagaucgaaauaucuggauuaaaguucacaucccugacuuguaccgguugcuaugcuugcucaaguggcaucagcuguaaaguacguauucaugucgaugagccggacgaacuuacagugcacguuaagucggaggaucccgacguggucgccgcuuccucuagcuugauggcccggaaacucgaauuugggacugauucaaccuucaaggcauuuagugccaugccuaaaacgucccugugcuucuacaucguggagcgagaguauuguaagucuugcagcgaagaggacacacagaaauguguuaacaccaagcuagaacaaccacaguccauucugaucgagagaaagggaacuauaauuggcaaacagaauaacacaugcaaggcuaaagcggguuguuggcucgaaucagugaagucguuuuucuacgggcugaaaaauaugcuuaguggcaucuuuggaaacguauucauuggcaucuuuuuguuccuggcacccuucauauuacucauccuguuuuucauguuuggguggaggauucuuuucugcuuuaaguguugccgccggaccagaggacuguucaaguauaggcacuugaaagaugacgaggagacuggcuaccgcaagaucauugaacgacucaauaacaaaaaggguaaaaacaagcugcuagacggggagcggcuggccgaucguagaaucgcugaacucuuuucuaccaagacacauauagga

SEQ ID NO: 10573 - RNA, 2916 nt, Artificial Sequence
  derived and/or modified CDS sequence (opt3) from CCHFV(UG3010, Artificial)__AY900143.1__Gn-4aa-Gc
gccgagggcgugagcaacgacugcgucuccagaacccagcugaucaagacagaaguugcugagauucacgaagauucuuacgggggacccggugagaaaauaacuaucuguaauggcucaacgauuguggaccaaaggcucgggagugaacuuggaugcuauaccaucaaccggguaaagacauacaaacugugugagaauagcgcaacugagaagggcugcgaaauugauuccgugccugucaaauguaagcaggguuucugcuugaaggugacccaggaggggcgcggacauguuaaauuaucucgaggcacagaaaucgugcuggacgucugugauaccucgugcgagcuaaugauaccaaagggcacuggggacauccucguggauuguucaggaggucagcaacacuuucugcaggacaaccuuauugaucugggcugcccgaauguacccuugcucgggaaaauggccaucuauauuugucguaugagcaaccauccuaagacaaccauggcguuccuguuuugguucaguuuuggauacguuaucacgugcauagugugcaaaguccuguucuaucucuuaauugugaucggcacucuguccaagaagcugaaacaguacagagaguugaagccacagaccuguauugugugcgaaucuacacccgucaaugcuaucgacgccgagaugcacgaacugaacuguaauuauaacaucugcccuuacugugcaagcaggcuaacuuccgauggucucguucggcaugugaaucaaugcccaaaacgcaaggagaaaguagaagagaccgagcuguaccuuaaccuggaaaggauucccugguuggugagacggcuccugcaggucucagagaguacagggauggccuuaaagcgcagcuguuggaugaccacgcugcucauacuucuggugguuucuuuguccccugugcagucagcuccagucggacgaaaaccgcuauaucuggacagcaucgcaaagggcaugaagagucuccuuaauucuacuaaccuugaaacaucccugagcauugaggcccccuggggcgcuaucaaugugcagucgaccuuuaaaccuacuguaucugccgcgaacauagcauuguccuggucaaguguugaacacagagggaacaagauucucgugagcggaagguccgagucuaucaugaaacuggaggaacggacagguaucagcuggucauuaggcgucgaggaugccagugaauccaagacccugacggugagcgucauggaccuaucucaaauguacucaccaguguucgaguaucucaguggggaccgucagguugaagaguggcccaaagcuaccugcacaggagauugucaggagcgcugcggcuguacuagcucuaccugccugcacaaggaauggccucauuccagaaauuggaggugcaacccaacaugguguugggguguggggacuggcugcaccuguugcggacuugacguacgggauuuguuuacagacuacaugauggucaaguggaaaguggaguauguuaagaccgaagccauuauguguguggagcugacuucgcaagagcgacagugcagccucaucgaagcaggcacgcgcuucaaucuggggcccgucacaauuacccuuuccgagccgagaaacauacagcagaggcugccuucagaaaucgugacuuugcaccccaaaauugaggaaggauuuuucgaucucaugcauguacaaaaggugcugagugcuucuaccguuuguaaauuacagagcugcacacacggugucccaggcgaccuacagguguaccacguggggaaucugcucaagggagauaaggucaacggccauuccauccacaaaaucgagucacauuuuaauaccagcuggaugucuugggacgguugugaucuggacuauuucugcaacaugggggauuggccuuccuguacuuacacaggcguuacgcagcacaaucgggccgcguucauuaacaugcuuaauauagagaccgacuacacuaagacauuucauuuccacaguaaacgcgugaccgcccacggagacacaccccaauuggaucugaaggcaagaccaacuuauggcgcuggggaagugaccguacucgucgagguggccgaccuggaauuacauacgaaaaagaucgagguuagcggacugaaguuugcuucucuuaccugcuccgguugcuacgccuguucaaguggcauuagcugcaaagugaggauccacgucaacgaacccgaugaguucacagugcauguuaagucguccgacccugaugugguagcagccgggucuagcuugauggcucguaaaauugaguuuggagcggacucaacuuucaaggcauuuaguuccaugccgaaaaauucucucuguuucuauaucgucgaacgggauuacugcagcuccuguaccaacgacgauacacagaagugcguggacacuaaacuggagcacccacagucaauacuaaucgaacacaagggcaccauuaucgguaagcagaaugauacguguagcacaaaaaccaguugcuggcuggagucugugaaguccuuuuucuaugggcucaaaaacaugcugggcggaauuuuuggcaacgucuuccuugggaucuuuuuguuccuggcccccuucgcuuuacucauauuuuucuuuuucuuuggauggcgacugcuuuucugucugaagugcuguagaaggacucgcggcuugcucaaauacaagcaacugaaggacgaagaggaggccgguuauaaaaagauuaucgaacggcuaaaugauaaaaaggggaaaagcagacuguuugacggagagaggcucgcagaccgcaagauugccgaacuguucucgacaaagacccauaucggc

SEQ ID NO: 10574 - RNA, 2916 nt, Artificial Sequence
  derived and/or modified CDS sequence (opt3) from CCHFV(Hy13, Artificial)__AY900145.1__Gn-4aa-Gc
agcgaggaauccggcgacgauugcaucucuagaacccagcugucaaggacagagacugccgaaauucacagugacaacuacgggggacccggugauaagauaacgaucuguaauggcagcaccauuguggaccaacggcucggguccgagcuuggaugcuauacaaucaaccgcgucaaaucuuucaagcugugugaaaauucggcuacuggcaaaucaugcgagauugauagcaccccuaucaagugucgacaggguuuuugcuugaaaauaacacaggaggggcguggacauguuaaguuaaguagaggcuccgaagugguacuggacgcaugugauucuagcugcgagaucaugauuccaaagggcaccggggacauccuaguggauuguuccggaggucagcaacacuuccucaaagacaaccugauugaucuuggcugcccgaauaucccccuguuggggaagauggccauauacauuuguaggaugucaaaccauccuaaaacuacaauggcguuucucuucugguuuaguuucggauaugucauuaccugcauccugugcaaggugaucuuuuaccugcucaucguugugggcacguuagguaaaaaguucaagcaguaucgggaacugaaaccacagacuuguaccauuugcgagacaacucccgucaaugcuauagacgccgagaugcacgaucuuaacuguagcuacaauaucugcccuuauugugcaucucgcuugaccuccgacgggcuggccagacaugugaugcagugcccaaagaggaaagaaaagguagaggaaacagagcuauaccucaaccuggaacggauucccuggguugugcgcaaacuucugcaagucucagagagcaccggaguggcuuugaagcgaaguucuuggcucgugguccuguuaguucugcucacggugucccuuagcccuguacagucggcaccaaucggcagaaaaccgcuguuuucugacuccauagugaagggcaugaagaauuugcuaaacucaacuagccuggagacaagccucuccauugaagcccccuggggagcuaucaauguccagucuaccuucaaaccuacugugagcgccgcgaacaucgcacugucauggaguuccguugagcacagggggaauaagauucuugugagcggucggucugaaucaaucaugaaacuggaggaacguacaggcauuaguugggauuugggggucgaggacgccagcgaguccaagcuccugaccgugucuauaauggauuuaucgcagauguacagcccaguauuugaauaucuguccggagaccgccaaguugaggaauggcccaaagcuacguguaccggcgauugcccugagagaugugguugcacaucaaguacuugucuacacaaggaauggccacauucuaggaacuggcggugcaaccccaccuggugcuggggcguggggacaggauguacuugcuguggccucgacgucaaggaucuguucaccgaccacauguuugugaaauggaaggucgaguacaucaaaacagaggccauugugugcguugaacuuaccagccaggagcgacaguguuccuugaucgaagcagggacucgcuucaaucugggaccggugacgaucacacucucagagccuagaaacauucaacagaagcugcccccagagauaguaacccuucauccuaggaucgaagaggguuucuuugaucugaugcacgucaaaaagguguugagcgcuucuacuguuugcaagcuccaguccuguacccacggcgugcccggggaccugcaggucuaucauauuggaaauuuacugaaaggcgauaaggugaacggucaccuaauccauaaaauugaaccacacuucaauacaaguuggaugagcugggacgggugcgaccucgauuacuauuguaacaugggcgacuggcccucuugcuccuacaccggaguaacucaacauaaucacgccgcguuugugaacaugcugaauaucgagacagauuauacgaagauauuccacuuucauucaaaacggguuaccgcccacggcgacacuccucagcuugauuugaaggcacgcccaacauacggggcuggagaaaucaccguccugguggagguggccgacauggagcuccauacaaagaaaauugaaaucaguggucugaaguucgcuagcuuaacuuguaccggcugcuacgccugcucguccgggauuucuuguaaagucagaauccacguugaugagccggacgaacugacggugcacgugaagagugaggaucccgacauaguagcagccucaaguucccuuauggcuaggaaauuggaauuuggaaccgauucuacauucaaggcguuuagcgcaaugccuaaaacuucccucugcuucuauauugucgagcgugaguacuguaagucaugcagcaaggaagacacccagaaaugugugaacacaaagcuggagcagccacaaaguauccuaauugaacauaaaggcacuaucauagguaagcagaaugauaccugcacgucuaaagccggguguuggcuggaguccguuaagagcuuuuucuauggccucaagaacaugcugucgggaaucuuuggcaauguguucauugggaucuucuuguuucuugcucccuucauucuguuaauccucuuuuucauguuuggauggcggauacuguucugcuuuaaauguugccgaagaacaaggggccuuuucaaguaccgccaccugaaagacgacgaagagaccgguuaucggaagauuaucgagagauugaacaauaaaaaggggaagaacaaacuccuggauggagaaaggcuagccgaccgcaagaucgcagagcuguuuucaacuaaaacacauauuggc

SEQ ID NO: 10575 - RNA, 2916 nt, Artificial Sequence
  derived and/or modified CDS sequence (opt3) from CCHFV(Semunya, Artificial)__DQ094832.1__Gn-4aa-Gc
gccgagggcgugagcaacgacugcgucuccagaacccagcugaucaagacagaaguugcugagauucacgaagauucuuacgggggacccggugagaaaauaacuaucuguaauggcucaacgauuguggaccaaaggcucgggagugaacuuggaugcuauaccaucaaccggguaaagacauacaaacugugugagaauagcgcaacugagaagggcugcgaaauugauuccgugccugucaaauguaagcaggguuucugcuugaaggugacccaggaggggcgcggacauguuaaauuaucucgaggcacagaaaucgugcuggacgucugugauaccucgugcgagcuaaugauaccaaagggcacuggggacauccucguggauuguucaggaggucagcaacacuuucugcaggacaaccuuauugaucugggcugcccgaauguacccuugcucgggaaaauggccaucuauauuugucguaugagcaaccauccuaagacaaccauggcguuccuguuuugguucaguuuuggauacguuaucacgugcguggucugcaaagugcuguucuaucucuuaauagugauuggcacucuggguaagaagcugaaacaguacagagaguugaagccacagaccuguaucgucugcgaauccauucccguuaaugcuaucgacgccgagaugcacgaacugaacuguaauuauaacaucugcccuuacugugcaucuaggcuaacaagcgaugggcucgugcggcauguaacucaaugcccaaaacgcaaggagaaaguggaagagaccgagcuguaccuuaaucuggaaaggauucccugguuggucagacggcuccuucagguguccgagucaacaggaauggccuuaaagcgcaguuguuggaugaccacgcugcucauacuucugguugugagcuugucuccuguccaguccgcuccagugggccgaaaaccgcuauuucuggacucaaucgcaaagggcaagaaaagccuccugaacaguacuaaucuugaaacaucucuguccauugaggcccccuggggagcuaucaacguacagagcaccuucaagccuacuguuucggccgcgaauauagcauugucuugguccucaguggaacacagagggaacaaaauucucgucagugguaggagcgaguccaucaugaagcuggaggaacggacaggcaucucuuggagcuuagggguggaggaugccucagaaaguaaaacccugacggucuccgugauggaccuaagccaaauguauucuccaguuuuugaguaccucucaggagaccgucagguggaagaguggcccaaggcuaccugcacaggcgauuguccugagcgcugcgguuguacuagcaguaccugccugcacaaggaauggccacauuccagaaacuggaggugcaaucccacaugguguuggggcguagggacuggaugcaccuguugcggccuugacguccgggauuuguucacagacuauaugauggugaaauggaagguugaguacgugaaaaccgaagccauuaugugugucgagcugacuucucaggagcgacaaugcucgcucaucgaagcagggacgcgcuuuaaccugggaccggugacaauuacccuuagcgagccuagaaauguacagcagaggcugcccuccgaaauagugacuuugcacccaaagaucgaggaagguuucuuugaucucaugcauguucagaaaguccuguucuguaaguauucauuacaagcuaccaguugcacacacggcgugccuggggaccuacagguguaccacgucggaaaccugcucaagggcgauaaaguuaauggucauucuauucacaagaucgagagccauuucaacaccuccuggaugucaugggacgggugugaucuggacuauuuuugcaauaugggcgauuggcccagcuguacuuacacaggagugacgcagcacaaccgggccgcguucgugaauaugcuuaacaucgagaccgacuacacuaaaacauuucauuuccacucuaagcgcguaaccgcccacggcgacacaccacaguuggaucugaaagcaagacccacuuauggggcuggagaagucaccgugcucguugagguggccgaccuggaauuacauacgaagaagauugaggucuccggucugaaauuugcuagucuuaccugcagcggcugcuacgccuguucuuccgggauaucaugcaaggugaggauccacguuaaugaaccugaugaguucacagugcauguaaaaaguaacgacccagaugucguggcagccggaagcucguugauggcucguaagauugaguuuggcgcggacuccacuuucaaagcauuuucuagcaugccgaaaaauucacucuguuucuauaucguggaacgggauuacugcaguuccuguaccgacgaugacacacaaaagugcgucaacauuaagcuggagcacccccagucuauccuaauagaacacaaggguacuaucauugggaaacagaaugauaccuguccuacgaagacaagcugcuggcuggaguccguuaaaucauuuuucuauggccucaagaacaugcugggaggcaucuuugggaacguguuccuuggaauuuucuuguuucuggccccauucgcuuuacucauccuguuuuucuuuuucggcuggcgacuucuguuuuguuugaaaugcuguagaaggacccgcggucuccugaaguacaagcagcuaaaagacgaagaggaggccggguauaagaaaauaauugaacggcugaaugauaagaaaggaaagagcagacucuucgacggcgagaggcuggcagaccgcaagaucgccaaacuuuuuaguacuaagacacauauuggu

SEQ ID NO: 10576 - RNA, 2916 nt, Artificial Sequence
  derived and/or modified CDS sequence (opt3) from CCHFV(SPU128/81/7, Artificial)__DQ157174.1__Gn-4aa-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaagagcuucaaauugugugaaaauuccgcuacuggcaaaucuugcgagauugagucgguuccagugaagugucgacaggguuacugcuuacguaucacccaggaagggagaggacauguaaaacugucaaggggcagcgaggugguccuagaugcaugugacacaaguugcgaaauaaugaucccgaagggcaccggggauauucucguggacuguuccggaggucagcaacacuuucugaaggauaaccuuaucgaccugggcugccccaaaauuccuuugcucgggaagauggccaucuauauaugucggaugucuaaucauccaaaaacuacaauggcguuccuguuuugguucagcuuuggauacguuauuaccugcauccugugcaaggcuauuuucuaucucuuaaucaucauuggcacgcuggguaaacgcuuuaagcaguacagagagcuuaagccccagacuuguaccauaugcgagacaacuccugugaacgccaucgaugcagaaaugcacgacuugaauuguuccuauaacauuugcccauacugugccucaaggcugaccagugaugggcuagcucggcaugucacacagugccccaaacgcaaggagaaaguggaagagaccgaacucuaccugaaucuugagcgaaucccuuggguaguuagaaagcuguugcaagugagcgagucuacgggagucgcacucaaaagguccucauggcugauaguguuacugguccucuucacugugagccuuaguccaguucagucugccccgauuggccggaagccccuguuuuuggacuccaucgugaaaggcaugaagaaccuacugaauagcacaucgcucgaaaccucucuguccaucgaggcuccuuggggagccauuaacguacagucaacuuauaagccaacagugaguaccgcgaauaucgcacuuagcugguccucugucgaacaccgugggaacaaaauucuggugagcggucgcucagagaguauaaugaaguuggaagagagaacgggcaucuccugggaccucgggguugaggaugccagcgaaucuaaacuguuaaccgugucagucauggaccugagucagauguacagccccguguucgaguaucuauccggagauaggcaaguagaagaguggccuaaggcuacauguacuggcgacugcccagaacggugugguugcaccucuucgacaugucuccacaaagaguggccccauagccgaaauuggcgcugcaacccgacuuggugcuggggcguugggaccggauguacaugcuguggccuggaugugaaggaccuuuuuaccgauuacauguucgucaaguggaaaguggaguauauuaagacugaagccaucgucugcguggaguugacgucccaggaaagacaguguucacugaucgaggcagggacaagguuuaaccucggaccuguuaccauuacucugagugagccccggaauauacaacagaaacuuccaccugaaaucauuacccugcacccccgcaucgaggaagguuucuucgacuugaugcaugugcagaagguacucucugcuagcacagucugcaaacugcaguccuguacccacggcgugccaggggauuuacaaguuuaccacauuggaaaccugcuaaagggcgacaaggugaauggucaucucauccacaaaauagagccccauuuuaacacuucauggaugagcugggaugggugcgaccuggacuauuacuguaauaugggcgauuggccuucuugcacauacacgggagucacccagcacaaccaugccuccuucgugaaucuuuugaacaucgaaacugacuauacaaagaauuuucacuuccacaguaaaagaguaaccgcgcauggcgauacaccacagcuggaccucaaggccaggccgacuuacggggcaggagagauuaccgugcugguugaggucgcugauauggaauuacacacgaaaaagaucgagauuagcggucugaaguuugccucucuuaccuguacaggcugcuaugcuugcuccucagggaucaguuguaaagugcguauacauguggacgaacccgaugaguugacuguccacguuaagagcgacgauccugacgugguggccgcaucguccucucucauggcccggaaacuggaauuuggaaccgauagcacauuuaaggcuuucucagcgaugccaaaaacuucccuaugcuuuuacauuguagagcgagagcacuguaaguccugcucugaagaggacaccaaaaagugugucaacacgaagcuggaacagccccaaagcauccucauugagcauaaaggcacaaucauagguaagcagaauaguaccugcacugcaaaagccucauguuggcuggaaagcgugaagaguuucuuuuaugggcuuaaaaacauguugucuggcaucuucggaaauguuuuuauuggcaucuuccuguucuuagggccuuuuauucuccugauccuuuucuuuauguucggauggagaauacuguuuugcuucaaguguugcaggcgcacacggggcuugcucaaguacagacaccugaaagaggaugaggaaaccgguuauaggcgcauuaucgagcgacuaaacaauaagaaagggaagaacaaacugcucgacggagaacggcuggcugaccguagaaucgccgagcuuuucuccacuaagacccauauuggc

SEQ ID NO: 10577 - RNA, 2916 nt, Artificial Sequence
  derived and/or modified CDS sequence (opt3) from CCHFV(ROS/HUVLV-100, Artificial)__DQ206448.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaagagauccucauggcucauaguccuguuagugcugcucacggugagccuuaguccgguccagucugcucccguuggcaggaagccucuguuuuuggauuccauugugaaaggcaugaagaaccuacugaauagcacuucgcucgagacaucucuguccaucgaagccccauggggagcgaucaacguacagucaaccuucaagcccacugugaguacagcaaauauugcccuuagcugguccucugucgagcaccgggggaacaaaauccuggugaccggucguagcgaaucaauuaugaaguuggaggaacgcacgggcguuaguugggaccucgggguggaggaugcuuccgagagcaaacuguuaaccgucucuauaauggaccugucacagauguacaguccuguguuugaauaucuaagcggagauagacaaguagaggaauggccaaaggccacauguacuggcgacugccccgagaggugugguugcaccuccucuacaugucuccauaaagaauggccgcacucgcggaauuggcgaugcaacccuacuuggugcuggggcguugggaccggauguacaugcuguggcguggaugucaaggaccuguucaccgaucauauguuugugaaguggaaagucgaguacaucaagacugaggcaauugugugcguugaacuuacgagccaggagcgccaguguuccuugaucgaagcugggacaagauucaaccugggacccgugaccaucacucucucagagccaaggaauauucaacagaaacugccucccgagauaaucacccuucacccaaagguagaagaggguuucuuugaccugaugcacguccagaaaguguugagugccucuacaguuugcaagcuccagagcuguacccauggcauucccggggaucugcaaguguaucacaucggaaacuuacugaagggcgaccgggucaauggucaucuaauucacaaaaucgaaccucauuucaacacuuccuggaugucaugggacgggugcgaucucgacuacuauuguaauaugggcgauuggccaagcugcacauacacgggagugacccagcacaaccacgcggccuuuguaaaucugcuuaacauagagacugacuauacaaagaccuuccauuuucacucuaaacgcgugacagcacauggcgauacuccgcaguuggaccugaaggcuagacccaccuacggggccggagaaaucacgguucucgucgagguggcugauauggagcugcacaccaaaaagguggaaauuuccgguuuaaaguucgccagucuggcauguacaggcugcuacgccugcagcucugggaucuccuguaaagucaggauucacguugacgagccugaugaacuuacugugcaugugaagucaagugacccagauguagucgcugcgagcaccucguugauggcacguaaacucgaguuuggaacagacuccacuuucaaggccuuuucugcuaugcccaaaaccagccugugcuucuauaucguggaacgggaguacuguaagucaugcagugaggaagauacgcagaaauguguugacacaaagcuagagcaaccucaguccauacugauugaacacaagggcaccaucauugguaaacagaaugacacuugcacagccaaggcaucuuguuggcucgagagcgugaaauccuuuuucuaugggcugaagaacaugcuuggcucagucuuuggaaauuucuucaucggcauauugcuguuuuuagccccauucgugcuccugguucuguuuuucauguuuggguggaaaauccuuuucugcuuuaaguguugccgaagaaccaggggauugcucaaguaccgccugcuaaaagaugacgaagagacuggcuaucggagaauuaucgagaggcugaacaauaagaaagguaagaaccgccuccuggauggggaacgacuugcugaccggaaaauugccgaguuguucagcaccaagacacauaucgga

SEQ ID NO: 10578 - RNA, 2916 nt, Artificial Sequence
  derived and/or modified CDS sequence (opt3) from CCHFV(AP92, Artificial)__DQ211625.1__Gn-4aa-Gc
agcgagggcggggacggagguugcaucuccagaacccagcugauuaagacagaaacugccgaggugcacggcgaugacuacgggggacccggcgagaaaauaacgaucuguaacgguucuaccauugucgaucaaaggcucgggucagagcuuggaugcuauacaaucaaucggauuaagaguuucaaacugugugaaaacagcgcucagggcaagaauugcgagaucgacuccgcaccuguucagugucgccagggcuacugcuugaaaauaucucaagaggggcgaggacaugugaaguuaucgcgugguucagaaaucguacuggaugugugugacacuagcugcgagauuaugaucccaaagggcaccggggauauucuagucgacuguaguggaggccagcagcacuuucuccaguccaaccugguggaucuugguugcccgaauaucccccuguuggggaaaauggccauauauauuuguagaaugucuaaccauccuaagacaaccauggcguuccucuuuugguucagcuuuggauacguuaucacuugcauucugugcaaaacacuguucuauauccucaucauuauaggcaccuuaggcaagaaacugaagcaauacagggaacuuaagccacagacguguacuaucugcgaguccgugcccgucaaugcuauugacgccgagaugcacgauuugaacuguucauauaauaucugcccuuacugugcaagucggcugaccagcgaagggcuaacacgccaugugaaccagugcccaaaaagaaaggagaaaguagaagagacugaacucuaccugaaucuugagaggauacccuggauuguucggaagcugcuccaggugucugaguccaccggagucgccuugaaacgcucaagcuggaugaucgugcuguuaauccugcucauugugaguaugucuccuguccaauccgcuccaaucagccgaaagccgcuuuuucuggacucgauugcaaaagguguuaagaacuugcuaaauucuacaucccuggaaaccucacucaguauagaggcccccuggggcgcuaucaacgcccagagcacguauaagccuacugcguccucugcaaauauugcccugacauggagcucaguggaacacagagggaacaaaauccuuguaaguggaagguccgagagcaucaugaagcuggaagaacggaccggcauuucuuggaacuuggguguggaggaugcuucagaaagucguacucucacaauaagcgucauggaccugucccagauguacucuccaguguucgaguauuuaucgggggaccgccaaguugaagaguggcccaaagccaccuguacgggcaauugcccugaaagauguggaugcaccagcuccacaugucuguacaaggaguggccacacucaaggaacuggcggugcaaucccacuuggugcuggggcguggggaccggauguacaugcuguggucuagaugucaaagagcucuuuacugaccauaugcuggugaaguggaagguagaauauaucaaaaccgaggcaauuguuugcguggaacuuacaagucaggagcgacaguguucuuugaucgaggcuggcacccgcuucagccuggggccggucacuauuacgcucuccgaaccuagaaacauccagcaaaagcugcccccagagcuuauaacacugcacccuaaaaucgaagauggauacuuugacuugaugcaugugcagaaggucaugucagccagcaccgugugcaaacuccagucuuguacucacggcguucccggugaucugcagauuuaucacguggggaauuuacugaagggcgacaggguaaacggacaucuaauccacaaggucgagccacaucucaauaccuccuggaugaguugggauggcugcgaccuggauuacuucuguaacaugggggacuggcccagcugcacauacaccggagugacucaacacaaucaugcggccuuugcaaaccuuuugaauauugaaacagauuauacgaaaaccuuccacuuccacucuaagcggguuacugcucauggugacacaccucagcuggaccucaaagcccgcccaagauacggcgcuggggagaucaccgugcuggucgagguggccgauauggaauuacacacaaagaaaguagaggugacuggacugaaguuugcaucccuuaccuguucaggcugcuaugccugcaguagcgguauaucguguaagguuaggauucaugucgacgaaccggaugaguugacggugcacgugaaauccucugaccccgauaucgucgcugcgagcucaagucucauggcacguaagauugaguucgggguugacuccaccuuuaaagccuucucuagcaugccuaaggauucccugugcuuuuacaucguggaacgggacuauuguaacucaugcaaaaaugaggaaacacagcgaugugugaacgcuaagcuagagcagccacaaagcauacugaucgaacacacuggcaccauuaucggaaaacagaaugauacaugcggcaguagaacuucuuguuggcucgacuccuucaagagcuuuuucuacgggcugaagucgaugcuuucaggaauuuuuggcaacguauucuuggguaucuuucuguucuuagcccccuuugcacuccugcuuuucuucuuuuucuuuggguggaggauacuguucugcuuuaaauguugccgccggaccagaggauuguucaaguauaggcauauuaaagaugacgaggaagucggcuacaagaaaaucaucgagcgccucaacaauaagaaggguaaacaccgacugcuagauggcgagcggcuggccgaccguaagauugcugaacucuuuucuacgaaaacacauaucggg

SEQ ID NO: 10579 - RNA, 2916 nt, Artificial Sequence
  derived and/or modified CDS sequence (opt3) from CCHFV(ArD8194, Artificial)__DQ211626.1__Gn-4aa-Gc
gccgagggcgggagcaacgacugcguguccagaacccagcuggucaagacagaaguugcugagauccacgaagauucuuacggaggucccggcgagaaaauuacuauauguaaugggucaacgaucguggaccaaaggcucggaagugaacuuggcugcuauaccauuaaccggguacgcacauacaagcugugugagaauagcgcaacugagaaauccugcgaaaucgauucugugccugucaaguguaaacaggguuucugcuugaagauuacccaggaggggcgaggacaugugaaguuaucgcguggcacagaaaucguucuggacgugugugauaccucaugcgagcuaaugauaccaaaaggcacuggggacauccucgucgauuguagcggaggucagcaacacuuucugcaggacaaccuuauugaucugggcugcccgaauauccccuugcucgggagaacagccauuuauguguguaggaugaguaaccauccuaagaccacgauggcguuccuguuuugguucuccuuuggauacguaaucacuugcguugugugcaaaguccuguucuaucucuuaauagugauuggcacccuggguaagcggcuuaaacaguaccgcgaguugaagccacagacauguaucgugugcgaaucuauucccgucaaugcuaucgacgccgagaugcacgaucugaacuguaauuauaacaucugcccuuacugugcaagcagacuaacuuccgacgggcucguuaggcaugugacccaaugcccaaagcggaaagaaaagguagaggaaacagagcuguaccuuaaucuggagcgcauucccugguuggugcgaaaacuccugcaggucucagaaaguaccggaguggccuuaaagagaagcuguuggaugauaacgcugcucauccuucugacuguuucuauguccccugugcagucagcuccagucggcaggaaaccguuguuucuagaucggauugcaaagggcaugaaaagccugcucaacaguacaucucuggagaccucccuuagcaucgaagcccccuggggagcuauaaaugugcagucgacuuucaagccuacaguaucugccgcgaacauugcacuguccuggucaaguguugagcacaaggggaauaaaaucuuggugagcggucguuccgaaucuaucaugaagcucgaggagcgcaccggcauuagcuggugccugggggucgaagacgccucagagaguaaaacguuaaccguguccgucauggaccugagccaaauguauucuccaguguuugaauaccuaucaggagauagacagguugaggaauggcccaaggcuacauguacuggcgacugcccugagaggugugguugcaccaguagcacaugccuccacaaagaguggccacauucccggaacuggcgauguaaccccacuuggugcuggggcguggggaccggauguacaugcuguggccuggauguaaaggaccuuuucaccgauuauauguuggucaaguggaaaguggaauacaucaagacugaggccauuauaugcguugaacugacgucucaggagcgccaauguucgcucaucgaggcagggacaagauuuaaucugggaccggugaccauuacucuuagcgaaccuaggaacguccagcagcggcugcccccagagaucaucaccuugcacccuaaaauugaagaggguuucuuugaccucaugcaugugcagaagguaauguccgcuucaacagugugcaaacugcaaaguuguacccacggcguucccggggauuuacaggucuaucacgugggaaaucugcuaaagggcgacaaggugaacggucauucuauacacaaaaucgaaagccaucucaauacuuccuggaugucaugggaugggugcgaccuggauuacuucuguaacaugggcgacuggccaagcugcacauauacgggagucacccagcacaaucaugccgcguucauuaacaugcuuaauaucgagacugacuacacaaagaccuuucacuuccacucuaaacgcguuacagcccauggcgauacuccccaguuggaccugaaggcaagaccugcuuacggggccggagagauuaccgugcucguggaaguagcugaucuggaguuacacacgaaaaagaucgaagucuccggucugaaguuugccagucuuagcugcucuggcuguuaugcaugcuccucagggauaaguuguaaagugaggauccauguuaacgagccagacgaguucaccgugcacgucaagagcaaugauccggacgugguugccgcuggaucguccuugauggcgcguaaaauugaaucuggcgcagauagcacauuuaaggccuucucaaguaugcccaaaaacucccucugcuuuuacaucguggagcgggacuauuguucuagcugcacugaugacgauacccaaaaguguguagacauuaaacuggaacacccucaguccauccuaauagagcauaaggguacaauuaucgggaagcagaaugauacuugcccaaccaaaacgucauguuggcuggaaagcauuaagaguuucuuuuacggccucaaaaacaugcugucuggaaucuucggcaaugucuuucuugggauguugcuguucuuagcucccuuuauacuccugauccuuuucuucuuuuucggauggcgacuguuguuuugccucaaguguugcagaaggacacgcaaacugcuaaaguauaagcaucugcgggacgaggaagaguccggcuacaaaaagauuaucgagagacucaacgacaaaaaggguaaaagcaggcuguucgauggggaacgccuugccgaccgaaagauugcagaguuguuuucgaccaagacucacaucgga

SEQ ID NO: 10580 - RNA, 2916 nt, Artificial Sequence
  derived and/or modified CDS sequence (opt3) from CCHFV(ArD15786, Artificial)__DQ211627.1__Gn-4aa-Gc
gccgagggcgggagcaacgacugcguguccagaacccagcuggucaagacagaaguuacugagauccacgaagauucuuacggaggucccggcgagaaaauuacgauauguaaugggucaaccaucguggaccaaaggcucggaagugaacuuggcugcuauacaauuaaccggguacgcacuuacaagcugugugagaauagcgcuaccgagaaauccugcgaaaucgauucugugccugucaaguguaaacaggguuucugcuugaagauuacacaggaggggcgaggacaugugaaguuaucgcguggcaccgaaaucguucuggacgugugugauacuucaugcgagcuaaugauaccaaaaggcacaggggacauccucgucgauuguagcggaggucagcaacacuuucugcaggacaaccuuauugaucugggcugcccgaauauccccuugcucgggcagaccgcaauuuauguguguagaaugaguaaccauccuaagacgacuauggccuuccuguuuugguucuccuuuggauacguaauaaccugcguugugugcaaaguccuguucuaucucuuaaucgugauuggcacacuggguaagaggcuuaaacaguaccgggaguugaagccacaaacuuguaucgugugcgaaucuauucccgucaaugcgaucgacgcugagaugcacgaucugaacuguaauuauaacaucugcccuuacugugccagccgccuaaccuccgacgggcucguuagacaugugacacagugcccaaagaggaaagaaaagguagaggaaaccgagcuguaccuuaaucuggagcggauucccugguuggugcgcaaacuccugcaggucucagaaaguacgggaguggcauuaaagcgaagcuguuggauaaucacucugcucauucuucugacaguuucuauguccccugugcagucagccccagucggcagaaaaccguugagccuagauaguaucgcuaagggcaugaaaucucugcucaacuccaccagccuggagacuucgcuuucuauagaagcacccuggggugccauuaaugugcaauccacauuuaagccuaccaucucagcugccaacaucgcgcugaguuggagcuccguagagcacaagggaaauaaaauuuugguuucugguaggagcgaaucaaucaugaagcucgaggagcggacgggcauuaguuggugccuggggguggaagacgcauccgagagcaaaaccuuaacagucucugugauggaccugucacagauguauaguccagucuucgaauaccuaagcggagaucgucagguggaggaauggcccaaggccacuuguaccggcgacugcccugagcgcugugguugcacauccucuacuugccuccacaaagaguggccacauucgagaaacuggagguguaaccccaccuggugcuggggcguugggacaggauguaccugcuguggccuggaugugaaggaccuuuuuacugauuauauguugguaaaguggaaagucgaauacauaaagacggaggcuaucauuugcguggaacugacaagccaagagcggcaguguucccucaucgaggccgggacccgauucaaucugggaccgguuacuaucacccuuucagaaccucgcaacgugcagcagagacugcccccagagauuauaacauugcacccuaaaaucgaagagggguuuuucgaccucaugcauguccaaaaggugaugagugcaucuaccguaugcaaacugcagagcuguacucacggcgugcccggggauuuacagguuuaucacgucggaaaucugcuaaagggcgacaaggugaacggucauuccauucacaaaaucgaaucacaucucaauacaagcuggaugucuugggaugggugcgaccuggauuacuuuuguaacaugggcgacuggccauccugcacguauaccggagugacucagcacaauagggcugccuucauuaacaugcuuaauaucgagacagacuacaccaagacauuccauuuucacaguaaacgggucacugcgcacggcgauacaccccaauuggaccugaaggcccgcccuacguacggggcaggagagauaaccguucucguggaaguggcugaucuggaguuacauaccaaaaagaucgaaguaagcggucugaaguucgccucucuuacuugcuccggcuguuaugcuugcucaagugggauuagcuguaaagucagaauccacgugaacgagccagacgaauuuaccguucaugugaagucgaaugauccggacgucguggccgcaggauccucuuugauggccaggaaaauugagagcggcgcugauucaacauucaaggcguuuaguuccaugcccaaaaacucucucugcuucuacaucguugagcgugacuauuguagcuccugcacugaugacgauacccagaaguguguggacauaaaacuggaacacccucagucaauucuaaucgagcacaaggguacgauuaucgggaagcagaaugauacaugcccaaccaaaacuagcuguuggcuggaaaguauaaaguccuuuuucuacggccucaaaaacaugcugucuggaaucuuuggcaauauuuuccuugggauguugcuguuuuuagcacccuucguacuccugauccuguuuuucuucuuuggauggcggcuuuuguucugccucaaguguugccgaagaacaaggaaacugcuaaaguauaagcaucugcgcgacgaggaagagagcggcuacaaaaagauuaucgagcggcucaacgacaaaaaggguaaaucgagacuguuugauggggaaaggcuugccgaccgcaagauagcugaguuguucucaaccaagacucacgucgga

SEQ ID NO: 10581 - RNA, 2916 nt, Artificial Sequence
  derived and/or modified CDS sequence (opt3) from CCHFV(ArD39554, Artificial)__DQ211628.1__Gn-4aa-Gc
agcgaguccaacaauaacgacugcgugucuagaacccagcugaucaagacagaaaaugccgagauucacggcgaugacuacgggggacccggugagaaaauaacuaucuguaacggcucaacgauugucgaacaaaggcucgggagugaacuuggaugcuauaccaucaaucggauuaagagcuucaaacugugugagaacuccgcuucuggcaaggguugcgagaucgauucgacaccuguuaaauguaagcagggguuuugcuugaagauaacucaggaaggacgcggccaugugaaauuaucacgaggcagcgagaucauucuggacguaugugauaguuccugcgaaaugaugaucccaaaggggucuggagacauucuaguggauuguagcgguggccagcaacacuuccuccaggacaaucuggucgaucuugggugcccgaacgugccccuguugggaaaaauggcaaucuacauaugucguauguccaaucauccuaagaccacaauggccuuucucuucugguuuucauucggcuauguuauuaccugcaucuuuugcaaagugauuuucuacguccugaucaucauugguacucuggggaagagaauaaagcaguauagggagcucaaaccacagacauguaccaucugcgaggcgacgcccgugaacgcuauugacgccgaaaugcacgauuuaaauuguaguuacaacaucugcccuuauugugcaagccggcugacuucugagggacuuguacgccauguuacccaaugcccaaagagaaaagaaaagauagaggaaacagaguuguaccugaaucuagagaggauucccugguuugugcggaaacuccugcaggucuccgaaucaacuggcguggcccuuaagcgcagcaguuggcuggugaccuugcucguccuguuaacaguuucucuguccccugugcagagcgcuccaaucggccgaaaaccccucuuccuugacucgaccgcaaagucuaugaagucccuguugaacucaacgagucuagagacuagccuguccaucgaagccccguggggugcuauuaauguacagucuacauuuaaaccuaccgccagcacugcgaacaucgcacucucauggaguuccguggagcacagaggaaacaagauucuggucacagguaggagcgaaucuauaaugaaacuugaggagcggaccggcaucucauggaaucuggggguggaagaugccagugagagcaagacguugaccguuuccgugauggaccucucucaaauguacucgacagucuucgaauaucugagcggagaccgucagguggaggaauggccaaaagcuacuuguaccggcgauugccccgagcgcugugguugcacauccucaacuuguuuacacaaggccuggccucauaguagaaacuggaggugcaauccaaccuggugcuggggcguagggacaggauguaccugcuguggccuggacguuaagaaccuauuuacugauuacaugcucauuaaauggaagguggaguucaucaaaacggaagcaaucgucugcguggagcugacaucucaggaacggcaauguagccuuauugaggcugggacccgauucaauuugggacccgucacuauaacccuguccgagccgcgcaacauccagcagaagcucccucccgaacuggugacacuucacccaagaguugaggaaggguuuuucgaccugaugcaugugcagaaaguauugucagccagcaccgucugcaagcuccaaucuuguacucacggcgugccuggggaucugcagguuuaucacgugggaaauuuacugaagggcgacaaaauuaacgguaauuccuuucauaagaucgagcccaaccuaaauacaaguuggaugagcugggaugggugcgaccucgauuacuauuguaacaugggcgacuggccaucuugcacguacaccggagucacucagcacaaucaugcggccuucgugaaccugcuuaauauugaaacagauuauaccaaaaacuuucacuuccauuccaagaggguaacagcacacggcgagacuccccaguuggaccugaaagcucggccuaaguacggggccggagaggugaccguucucgucgaaguggcugacauggagcugcacacgaagaaaaucgaaauaucagguuuaaaguuugccagucugaccuguacaggcugcuacgcaugcagcucggggaucuccuguaaagugcgccuucaugucgaugagccagacgaauugacuguucacgugaagucugaugacccggaugugguagccgcuagcucaagucucauggcgagaaaaauugaguucggaaccgacuccacauuuaaggcauucucuagcaugcccaaagauaagcugugcuuuuauaucgucgagagggacuacuguuccucaugcagcaaggaagauacucaaaaaugugugaacgccaagcuagagcagccucagaguauucugaucgaacauaaaggcaccauaauugguaagcagaaugacacgugcacaguuaaagcuagcuguuggcucgaguccgugaagucuuucuuuuaugggcugaagaacaugcuuggcggaaucuucggcaaugucauuuuggggaucauaauguuccuggccccauuugcauuacuccugcuuuucuuucuguucggauggcguaucuuguuuugccuccgguguugccgaagaaccaggggccuguucaaauacaagcacauuaaagaugacgaagagucggguuauaagcgcaucauugagcggcuaaacaauaaaaaggggaagaacaaacuguuugauggagaaagacucgccgacaagaaaaucgcugagcuguucucaacuaagacacacauaggc

SEQ ID NO: 10582 - RNA, 2916 nt, Artificial Sequence
  derived and/or modified CDS sequence (opt3) from CCHFV(C-68031, Artificial)__DQ211629.1__Gn-4aa-Gc
agcgaggaauccggcgacgauugcaucucuagaacccagcugucaaggacagagacugccgaaauucacagugacaacuacgggggacccggugauaagauaacgaucuguaauggcagcaccauuguggaccaacggcucggguccgagcuuggaugcuauacaaucaaccgcgucaaaucuuucaagcugugugaaaauucggcuacuggcaaaucaugcgagauugauagcaccccuaucaagugucgacaggguuuuugcuugaaaauaacacaggaggggcguggacauguuaaguuaaguagaggcuccgaagugguacuggacgcaugugauucuagcugcgagaucaugauuccaaagggcaccggggacauccuaguggauuguuccggaggucagcaacacuuccucaaagacaaccugauugaucuuggcugcccgaauaucccccuguuggggaagauggccauauacauuuguaggaugucaaaccauccuaaaacuacaauggcguuucucuucugguuuaguuucggauaugucauuaccugcauccugugcaaggugaucuuuuaccugcucaucguugugggcacguuagguaaaaaguucaagcaguaucgggaacugaaaccacagacuuguaccauuugcgagacaacucccgucaaugcuauagacgccgagaugcacgaucuuaacuguagcuacaauaucugcccuuauugugcaucucgcuugaccuccgacgggcuggccagacaugugaugcagugcccaaagaggaaagaaaagguagaggaaacagagcuauaccucaaccuggaacggauucccuggguugugcgcaaacuucugcaagucucagagagcaccggaguggcuuugaagcgaaguucuuggcucgugguccuguuaguucugcucacggugucccuuagcccuguacagucggcaccaaucggcagaaaaccgcuguuuucugacuccauagugaagggcaugaagaauuugcuaaacucaacuagccuggagacaagccucuccauugaagcccccuggggagcuaucaauguccagucuaccuucaaaccuacugugagcgccgcgaacaucgcacugucauggaguuccguugagcacagggggaauaagauucuugugagcggucggucugaaucaaucaugaaacuggaggaacguacaggcauuaguugggauuugggggucgaggacgccagcgaguccaagcuccugaccgugucuauaauggauuuaucgcagauguacagcccaguauuugaauaucuguccggagaccgccaaguugaggaauggcccaaagcuacguguaccggcgauugcccugagagaugugguugcacaucaaguacuugucuacacaaggaauggccacauucuaggaacuggcggugcaaccccaccuggugcuggggcguggggacaggauguacuugcuguggccucgacgucaaggaucuguucaccgacuacauguuugugaaauggaaggucgaguauaucaaaacagaggccauugugugcguugaacuuaccagccaggagcgacaguguuccuugaucgaagcagggacucgcuucaaucugggaccggugacgaucacacucucagagccuagaaacauucaacagaagcugcccccagagauaguaacccuucacccuaggaucgaagaggguuucuuugaucugaugcaugucaaaaagguguugagcgcuucuacuguuugcaagcuccaguccuguacccacggcgugcccggggaccugcaggucuaccacauuggaaauuuacugaaaggcgauaaggugaacggucaucuaauccacaaaauugaaccacauuucaauacaaguuggaugagcugggacgggugcgaccucgauuauuacuguaacaugggcgacuggcccucuugcuccuauaccggaguaacucaacacaaucaugccgcguuugugaacaugcugaauaucgagacagauuacacgaagauauuccacuuucacucaaaacggguuaccgcccauggcgacacuccucagcuugauuugaaggcacgcccaacauacggggcuggagaaaucaccguccugguggagguggccgacauggagcuccacacaaagaaaauugaaaucaguggucugaaguucgcuagcuuaacuuguaccggcugcuaugccugcucguccgggauuucuuguaaagucagaauccauguugaugagccggacgaacugacggugcacgugaagagugaggaucccgacauaguagcagccucaaguucccuuauggcuaggaaauuggaauuuggaaccgauucuacauucaaggcguuuagcgcaaugccuaaaacuucccucugcuucuacauugucgagcgugaguauuguaagucaugcagcaaggaagacacccagaaaugugugaacacaaagcuggagcagccacaaaguauccuaauugaacacaaaggcacuaucauagguaagcagaaugauaccugcacgucuaaagccggguguuggcuggaguccguuaagagcuuuuucuacggccucaagaacaugcugucgggaaucuuuggcaauguguucauugggaucuucuuguuucuugcucccuucauucuguuaauccucuuuuucauguuuggauggcggauacuguucugcuuuaaauguugccgaagaacaaggggccuuuucaaguaucgccaucugaaagacgacgaagagaccgguuaccggaagauuaucgagagauugaacaauaaaaaggggaagaacaaacuccuggauggagaaaggcuagccgaccgcaagaucgcagagcuguuuucaacuaaaacacacauuggc

SEQ ID NO: 10583 - RNA, 2916 nt, Artificial Sequence
  derived and/or modified CDS sequence (opt3) from CCHFV(Drosdov, Artificial)__DQ211630.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgaggucaugauaccgaaaggcacuggggauauccucguggacuguaguggaggucagcaacacuuccugaaggauaaccuuauugaccugggcugcccccauaucccuuugcucgggaaaauggccauuuacaucuguagaauguccaaucacccaaggacaaccauggcguuucuguucugguuuucuuucggauauguuauaacgugcaucuuuugcaaggcucuguucuacagccucauuauuaucggcacuuuagguaaaaagaucaagcaguaucgggaacugaaaccccagaccuguacaauuugcgagacugccccugugaacgcaauagaugccgagaugcaugaccuuaaguguuccuacaauaucugcccauauugugcuucacgcuugaccagugacgggcuggcaagacacgucacacagugccccaaaaggaaggaaaaaguggaggaaaccgagcuauaccucaaccuggaacggauuccuuggaucguacgcaaacuucugcaaguuagcgagucuacgggaguggccuugaagcgauccucauggcucauaguccuguuagugcugcucacugugagccuuaguccaguccagucugcuccgguuggcagaaagccccuguuuuuggauuccacagugaagggcaugaaaaaucuacugaacagcaccucgcucgagacuucucuguccauugaagccccuuggggagcgaucaauguacagucaacauucaagccaaccgugaguacggcaaacaucgcccuuagcugguccucugucgagcacagggggaauaaaauucuggugaccggucggagcgaaucaaucaugaaguuggaggaacguacaggcguuaguugggaccucgggguggaggaugcuuccgagagcaaacuguuaacugucucuauuauggaccugucacagauguacagucccguguuugaauaucuaagcggagaucgccaaguagaggaauggccuaaggccaccuguacaggcgacugcccagagagaugugguugcacuuccucuaccugucuccauaaggaauggccccacucgaggaacuggcggugcaauccgacauggugcuggggcguugggaccggauguacuugcuguggcguggaugucaaagaccuguucacggaucauauguuugugaaguggaaagucgaguacaugaagacagaggcaauagugugcguugaacuuaccagccaggagcgacaguguuccuugaucgaagcugggacucgcuucaaccugggaccugugaccauuacacucucagagcccagaaacauccaacagaaacugccaccugagaucauuacccuucaccccaagauagaagaggguuucuuugaccugaugcacguacagaaggucuugagugccucuacugugugcaaacuccagagcuguacacauggcaucccaggggaucugcaaauuuaucacaucggaaauuuacugaagggcgacaggguuaacggucaucuaauucacaaaaucgaaccccauuucaauacguccuggaugucaugggacgggugcgaucucgacuacuauuguaacaugggcaauuggccuagcugcaccuacacuggagugacacagcacaaccacgcggccuuugucaaucugcuuaacauagagaccgauuauacaaagacuuuccauuuucacucuaaacgggugaccgcacauggcgacacgccacaguuggaucugaaggcucgcccgaccuacggggccggagaaaucacaguacucguggagguugcugacauggagcugcacacuaagaaagucgaaauuuccgguuuaaaguucgccagucugguguguaccggcugcuacgcaugcagcucugggaucuccuguaaagugaggauucacgucgaugagcccgacgaacuuacaguucaugugaagucaagugauccugacgugguagccgcuagcacuucguugauggcgagaaaacucgaguuuggaaccgauuccaucuucaaggcauuuucugccaugccaaaaacgagccugugcuucuauauagucgaacgugaguacuguaagucaugcagugaggacgauacaaagaaauguguggacaccaagcuagaacagccccaauccauucugaucgagcacaaaggcacuauuaucgguaagcagaaugacacaugcaccgcuaaagccucuuguuggcucgaaagcguuaaguccuuuuucuaugggcugaagaacaugcuuggcucaguguuuggaaauuucuucgucggcauauugcuguuuuuagcaccuuucgugcuccugguucuguuuuucauguuuggguggaaaauccuuuucugcuuuaaguguugccggcgaacuagaggauuguucaaauacaggcaucucaaggaugacgaggaaaccggcuaucgccggauuaucgagagacugaacagcaaaaaggguaagaauaggcuacuggauggggagcgccucgccgaccgaaaaauugcugaacuguuuaguacaaagacgcacaucgga

SEQ ID NO: 10584 - RNA, 2916 nt, Artificial Sequence
  derived and/or modified CDS sequence (opt3) from CCHFV(Kashmanov, Artificial)__DQ211631.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaagagauccucauggcucauaguccuguuagugcugcucacggugagccuuaguccgguccagucugcucccguuggcaggaagccucuguuuuuggauuccauugugaaaggcaugaagaacagccuaaauucgacuucucuggagacaucccucucaaucgaagccccauggggagcgaucaacguacagaguaccuucaagcccacugugagcacagcaaauauugcccuguccuggucuagcgucgagcaccgggggaacaaaauccuugugaccggucguucagaaaguauuaugaagcuggaggaacgcacgggcguuuccugggacuuggggguggaggaugcuagcgagucuaaacuccugaccgucucaauaauggacuuaagucagauguacagcccuguguuugaauaucuguccggagauagacaaguagaggaauggccaaaggccacauguacuggcgacugccccgagaggugugguugcaccucuucgacaugucuacauaaagaauggccgcacagccggaauuggcgaugcaacccuacuuggugcuggggcguugggaccggauguacaugcuguggcguggaugucaaggaccucuucaccgaucauauguuugugaaguggaaagucgaguacaucaagacugaggcaauugugugcguugaacugacgucccaggagcgccaguguucacuuaucgaagcugggacaagauucaacuugggacccgugaccaucacucugagugagccaaggaauauucaacagaaacucccucccgagauaaucacccugcacccaaagguagaagaggguuucuuugaccuuaugcacguccagaaagugcugucugccagcacaguuugcaaguugcaguccuguacccauggcauucccggggaucuccaaguguaucacaucggaaaccuguuaaagggcgaccggauuaauggucaucugauccacaaaauagaaccucauuucaacacuucauggaugagcugggacgggugcgaucuagacuacuauuguaauaugggcgauuggccaucuugcacauacacgggagucacccagcacaaccacgcggccuuugugaaucuccugaacaucgagacugacuauacaaagaccuuccauuuucacuccaaacgcguaacagcacauggcgauacuccgcagcuugacuugaaggcuagacccaccuacggggccggagaaauuacggugcugguugaggucgcugauauggagcuccacaccaaaaagguggaaaucaguggucugaaguucgccagcuuagcauguacaggcugcuacgccuguucuuccgggauuucaugcaaagugaggauccacgucgacgagccugaugaacugacuguucaugugaagaguagcgacccagaugugguagcugcgucgaccucccuuauggcacguaaauuggaguuuggaacagacucuacuuucaaggccuuuagcgcuaugcccaaaaccucacucugcuucuauauagucgaacgggaguacuguaagaguugcuccgaggaagauacgcagaaauguguggacacaaagcuggagcaaccucagucuauucuaaucgaacacaagggcaccauuaucgguaaacagaaugacacuugcacagccaaggcaagcuguuggcuggaguccguuaaaucauuuuucuaugggcucaagaacaugcugggcagcguguuuggaaauuucuucauaggcauccuuuuguuucuggccccauucgucuuacucgugcuguuuuucauguuuggguggaaaauucuuuucugcuuuaaguguugccgaagaaccaggggacuguugaaguaccgccaucucaaagaugacgaagagacuggcuaucggagaaucauugagaggcugaacaauaagaaagguaagaaccgccuacuggauggggaacgacucgcugaccggaaaaucgccgagcuguucaguaccaagacacacauagga

SEQ ID NO: 10585 - RNA, 2916 nt, Artificial Sequence
  derived and/or modified CDS sequence (opt3) from CCHFV(Oman, Artificial)__DQ211632.1__Gn-4aa-Gc
agcgaggaauccggcgaggacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaaaucuuucaaguugugugaaaauuccgcuacugguaaaucuugcgagauugacaacaccccuguuaaguguaaacagggguuuugcuuaaagaucacacaggaaggacgaggccaugugaagcugucgcgugauucagagguagugcuagacgcaugugauagcaguugcgaaauaaugaucccaaaaggcaccggggacauucucgucgauuguuccggaggucagcaacacuuccugaaggacaaucuuaucgaucugggcugcccgaacauucccuugcucgggaaaauggccaucuacauauguagaaugucuaaucauccuaagacuacaauggcguuucuguucugguuuagcuucggauaugugauuaccugcauccugugcaaaguuaucuuuuaccucuuaauuguggucggcacgcuggguaagaaguucaaacaguauagggagcuuaagccacagacuuguaccaucugcgagacaacucccgugaacgcuauugacgccgaaaugcacgauuugaauuguuccuacaacauaugcccuuauugugcaucacggcugaccagugacgggcuagcccgccauguaaugcagugcccaaaaagaaaggagaaaaucgaagagacagaacucuaccugaaucuugagaggauucccuggguugugcggaagcuguugcaagucagcgagucuaccggaguggcucucaaacgcuccucauggcugaucguguuacugguccuccuuacgguuagccugaguccugugcagucugcaccaauaggccgaaagccguuguuucuagacuccauugccaagggcaugaaaaaccugcucaauagcacuucgcuggaaacaucucuuuccaucgaggcucccuggggagccaucaacguacagucaaccuucaagccuacugugaguacagcgaauauugcacugagcugguccucugucgaacacagagggaacaaaaucuuggugagcgguaggucagagaguauuaugaagcucgaggagcggaccggcauauccugggaucuggggguugaggacgccagcgaaucuaaauuacugacggugucagucauggaucuaagucagauguacagcccaguguuugaguaucucuccggagaccgucaaguagaagaguggcccaaggcuaccuguacaggcgauugcccugaacgcugugguugcacuucuucgaccugucugcacaaggaguggccacauagcagaaacuggaggugcaaucccacauggugcuggggcguugggacuggauguaccugcuguggccuugacgugaaagauuuguucacagacuacauguuugucaaguggaaaguggaguauaucaagaccgaagccauugucugcguggagcugacuucccaggaacggcaguguucacucaucgaggcagggacgcgauucaaccugggaccgguuacaaucacccuuagugagccucgcaauauucaacagaaacugcccccagaaauagugacuuugcacccuagaaucgaggaagguuucuuugaucucaugcauguacagaagguccugucugcuagcaccgugugcaaguuacaguccuguacacacggcguucccggggaccugcaaguguaccacauuggaaaccuacucaaaggcgauaaggucaauggucaucugauccacaaaguggagccacauuucaacaccucauggaugagcugggacgggugcgaccuugauuauuacuguaauaugggcgacuggcccucuugcacuuauacaggaguaacgcagcacaaccaugccgcguuugugaauuugcugaacauugaaaccgauuacacuaagaauuuccacuuucacuccaaaaggguuacagcccauggcgacaccccucagcucgaucugaaggcacggccaaacuacggggcuggagaggucacaguguuaguggaggucgccgacauggaacugcacacuaagaaaaucgagauaaguggucuuaaguucgcuagcuugaccuguacgggcugcuaugccugcagcuccgggaucucauguaaaguucgcauucauguggaugaaccggacgagcucaccgugcacguaaagagugaagaucccgacaucgucgcagccagcucgucccugauggcuagaaaacuagaguuuggaacagauucuacuuucaaggcguuuagcgcaaugccuaaaaccucacugugcuucuacauuguggagagggaauauuguaagaguugcuccaaggaggacacacagaaauguguuaaugccaagcucgaacguccacaaucuauccugauagagcacaaaggcacuauuaucgguaagcagaacgauaccugcacggcuaaagccagcuguuggcuugaauccgugaagucauuuuucuacggguugaagaauaugcugagcggcauuuuuggaaacgucuucaucggcauauucuuauuucucgcacccuucauccugcuuauucuguuuuucauguuuggguggcggaucuuguucugcuuuaaauguugccgaagaacaaggggacucuucaaguaucgccaucugaaagacgacgaggagaccggcuaccggaagauuaucgaaagacuaaacaauaaaaaggguaagaacaaacugcucgauggggagaggcuggccgaccgcaagauagcugaacuuuuuaguacuaaaacacacauugga

SEQ ID NO: 10586 - RNA, 2916 nt, Artificial Sequence
  derived and/or modified CDS sequence (opt3) from CCHFV(SPU97/85, Artificial)__DQ211633.1__Gn-4aa-Gc
agcgaggaauccgacggcgauugcaucucuagaacccagcugcucaggacagagacugccgaaauucacucagacaacuacgggggacccggugauaagauaacgaucuguaauggcaguaccauuguggaccaacggcuugggagcgagcugggaugcuauacaaucaaccgcgucaaauccuucaaguugugugaaaauucugcuacuggcaaaucgugcgagauugauucaaccccuguuaagugucgacaggguuuuugcuuaaaaaucacacaggaggggcguggacaugugaagcugagcagaggcagugaaauaguacuagacgcaugugauuccucuugcgagaucaugauuccaaagggcaccggggacauccucguggauuguagcggaggucagcaacacuuccugaaagacaaccuuauugaucugggcugcccgaauauccccuugcucgggaggauggccauauacauuugucggauguccaaccauccuaagacuacaauggcguuucuguucugguuuucauucggauaugucauuaccugcauccugugcaaagugaucuuuuaccucuuaaucguugcuggcacgguggguaagaaauucaagcaguaucgcgaacugagaccacagacuuguaccauuugcgagacaacucccgucaaugccauagacgcagagaugcacgaucuuaacuguaguuacaauaucugcccuuauugugccagcagguugaccucugacgggcuggcucggcaugugaugcagugcccaaagcgcaaagaaaagauugaggaaacagagcuauaccucaaccuggaacgaauccccuggguaguuagaaaacuucugcaaguguccgagucaaccggagucgcauugaagaggagcaguuggcucacggugcuguuagugcugcucauagucucucuuuccccuguucagagcgccccaauuggccggaaaccgcuguuuuuggacucgaucgugaagggcaaaaagaaucuacugaacucuacuucccucgagacaucacugaguaucgaagcucccuggggagccauuaauguacagagcaccuucaagccuacuguguccgcggcaaacaucgcccuuucuuggagcucagucgagcaccgugggaauaaaauucuggugaguggucgcuccgaaagcauaaugaaguuggaggaaagaacaggcaucucuugggaucucgggguugaggacgcuucagagaguaaacuguuaaccgugagcgucauggaucugucccagauguacucuccaguguuugaauaucuaucgggagacaggcaaguagaggaauggcccaaggccacguguaccggcgauugcccugagcggugugguugcacaagcuccacuugucuccacaaagaauggccacauucacgaaacuggcgcugcaaccccaccuggugcuggggcguugggacaggauguacuugcuguggccuggacgugaaggaucuuuucaccgacuacauguuugucaaguggaaaguggaguauauuaagacagaggcaaucgucugcguggaauugaccagucaggagagacaguguucucugaucgaagcugggacuagguucaaucucggaccgguuacgauuacacugagcgagccucggaacauacaacagaaacuucccccagagaucauuacccugcacccucgcaucgaagaggguuucuuugauuugaugcaugugcagaagguacucuccgccucaacugucugcaaacugcagagcuguacccacggcgugcccggggacuuacaaguuuaccacauuggaaaucugcuaaagggcgauaaggugaacggucaucucauccacaaaauagaaccacauuucaauacaucuuggauguccugggacgggugcgaccuggauuauuacuguaacaugggcgacuggcccaguugcaccuauacuggagucacacagcacaaucaugcggccuuugugaaccuuuugaauaucgagacggauuacaccaagaacuuccacuuucacagcaaaagaguaacugcacauggcgacacaccucagcuggaucucaaggcuaggccaaccuacggggccggagaagugacaguucuggucgagguggcugacauggaguuacacacuaaaaagauugaaaucucuggucugaaguucgccucccuuucauguaccggcugcuaugcaugcaguagcgggauuucguguaaagugcguauccaugucgaugagccggacgaauugacgguucacgugaaguccgaggaucccgacauaguggccgcuggaucuagccucauggcgcggaaacuggaauuuggcgcagauucaaccuucaaggccuuuagugcuaugccuaaaacaucccuaugcuucuacauuguagagcgagaguauuguaagucuugcagcagagaagacacucagaaaugugucaauaccaagcuggagaggccacaauccauccucauugaacacaaggguacaaucauagggaaacagaacgauacuugcaccgccaaggcaucauguuggcuggagagcgugaaaaguuucuuuuacggccuuaagucuauguuguccggaaucuuuggcaauguuuucauugggaucuuccuguuuauugcccccuucguguuacucauccuguuuuucauguuuggauggcgcauacuuuucugcuuuaaauguugccggagaacgaggggccuguucaaguaucgccauuugaaggacgacgaagagacagguuaccgaaaaauuaucgagcggcucaacaauaagaaagggaagaacaaacugcuagauggagaacgucuggcugacagaaagaucgccgagcucuuuagcaccaagucgcacauuggc

SEQ ID NO: 10587 - RNA, 2916 nt, Artificial Sequence
  derived and/or modified CDS sequence (opt3) from CCHFV(SPU103/87, Artificial)__DQ211634.1__Gn-4aa-Gc
agcgaggaauccucugacgauugcaucucaagaacccagcuucucaggacagagacugccgaaauucacggcgacaacuacgggggacccggugauaagauaacgaucuguaauggcaguaccauuguggaccaacggcuugggagcgagcugggaugcuauacaaucaaccgcgucaaaacuuucaaguugugugaaaauuccgcuaccggcaaaucuugcgagauugauucgguuccugugaagugucgacaggguuacugcuuaaaaaucacacaggaggggcguggacauguaaagcugucaagaggcagcgaagugguccuagacgcaugugauaccaguugcgaggugaugauaccaaagggcacuggggacauccucguugauuguuccggaggucagcaacacuuucugaaagacaaccuuauugaucugggcugcccgaagauccccuugcucgggaaaauggccauuuauaucuguaggaugucuaaucauccuaagacaaccauggcguuccuguuuugguucagcuuuggauacgugauaacgugcguccugugcaaagcuauuuucuaucucuuaaucauugugggcacucuggguaagcggcuuaagcaguaccgcgaauugaaaccacagaccuguacaaucugcgagacuacccccguaaacgccaucgacgcagagaugcacgaucugaauuguuccuauaacauuugcccuuacugugccucaagacuaacaagugacgggcucgcuaggcauguuacccagugcccaaagcggaaagaaaagguggaggaaacggagcuguaccuuaaucuggaacgcauacccugggucgugcgaagauugcuccaagugagcgagucuacuggagucgcacugaaaagguccucaugguuaaucguucugcucgugcuuuuuacaguaagccugaguccugugcagucugccccaauuucccggcguccguuguuccuagacaacaucgucaagggcaugaaaaaucugcucaacagcaccucgcuggagacuucucuuuccauagaagcucccuggggcgccauuaaugugcagucaacauauaagccuaccguuaguacggcgaacaucgcacugagcugguccucuguggagcaccgcgggaauaagaucuuggucagcggaagaucagaaaguauuaugaaacucgaggaaaggaccgguaucuccugggaucugggcguggaggacgccagcgagucuaaguuacugacaguaucaguuauggaucuaagucagauguacagcccaguguuugaauaucucuccggggaccggcaagucgaggaauggcccaaagcuacuuguaccggagauugcccugagcgauguggcugcacaucuucgacuugucugcacaaggaauggccacauagccgcaacuggagaugcaaccccaccuggugcugggguguggggacaggcuguaccugcuguggacuugacgucaaagauuuguucacugacuacauguuugugaaguggaagauugaguauauaaaaacggaggccaucguuugcguggaacugacaucccaggagaggcaguguucacucauugaagcaggcacccgguucaaucuggggccgguaacuaucacccuuagugagccucgcaacauccaacagaagcugcccucugagauuauaacauugcacccaagaaucgaagagggauuuuucgaucucaugcauguccagaaagugcugagcgcuuccaccguuugcaaguuacagucauguacucacggugugccuggcgaccugcaagucuaccacauugggaaucuacucaaaggagauaaggugaacggccaucugguacacaagaucgaaccccauuucaauacaagcuggaugucuugggacgguugcgaccuugauuauuacuguaacaugggggacuggccauccugcacguacaccggcgugacucagcacaaucaugccaguuuuguuaacuugcugaauauugagacagauuauaccaaaaacuuccacuuucacagcaagagggucacagcgcauggagacacuccccagcucgaucugaaagcccguccuaccuacggcgcaggggaaaucacgguguuaguggaggucgcugacauggagcugcacaccaagaaaauagaaaucucuggacuuaaguucacauccuugacuuguaccgguugcuaugccugcucaaguggcauuagcuguaagguucggauccauguggaugagccagacgaacucacagugcacguaaaaucggaugacccggaugucguggcugccuccucuagccugauggcacgaaagcuagaguuugggacugacucaaccuucaaagccuuuagugcuaugcccaagacgucccugugcuucuacauuguugaaagagaguauuguaaaucuugcagcgaggaagauacacagaagugugugaauaccaaacucgagcaaccucaguccauccugauagaacacaagggaacuauuaucggcaagcagaacaauacaugcaaagcgagggcagguuguuggcuugagucagucaagagcuuuuucuacggguugaaaaacaugcugaguggcauuuuuggaaauguguucaucggcauauuuuuauuccucgccccauucauccugcuuauucuguuuuucauguuuggguggcgcaucuuguucugcuuuaaguguugccggagaaccaggggacucuucaaauaucgccaucugaaggacgacgaagagacuggcuaccgaaagauuaucgagcggcuaaacaacaaaaaggguaaaaauaagcugcucgauggggaacgucuggcugacagaaggauagccgagcuguuuucuaccaaaacacacauugga

SEQ ID NO: 10588 - RNA, 2916 nt, Artificial Sequence
  derived and/or modified CDS sequence (opt3) from CCHFV(SPU415/85, Artificial)__DQ211635.1__Gn-4aa-Gc
agcgaggaauccgacggcgauugcaucucuagaacccagcugcucaggacagagacuacggaaauucacucagacaacuacgggggacccggugauaagauaaccaucuguaauggcaguacaauuguggaccaacggcuugggagcgagcugggaugcuauacuaucaaccgcgucaaauccuucaaguugugugaaaauucugccaccggcaaaucgugcgagauugauucaacaccuguuaagugucgacaggguuuuugcuuaaaaaucacccaggaggggcguggacaugugaagcugagcagaggcagugaaauaguacuagacgcuugugauuccaacugcgagaucaugauuccaaagggcacuggggacauccucguggauuguucuggaggucagcaacacuuccugaaagacaaucuuauugaucugggcugcccgaacauccccuugcucgggaagauggcaauauacauuuguaggaugagcaaucauccuaaaacaaccauggccuuucuguucugguuuuccuucggauaugucaucacgugcauucugugcaaggugaucuuuuaccucuuaaucguugcgggcacuguggguaaaaaguucaagcaguaucgggaacugcgcccacagaccuguacaauuugcgagacuauacccgucaacgcuaucgacgccgagaugcacgaucuuaauuguucauacaacauuugcccuuauugugcaaguagauugaccagcgacgggcuggccaggcaugugaugcagugcccaaaacggaaggaaaaaguagaggaaacagagcuauaccucaaucuggaacgcauccccuggguugugcgaaagcugcugcaagucucugaguccaccggaguggcuuugaaaagaucaagcuggcucacggugcuguuaguccugcucauaguuagucuuucuccugugcaguccgcaccaauuggcaggaagccgcuguuuuuggacagcaucguaaaaggcaugaagaaccuacuuaauucgacuucucucgagacaucccugucaaucgaagcccccuggggagcuauuaacgugcagaguaccuucaagccuacugucagcgccgcgaauaucgcacuuuccuggucuagcguggagcaccgggggaacaaaauucugguuucaggucguagugaauccauaaugaaguuggaggaacgcacaggcaucagcugggaucucgggguggaggacgccucugagucaaaacuguuaaccgucagugugauggaucugagccagauguacuccccaguauuugaauaucuaucuggagacagacaaguugaggaauggcccaaggcuacguguaccggcgauugcccugagaggugugguugcacaucgagcacuugucuccacaaagaauggccacauucccggaacuggcgaugcaaucccaccuggugcuggggcguggggacaggauguacuugcuguggccuggacgucaaggaucuuuucaccgacuacauguuugugaaguggaaagucgaguauauuaagacagaggccaucgugugcguugaauugaccucacaggagcgccaguguagucugaucgaagcagggacuagauucaaccucggaccggugacgauuacacugucugagccuaggaauauacaacagaaacuucccccagagaucauuacccugcacccucggaucgaagaggguuucuuugauuugaugcauguacagcgcguccucagcgcuuccacugugugcaagcugcagucauguacccacggcguucccggggacuuacaaguguaccacauuggaaaccugcuaaaaggcgauaaggucaauggucaucucauccacaagauagaaccacauuucaacacaagcuggaugucuugggacgggugcgaccuggauuauuacuguaauaugggcgacuggcccuccugcaccuauacuggagugacacagcacaaccaugccgcguuuguaaaucuuuugaacaucgagacggauuacaccaaaaauuuccacuuucacaguaagagagugacugcccauggcgacacaccucagcuggaucucaaagcaaggccaaccuacggggcuggagaaguuacaguccugguggagguggccgacauggaguuacacacuaagaaaauugaaaucagcggucugaaguucgcuucucuuaccuguacgggcugcuaugccugcuccucagggauuaguuguaaggucaaaauccauguugaugagccggacgaauugaccgugcacguaaagagcgaggaucccgacauaguggcagccggaucgucccucauggcucguaaacuggaauuuggcgcggauucuacauucaaggcauuuagcgccaugccuaaaacuucacuaugcuucuacauugucgagcgggaguauuguaagaguugcucccgagaagacaccagaaaaugugugaacacaaagcuggauaggccacagucuauccucauugagcacaaggguacuaucauagggaaacaaaauaauaccugcacggcuaaggccagcuguuggcuggaauccguuaaaucauuuuucuacggccuuaagaacauguugagcggaaucuuuggcaacguguucauugggaucuuccuguuuauugcacccuucgucuuacucauccuguuuuucauguuuggauggcgcauacuuuucugcuuuaaauguugccggagaacaaggggccuguucaaguaucgccauuugaaggacgacgaggaaaccgguuaccgaaaaauuaucgagcggcucaacaauaagaaagggaagaacaaacugcuagauggagagcgucuggccgacagaaagaucgcugaacucuuuaguacuaagucucacauuggc

SEQ ID NO: 10589 - RNA, 2916 nt, Artificial Sequence
  derived and/or modified CDS sequence (opt3) from CCHFV(Turkey200310849, Artificial)__DQ211636.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagguugacuccacaccagugaagugucgacaggguuuuugcuuaaaaauuacccaggaggggcguggacauguaaagcugucuagaggcucggaagugguccuagaugcaugugacucaagcugcgaggugaugaucccgaagggcacuggggauauacucguugacuguaguggaggucagcaacacuuccugaaagauaaccuuaucgaccugggcugcccccauauuccuuugcucgggaagauggccaucuacauuuguaggauguccaaucacccacggacaaccauggcguuucuguucugguuuucuuucggauaugugaucacgugcauaagcugcaaagcucuguuuuacucccucauuaucauuggcacuuuagguaagaaaaucaagcaguaucgcgaacugaagccccagaccuguacaaucugcgagacugccccugucaacgcaauugaugccgagaugcaugaccuuaauuguucauacaacauaugcccauauugugcuaguagauugaccagcgacgggcuggcaaggcacgugacacagugccccaaacggaaggaaaaaguagaggaaaccgagcuauaccucaaucuggaacgcaucccuuggauuguucgaaagcugcugcaagugucugaguccacgggagucgccuugaaaagaucaagcuggcucaucgugcuguuagugcugcucacugucagucuuucuccaguucaguccgcuccggugggcaggaagccccuguucuuggauagcauaguaaaaggcaugaagaaccuacuuaauucgacaucucucgagaccucccugucaauugaagccccuuggggagcgaucaacgugcagaguacuuuuaagccagcagucagcacagccaauaucgcucuuuccuggucuagcguggagcaccgggggaacaaaauucugguuaccggucguucagaaaguaucaugaaguuggaggaacgcacgggcguguccugggaccucggggucgaggaugccagcgagucuaaacuguuaaccgugucaauuauggaccugagucagauguacagccccguauucgaauaucuauccggagauagacaaguugaggaauggccuaaggcaacauguacuggcgacugcccagagaggugugguugcaccucuucgacaugucuccauaaagaauggccccacagccggaauuggcgaugcaacccgacuuggugcuggggcguggggaccggauguacaugcuguggcgucgaugugaaggaccuguuuaccgaucauauguucgucaaguggaaaguggaguacauaaagacugaggcuaucguuugcguggaacuuacgucccaggagcgccaguguucauugauugaagccgggacaagauuuaaccugggaccuguaaccaucacucucagugagcccaggaauauccaacagaaacugccaccugagauuauaacccuucaccccaagaucgaagaggguuucuucgaccugaugcacguccagaaaguguugucugcgagcacaguuugcaagcuccaguccuguacccauggcauuccaggggaucugcaaguguaucacaucggaaacuuacugaagggcgaccgggucaauggucaucuaauucacaaaaucgaaucacauuuuaacacuagcuggaugucuugggacgggugcgaucucgacuacuauuguaauaugggcgauuggcccuccugcacauacacgggagugacccagcacaaccacgccgcauucguaaaucugcuuaacauagagacugacuauacaaagaccuuucauuuccacaguaaacgcgugacagcucauggcgauacuccucaguuggaccugaaggccagaccaaccuacggggcuggagaaaucacgguucucgucgagguggccgauauggagcugcacaccaaaaagguggaaauuagcgguuuaaaguuugcaucucuggccuguacaggcugcuacgcuugcuccucagggaucaguuguaaagucaggauucacguugacgagccggaugaacuuacugugcaugugaaguccucggaccccgauguagucgcggcauccaccucuuugauggcccguaaacucgaguucggaacagacagcacuuuuaaggcuuucucagccaugccuaaaaccagucugugcuuuuauaucguggaacgggaguacuguaaguccugcucugaggaugacacgcagaaauguguugacacacgacuagaacaaccacagagcauacugauugagcacaagggcaccaucauugguaagcagaaugauacuugcacagcaaaagccuccuguuggcucgaaucagucaagagcuucuuuuaugggcugaaaaacaugcuuggcaguguguucggaaauuuguuuaucggcauacuguuauuccucgcucccuucgugcugcuuguucuguuuuucauguuuggguggaagaucuuguucugcuuuaaauguugcagaaggacccgcggacucuucaaguaccggcaucugaaggacgaugaggaaacuggcuauagaaggauuaucgagcgccuaaacucuaaaaaggguaaaaaucgacugcucgacggggaucggcuggccgaccguaagauugcagagcuuuuuagcaccaaaacacacaucgga

SEQ ID NO: 10590 - RNA, 2916 nt, Artificial Sequence
  derived and/or modified CDS sequence (opt3) from CCHFV(Iran-52, Artificial)__DQ446215.1__Gn-4aa-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugcgaucguucaaauugugugaaaauuccgcuacugguaagucuugcgagauugauucgaucccuguaaaauguaagcagggguacugcuuaaaaauuacccaggagggacguggccaugugaagcugucaagaggcagcgaagucgugcuagacguuugugauaguuccugcgaggugaugaucccaaaggggacaggagacauacucgucgauuguucugguggccagcaacacuuucugaaagacaaccuuguggaucuggggugcccgaagauccccuugcucggaaaaauggcaauuuauaucuguaggaugagcaaucauccuaagaccacuauggccuuccuguuuugguucuccuuuggcuacguaauuacaugcauccugugcaaagcgauauucuuucucuuaauuaucuucgguacccuggggaagcgguuuaagcaguaucgcgaacuuaaaccacagacguguacuauuugcgagaccacacccguuaacgcuaucgacgccgagaugcacgauuugaauuguucauacaacaucugcccuuauugugcaaguagacugacuagcgacggacuagccaggcaugugacccagugcccacggcgcaaggaaaaagucgaggaaacagagcucuaccugaaucuugaacgaauacccuggguggugagaaagcuguugcaagucucugaguccaccggcacgguucucaaaaggucaagcuggcugauuguguuacugguacucuucacugugagucuuucuccuguccaguccgcuccaaucggccggcguccgcuguuuuuggacagcauugugaaggggaugaaaaaccuacugaauagcacaucucucgagaccucccugucaaucgaagcacccuggggagccauaaacguucagaguacuuacaagccuacagugagcaccgcuaauauugcccuuuccuggucuagcgucgagcaccgcgguaacaaggugcugguaucaggcagaagugaauccaucaugaaauuggaggaaaggacggggaucagcugggaucucggaguugaggacgcgucugagucaaagcuguuaaccgugagugucauggaucugagccagauguauuccccaguguucgaauaccuaucuggcgaccggcaagucgaggaauggcccaaagcaacauguacuggugauugcccugagcgaugugggugcaccucgagcacaugucuccacaaggaauggccacauucccgcaauuggagaugcaaccccacuuggugcuggggcgugggaaccggcuguacaugcugugggcuggacguuaaagaucuuuuuaccgacuauauguucgugaaguggaagguagaguacauuaaaacugaggccaucgucugcguggaauugacgucacaggagaggcaguguagucugauugaagcuggaacacgguucaaccucgguucuguuaccauaacucugagcgagccgcgcaauauccaacagaagcucccucccgagauuaucacccugcacccaaaaaucgaagagggcuuuuucgauuugaugcaugugcagaagguccucuccgccucaacagugugcaaacugcagagcuguacccacgggguaccuggagacuuacaaguguaucacauuggcaaccugcuaaagggugauagaguuaaugggcaucucauacacaagaucgaacagcauuuuaacacuucuuggauguccugggacggcugcgaccuggauuacuauuguaauaugggagacuggcccaguugcacauacacgggcgucacccagcacaaccaugcuagcuucgugaaucuuuugaacauugagacugauuacacaaaaaccuuucacuuccacucuaagagggugacagcacauggggacacuccacagcuggaucucaaagcccgucccaccuauggagcgggugaaaucacgguccugguugagguggccgacauggaguuacacaccaagaaaauugaaaucuccggccugaaguuugcagggcuuacauguacuggaugcuacgcuugcucaaguggcauaagcuguaaggugcggauccauguagaggaaccugaugaguugaccguccacgugaaaucggacgauccagacguuguggccgcuuccucuagccucauggcccgaaagcuggaauuugguacagauucaacuuuuaaagcauucagugccaugccgaagaccucccuaugcuuuuauauugucgagagagaguacuguaaaucuugcagcaaggaagacacgcaaaaaugugugaauacaaagcuggagcagccccaguccauccucauugaacacaaggggaccaucauaggcaaacagaacaauacuugcacagcuaaggcgucauguuggcuggagagcguuaaaaguuucuuuuauggacuuaagaacauguugggcgggauuuucggaaauguguucaucggcauuuuuaccuuccugacuccuuuuaucuuacucauacuguucuuuauguucgguuggaggauccuuuucugcuucaaauguugccgccggaccagagggcuguuuaaguacaggcauuugaaggaugacgaagagacaggauaucgcaaaauuaucgagcgacucaacaauaagaaaggcaagaaccggcugcuagacggugaacgucuggcagauagaaaaauugccgagcuuuucucuacgaagacccacaucggc

SEQ ID NO: 10591 - RNA, 2916 nt, Artificial Sequence
  derived and/or modified CDS sequence (opt3) from CCHFV(Iran-53, Artificial)__DQ446216.1__Gn-4aa-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugcguagcuucaaauugugugaaaauuccgcuacugguaagucuugcgagauugauucgaucccuguaaaauguaagcagggguacugcuuaaaaauuacccaggagggacgaggccaugugaagcugucaagaggcagcgaagucgugcuagacguuugugauaguuccugcgaggugaugaucccaaaggggacaggagacauacucgucgauuguucugguggccagcaacacuuucugaaagacaaccuuguggaucuggggugcccgaagauccccuugcucggaaaaauggcaauuuauaucuguaggaugagcaaucauccuaagaccacuauggccuuccuguuuugguucuccuuuggcuacguaauuacaugcauccugugcaaagcgauauucuuucucuuaauuaucuucgguacccuggggaagcgguuuaagcaguaucgcgaacuuaaaccacagacguguacuauuugcgagaccacacccguuaacgcuaucgacgccgagaugcacgauuugaauuguucauacaacaucugcccuuauugugcaaguagacugacuagcgacggacuagccaggcaugugacccagugcccacggcgcaaggaaaaagucgaggaaacagagcucuaccugaaucuugaacgaauacccuggguggugagaaagcuguugcaagucucugaguccaccggcacgguucucaaaaggucaagcuggcugauuguguuacugguacucuucacugugagucuuucuccuguccaguccgcuccaaucggccggcguccgcuguuuuuggacagcauugugaaggggaugaaaaaccuacuuaauucgacaucucucgagaccucccugucaaucgaagcacccuggggagccauaaacguucagaguacuuacaagccuacagugagcaccgcuaauauugcccuuuccuggucuagcgucgagcaccgcgguaacaaggugcugguaucaggcagaagugaauccaucaugaaauuggaggaaaggacggggaucagcugggaucucggaguugaggacgcgucugagucaaagcuguuaaccgugagugucauggaucugagccagauguauuccccaguguucgaauaccuaucuggcgaccggcaagucgaggaauggcccaaagcaacauguacuggugauugcccugagcgaugugggugcaccucgagcacaugucuccacaaggaauggccacauucccgcaauuggagaugcaaccccacuuggugcuggggcgugggaaccggcuguacaugcugugggcuggacguuaaagaucuuuuuaccgacuauauguucgugaaguggaagguagaguacauuaaaacugaggccaucgucugcguggaauugacgucacaggagaggcaguguagucugauugaagcuggaacacgguucaaccucgguucuguuaccauaacucugagcgagccgcgcaauauccaacagaaacuuccucccgagauuaucacccugcacccaaagaucgaagagggcuuuuucgauuugaugcaugugcagaagguccucuccgccucaacagugugcaaacugcagagcuguacccacgggguaccuggagacuuacaaguguaucacauuggcaaccugcuaaagggugauagaguuaaugggcaucucauacacaagaucgaacagcauuuuaacacuucuuggauguccugggacggcugcgaccuggauuacuauuguaauaugggagacuggcccaguugcacauacacgggcgucacccagcacaaccaugcuagcuucgugaaucuuuugaacauugagacugauuacacaaaaaccuuucacuuccacucuaagagggugacagcacauggggacacuccacagcuggaucucaaagcccgucccaccuauggagcgggugaagucacgguucugguggagguggccgacauggaguuacacaccaagaaaaucgaaauuuccggccugaaguuugcagggcuuacauguacuggaugcuacgcuugcucaaguggcaucagcuguaagguacggauacaugucgaugagccugacgaauugaccgugcacguuaaaucggaugacccagauguggucgccgcuuccucuagccucauggcccgaaagcuggaguucgguacagacucaacuuuuaaagcauucagugccaugccgaagaccucccuaugcuuuuauaucguggaaagagaguacuguaaaucuugcagcaaggaggauacgcaaaaauguguuaauacaaagcuggaacagccccaguccauucucaucgagcacaaggggaccauuaucggcaaacagaacaauacuugcacagcuaaggcgucauguuggcuggaaagcgugaaaaguuucuuuuauggacuuaagaacauguugggcgggauauucggaaauguauucauuggcaucuuuaccuuccugacuccuuuuauuuuacucauccuguucuuuauguucgguuggaggauacuguuuugcuucaaauguugccgccggaccagagggcuguuuaaguacaggcauuugaaggacgacgaggaaacaggauaucgcaaaaucauugagcgacucaacaauaagaaaggcaagaaccggcugcuagauggugagcgucuggcagacagaaaaaucgccgaacucuucucuacgaagacccacauuggc

SEQ ID NO: 10592 - RNA, 2916 nt, Artificial Sequence
  derived and/or modified CDS sequence (opt3) from CCHFV(Kosova Hoti, Artificial)__EU037902.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccagaaggggcguggacaugugaagcugucuagaggcucggagguagugcuagaugcaugugacucaaacugcgaagucaugauaccgaaaggcacuggggauauccucguggacuguagcggaggucagcaacacuuccugaaggauaaucuuauugaccugggcugcccccauaucccuuugcucgggaaaauggccauuuacaucuguaggaugaguaaccacccaaagacaaccauggcguuucuguucugguuuuccuucggauauguuauaacgugcaucuuuugcaaagcucuguucuacucucucauuauuaucggcacuuuagguaagaagaucaaacaguaucgggagcugaagccccagaccuguacaauuugcgaaacugccccugugaaugcaauagaugccgagaugcaugaccuuaacuguagcuacaauaucugcccauauugugcuucccgcuugaccucagacgggcuggcaagacacgucaaacagugccccaagaggaaagagaagguggaagagacagaacuauaccucaaccuggagcggauuccuuggguaguucgcaaacuucugcaagugagugaaagcaccggagucgccuugaagcgaucuuccuggcucaucgugcuguuagugcugcucacggucucacuuagcccaguucagagugcuccggugggcagaaagccccuguuuuuggauucuauaguaaaaggcaugaagaaucuacugaacuccacuagccucgagacaucgcugucuauugaggccccuuggggagcgaucaaugugcaguccaccuucaaaccaacugucucaacagcaaacaucgcccuuaguuggagcuccguggaacacagggggaauaagauucugguuaccggucggucugagagcaucaugaaauuggaggaacguacgggcauuucaugggaccucgggguggaagaugcuagugaguccaagcuguuaaccgucagcauaauggaccugucucagauguacucacccguguuugaguaucuaaguggagaucgccaaguagaagaguggccuaaggccacauguacuggcgacugcccacagagaugugguugcaccagcuccacaugucuccauaaagaauggccccacucuaggaacuggcggugcaacccgacuuggugcuggggcguugggaccggauguacaugcuguggcguggaugucaaggaccuguucaccgaucauauguuugugaaauggaaggucgaguacaucaaaacugaagcaauugugugcguugagcuuacgucgcaggagcgacaauguagcuugaucgaagcugggacacgcuucaaucugggaccugugaccaucacucucuccgagcccagaaacauucagcagaagcugccaccugaaauaaucacccuucaccccaagauugaggaggguuucuuugaccugaugcacguacagaaagucuugucagccaguacagugugcaagcuccaaucuuguacccauggcaucccaggggaucugcagguuuaucacauuggaaauuuacugaaaggcgacagggugaacggucaucuaauccacaagauagaaccccauuucaauacuagcuggauguccugggacgggugcgaucucgacuacuauuguaacaugggcgauuggccuucaugcacauacacgggagucacccagcacaaucacgcggccuuugugaaccugcuuaauaucgagacugacuauacaaaaaccuuccauuuucacagcaagcggguaacagcacauggcgauacuccacaguuggaccugaaggcucgcccgaccuacggggccggagaaauuacggugcucguugaggucgcugauauggaacugcacaccaaaaagguggagaucucugguuuaaaauucgccucccuggcauguacaggcugcuacgccugcaguagcgggauuucuuguaaggugagaauccacgucgacgagcccgaugaacuuacuguucaugugaaauccucagacccugaugugguagcugcgggaaccaguuugauggcaaggaagcucgaguuuggcacagacagcacuuucaaagccuuuucggcuaugccaaagaccucccugugcuucuauauagucgaaaaggaguacuguaaaucuugcagcgaagaugacacgaagaaauguguggacacaaagcuagagcaaccccagucaauucugaucgagcaccgugguaccauuaucgggaaacagaacgauacuugcacagccaaggcaaguuguuggcucgaauccguuaagagcuuuuucuauggccugaaaaauaugcuuggaucuguguuuggcaacuucuucauagggaucuugcuguuuuuagccccuuucguccuccuggugcuguuuuucauguuuggauggaagauucuuuucugcuuuaaauguugccggcgaaccagaggcuuguucaaguacaggcaucucaaagacgaugaggaaacugguuaucgccggaucauugagagacugaauaacaagaaggggaaaaauaggcuacuggacggagaacgccucgcugaucgaaagaucgccgagcuguuuuccaccaaaacacacauaggc

SEQ ID NO: 10593 - RNA, 2916 nt, Artificial Sequence
  derived and/or modified CDS sequence (opt3) from CCHFV(YL04057, Artificial)__FJ562094.1__Gn-4aa-Gc
gccgagggcgggagcuccgacugcaucucuagaacccagcuggugaagacagaagucgcugagauucacgaagauucauacggaggucccggcgagaaaauaacuaucuguaacgggaguacgauuguugaccaaaggcucggacgggaacuuggcugcuauaccaucaaucgcgugcgaagcuacaagcugugugagaacuccgcaucugguaaaucgugcgagauugauucaaucccuguaaaguguaaacagggguucugcuugaagauaacacaggaaggacguggccaugugaaguuaagcagaggcacugagaucguccuggacgugugugauaguuccugcgaacuaaugauuccaaaagggaccggagacauccucguugauuguucugguggccagcaacacuuucugcagaauaaccuuauugaccuggggugcccgaaugugcccuugcucggaaagauggccaucuaugucuguaggaugagcaaccauccuaaaacaaccauggcguuccuguuuugguucuccuuuggcuacgugauaacuugcauugcuugccggguacuguucuaucucuuaaucgccauugguacaguugggaagaaacugaagcaguaccgcgagcuuaagccacagaccuguaucgugugcgagucaguccccgugaaugcaaucgaugccgaaaugcacgaguugaacuguaguuauaauauuugcccuuacugugcuagcagacugucuacggacggacuaauaaggcaugugacucaaugcccaaaacggcgcgaaaaggucgaggaaaccgagcucuuucugaaccuugagcgaauccccuggcugguuagaaaauugcuccagguguccgaaucaacaggcauggcacugaagaggagcuguuggaugauuacuuuacugauccuccuucugguaaguauaucuccugugcaguccgccccagucggccggaaaccguuguuccuagauagcauugcuaaggggaaaaagucgcugcucaauucuaccucccuggagacaucacuuaguaucgaagcccccuggggagcgaucaacgugcagagcaccuuuaagccuacgguuuccgcagccaauauugcucugucuuggagcucaguggagcaccgugguaacaaaaucuuggucaguggccgcuccgaaagcauuaugaagcucgaggagagaacuggggugucuuggaaucugggaguagaagacgccucagagaguaaaacauuaaccguuagcgugauggaucugucccaaauguacucuccagucuucgaauaucuaucgggcgacaggcaaguggaggaauggcccaaggcaacuugcacaggugacuguccugagcggugcggguguaccagcuccacgugccuccacaaagaguggccacauucacgaaacuggcgcugcagucccaccugguguuggggcgucggaacaggcugcacuuguugcgggcuggaugugaaggacuuuuucaccgauuacaugcuuguuaaguggaaaguggaauauauaaagacagaggcuaucguaugugucgaauugacuucucaggagagacagugcagccugauugaggccggaaccagguuuaaccucgguccggugacaaucacccuguccgaaccucggaauguucagcagcgccuucccccagagaucgugacucugcacccuaaaauugaagagggcuucuucgacuugaugcauguccagaagauacucucagcgagcacgguguguaaacugcaaucuugcacacacgggguacccggagauuuucagguguaccacguuggcaacuuacugagaggugacaaggucaaugggcauuccauccacaagauugaaccacauuucaacaccaguuggaugagcugggauggcugugaccuagauuauuuuugcaauaugggagacuggcccucuuguacuuacaccggcgugacacagcacaacagggccgcauucaucaauaugcucaacauugagaccgauuauacuaaaacauuucauuuccacuccaagcgugugacggcucacggggacaccccucagcuggaccuuaaagcccggccagcuuacggagccggugaggucacuguuuugguggaaguggcagaucuggagcuccauacaaagaaacuggaaguaucaggcuuaaagaucgccagucugaccugcagcgggugcuacgcuuguucguccggaauaucuugcaagguccgaauccacgugaaugagccggacgaauuuacaguucaugugagaagcucagaucccgacgucguggcggcaggcaguucccuuauggccaggaaaauugaguucggugcugauucuacuuuuaaggccuucagcuccaugccuaaagacucauuguguuuuuauaucguugagaaggauuacugcagcaguuguaccgacgaugacacgcaaaaaugcgugaacaccaagcucgaucacccacagucuauucugaucgaacacaaagggacaauaauuggcaagcagaaugacacuuguuccaccaagacaagcugcuggcuagagucgguaaaaggauucuuuuauggccugaagaacaugcucucagggaucuucggaaaugucuuccugggcauucuuuuguuucuggcacccuucguguuacucaucuuuuucuuuuucuuugguuggcgccugcuuuucugucugaaaugcugucggagaacuaggggguugcucaaguacaaacaucugaaggaugaagaggaagccggauauaagaaaauaaucgagcgccuaaacggcaagaaagguaagucucagcuguuugacggcgagcgacucgcugaccggaaaauugccgaacuguucaguaccaagauccacauuggg

SEQ ID NO: 10594 - RNA, 2916 nt, Artificial Sequence
  derived and/or modified CDS sequence (opt3) from CCHFV(V42/81, Artificial)__GU477490.1__Gn-4aa-Gc
agcaaggagcccggcgacgauugcaucuccagaacccagcugaugaggacagaaacugccgagauucacgacgauaacuacgggggaccuggugacaaaauaacgaucuguaauggcucuaccauuguggaucaacggcucgggucagaacuuggaugcuauacaaucaaccgcgucaagaguuucaaacugugugagaauagcgcuacuggcaaggcaugcgaaguugacuccaccccagugaaaugucgacaggguuuuugcuugaagauuacacaggaggggcguggacauguaaaguuaucuagaggcucggaggugguccuggaugccugugacucaagcugcgaagugaugaucccgaaaggcaccggggauauccuaguugacuguaguggaggucagcaacacuuccucaaggauaaccugaucgaccuugagugcccccauauuccucuguugggcaaacucgcgaucuacauuuguaggauguccaaucacccacggacuacaauggcuuuucuguucugguuuggguucggauaugugauaaccugcauacugugcaaggcccucuuuuacucuuuaauuaucauuggcacgcuggguaaaaagaucaagcaguaucgcgaacuuaaaccccagacuuguaccaucugcgagacagcaccugucaacgccauugaugcugagaugcaugacuugaauuguagcuacaacauaugcccauauugugcauccagacugacuucagacgggcuagccaggcacgugacccagugccccaagcggaaagaaaagguagaggaaacagagcucuaccugaaucuugaacgcaucccuuggauuguucgaaaacuguugcaagugagugagagcaccggagucgugcucaagagaucuuccuggcugaucguguuacugguccuccuuacgguuucacugagcccagugcagagugcuccgguaggcaggaaacccuuguuccuagauucuauagugaagggcaagaaaaaccugcucaauuccacuagccuggagacaucgcuuucuauugaagccccuuggggagcgaucaacauccaguccaccuuuaagccaacugucucagcagccaauauugcucugaguuggagcuccguggagcaccgggggaacaaaaucuugguuucuggucguagcgaaucaauuaugaagcucgaggaacgcacaggcgugaguuggaaucugggggucgaggacgccuccgagagcaaauuacugaccgugucuauaauggaucuaucacagauguacagucccguauucgaauaucucagcggagacagacaaguugaggaauggccuaaggcaacguguaccggcgauugcccagagaggugugguugcacauccucuacuugucugcauaaggaauggccccacucgcggaacuggcgaugcaacccgaccuggugcuggggcguggggacaggauguacuugcuguggcgucgacgugaaagaucuuuuuaucgaccauauguucgucaaguggaaaguggaguacauuaagaccgaggcuaucguuugcguggaauugacaagccaggagcgccaguguucccugaucgaagccgggaccagauuuaaucucggaccuguaacuauuacgcugucagagcccaggaacauacaacagaaacuuccaccugagaucauuacacugcaccccaagaucgaagaggguuucuucgauuugaugcacguccagaaggugcucagugcgucuaccguuugcaaacugcagagcuguacucauggcauuccaggggacuuacaaguguaucacaucggaaaucugcuaaagggcgaucgggucaacggucaucucauacacaaaaucgaaccccauuuuaauaccuccuggaugucaugggacgggugcgaccuggauuacuauuguaacaugggcgacuggccuagcugcacauacaccggagugacucagcacaaucacgccgcauucguaaaccuuuugaauauugagacagauuauacgaagaccuuucauuuccacucuaaacgcgugacugcucauggcgaaacaccacagcuggaccucaaggccagaccggcuuacggggccggagagaucaccguucuggucgagguggcagauauggaauuacacacaaagaaaguggagauuuccggucugaaguuugccagucuugcuuguacuggcugcuacgcgugcagcucugggaucuccuguaaagucaggauacacguugacgaacccgaugaguugaccgugcaugugaagucaaacgacccugauguagucgcagccaguacgagccucauggcucguaaacuggaaucgggaaccgacuccacauucaaggccuuuucugcaaugccaaaaacuagccuaugcuucuauauuguggagcgggaguacuguaagucaugcagugaagaugacacccagaaguguguugagacaaaacuggaacaaccccaguccauccucauugagcacaagggcacuaucauagguaaacagaaugauaccugcacggccaaggcuucuuguuggcuggaaagcgugaaauccuuuuucuaugggcuuaagaacauguugggcucagucuuuggaaauuucuuuaucggcauucuguuauuccucgccccuuucgugcugcuuguucuguuuuucauguuuggguggaagaucuuguucugcuuuaaauguugccgaagaacaaggggacucuucaaguaccgccaucugaaagaggacgaggaaaccggcuaucggagaauuaucgagaggcuaaacagcaagaaagguaagaaucgccugcucgacggggaacgacuggcagaucggaagauagcggagcuuuuuaguacuaaaacacacauugga

SEQ ID NO: 10595 - RNA, 2916 nt, Artificial Sequence
  derived and/or modified CDS sequence (opt3) from CCHFV(79121M18, Artificial)__GU477493.1__Gn-4aa-Gc
gccgagggcgggagcuccgacugcaucucuagaacccagcuggugaagacagaagucgcugagauucacgaagauucauacggaggucccggcgagaaaauaacuaucuguaacgggaguacgauuguugaccaaggacucggcagcgaacuugguugcuauaccaucaauagggugcgguccuacaagcugugugagaacucugcaucggggaaaucaugcgagauugauagcaucccuguaaaguguaaacagggauucugcuugaagauaacacaggaaggccgcggccaugugaaguuaagucgagggacugagaucguccuggacgugugugauuccucuugcgaacuaaugauuccaaaaggaaccggugacauccucguugauuguagcggcgggcagcaacacuuucugcagaauaaccuuauugaccugggaugcccgaaugugcccuugcucggcaagauggccaucuaugucugucguauguccaaccauccuaaaacaaccauggcguuccuguuuugguucucauuugguuacgugauaacuugcauugcuugcagaguacuguucuaucucuuaaucgccauugggacaguuggaaagaaacugaagcaguacagggagcuuaagccacagaccuguaucgugugcgagaguguccccgugaaugcaaucgaugccgaaaugcacgaguugaacuguagcuauaauauuugcccuuacugugcuucucggcuguccacggacggccuaauacgccaugugacucaaugcccaaaaagaagggaaaaggucgaggaaaccgagcucuuucugaaccuugagcggauccccuggcugguucgcaaauugcuccaggugucagaaagcacaggcauggcacugaagcgaaguuguuggaugauuacuuuacugauccuccuucugguaucuauauccccugugcagagcgccccagucgggagaaaaccguuguuccuagauucgaccgcuaagggaaugaaaucucugcucaauuccacaucacuggagaccagucuuagcauugaagcccccuggggugcgaucaacgugcaguccacguuuaagccuacuguuucugcagccaauaucgcucugagcuggucaaguguggagcacaggggcaacaagauuuuggucuccgggcggagcgaaucuaucaugaaacucgaggagcguacaggagugucauggaaucugggcguagaagacgccagugagagcaagaccuuaacuguuuccgugauggaucugucucaaauguacucgccagucuucgaauaucuaagcggugaccgccagguggaggaauggcccaaagcaacaugcaccggggacuguccugagagaugcggcuguacguccucaaccugccuccacaaggaguggccacauaguaggaacuggcggugcaaccccacaugguguuggggagucggcacugggugcaccuguugcggacuggaugugaaagacuuuuucacagauuacaugcuuguuaaguggaagguggaauauauuaaaacugaggcuauaguaugugucgaauugaccucucaggagcgacaaugcagccugaucgaggccgguacacgcuuuaaucucggcccggugaccauuacucuguccgaaccuagaaacguucagcagaggcuucccccagagaucgugacgcugcacccuaagaucgaagagggguucuucgacuugaugcauguccagaaaauucucucagcgagcacaguguguaagcugcaaucuugcacccacggaguacccggcgauuuucagauauaccacguggguaauuuacugcgcggggacaaaguuaacggccauuccauccacaagauugaaccacauuucaauaccaguuggaugagcugggauggaugugaccuagauuauuuuugcaacaugggcgacuggcccucuuguacuuacacaggggucacccagcacaaucgggccgcauucaucaacaugcucaauauugagacugauuauacaaagacguuucauuuccacuccaaaagagugaccgcucacggagacacuccucagcuggaccuuaaggccaggccagcuuacggugccggcgaggugacagucuugguugaaguggcagaucuggagcuccauaccaaaaagcuggaagugucaggguuaaaaaucgccagucugacaugcagcggaugcuacgcuuguucguccggcauaucuugcaagguacguauccacgucaacgagccggacgaauuuacugugcauguucggagcucagaucccgacguggucgcggcagguaguucccuuauggcccgaaagauugaguucggggcugauucuaccuuuaaagccuucagcuccaugccuaaggacucauuguguuuuuauaucguggagaaagauuacugcagcaguuguacggacgaugacacccaaaagugcguuaauacaaaacucgaucacccacagucuauucugaucgaacacaagggcacuauaauuggaaaacagaacgacaccuguuccacaaagacuagcugcuggcuagagucggugaagggcuucuuuuaugggcugaaaaauaugcucucaggaaucuucggcaacguauuccuggguauuuuucuuuucuuggcacccuuuguccuguuaaucuucuuuuucuuuuucggguggagacuccuguuuugucuuaagugcuguaggcgcacccggggacuguugaaauacaagcaucucaaagaugaagaggaagccggcuauaagaagauaaucgagagacugaaugguaaaaagggcaaaucucagcuauucgacggggagaggcuggcugaccgcaagauugccgaacucuuuaguacgaaaauccacauugga

SEQ ID NO: 10596 - RNA, 2916 nt, Artificial Sequence
  derived and/or modified CDS sequence (opt3) from CCHFV(Afg09-2990, Artificial)__HM452306.1__Gn-4aa-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugcguagcuucaaauugugugaaaauuccgcuacugguaagucuugcgagauugauucgaucccuguaaaauguaagcagggguacugcuuaaaaauuacccaggagggacgaggccaugugaagcugucaagaggcagcgaagucgugcuagacguuugugauaguuccugcgaggugaugaucccaaaggggacaggagacauacucgucgauuguucugguggccagcaacacuaucugaaagacaaccuuguggaucuggggugcccgaagauccccuugcucggaaaaauggcaauuuacaucuguaggaugagcaaucauccuaagaccacuauggccuuucuguucugguuuuccuucggcuauguaauuacaugcauccugugcaaagcgauauuuuuccucuuaauuaucuuugguacccuggggaagcgguucaagcaguaccgcgaacuuaaaccacagacguguacuauuugcgagaccacacccguuaacgcuaucgacgccgagaugcacgauuugaauuguucauauaacaucugcccuuacugugcaaguagacugacuagcgacggacuagccaggcaugugacccagugcccacggcgcaaggaaaaagucgaggaaacagagcucuaccugaaucuugaacgaauacccuggguggugagaaagcuguugcaagucucugaguccaccggcacgguucucaaaaggucaagcuggcugauuguguuacugguacucuuuacugugagucuuucuccuguccaguccgcuccaaucggccggcguccgcuguucuuggacagcauugugaaggggaugaaaaaccuacuuaauucgacaucucucgagaccucccugucaaucgaagcacccuggggagccauaaacguucagaguacuuauaagccuacagugagcaccgcuaauauugcccuuuccuggucuagcgucgagcaccgcgguaacaaggugcugguaucaggcagaagugaauccaucaugaaauuggaggaaaggacggggaucagcugggaucucggaguugaggacgcgucugagucaaagcuguuaaccgugagugucauggaucugagccagauguacuccccaguguuugaauaucuaucuggcgaccggcaagucgaggaauggcccaaagcaacauguacuggugauugcccugagcgaugugggugcaccucgagcacaugucuccacaaggaauggccacauucccgcaauuggagaugcaaccccacuuggugcuggggcgugggaaccggcuguacaugcugugggcuggacguuaaagaucuuuucaccgacuacauguuugugaaguggaagguagaguauauuaaaacugaggccaucgucugcguggaauugacgucacaggagaggcaguguagucugauugaagcuggaacacgguucaaccucgguucuguuaccauaacucugagcgagccgcgcaauauccaacagaagcugccucccgagauuaucacccugcacccaaaaaucgaagagggcuucuuugauuugaugcaugugcagaagguccucuccgccucaacagugugcaaacugcagagcuguacccacgggguaccuggagacuuacaaguguaccacauuggcaaccugcuaaagggugauagaguuaaugggcaucucauacacaagaucgaacagcauuucaacacuucuuggauguccugggacggcugcgaccuggauuauuacuguaauaugggagacuggcccaguugcacauacacgggcgucacccagcacaaccaugcuagcuuugugaaucuuuugaacauugagacugauuauacaaaaaccuuccacuuucacucuaagagggugacagcacauggggacacuccacagcuggaucucaaagcccgucccaccuacggagcgggugaaaucacgguccugguugagguggccgacauggaguuacacaccaagaaaauugaaaucuccggccugaaguucgcagggcuuacauguacuggaugcuaugcuugcucaaguggcauaagcuguaaggugcggauccauguagaugagccugacgaauugaccguccacgugaaaucggaugacccagauguuguggccgcuuccucuagccucauggcccgaaagcuggaguuugguacagacucaacuuucaaagcauuuagugccaugccgaagaccucccuaugcuucuacauugucgaaagagaguauuguaaaucuugcagcaaggaggauacgcaaaaaugugugaauacaaagcuggaacagccccaguccauccucauugagcacaaggggaccaucauaggcaaacagaacaauacuugcacagcuaaggcgucauguuggcuggaaagcguuaaaaguuucuuuuacggacuuaagaacauguugggcgggauuuuuggaaauguguucaucggcauuuucaccuuucugacuccuuucaucuuacucauacuguuuuucauguuugguuggaggauccuuuucugcuuuaaauguugccgccggaccagagggcuguucaaguauaggcauuugaaggacgacgaggaaacaggauaccgcaaaauuaucgagcgacucaacaauaagaaaggcaagaaccggcugcuagauggugagcgucuggcagacagaaaaauugccgaacucuuuucuacgaagacccacaucggc

SEQ ID NO: 10597 - RNA, 2916 nt, Artificial Sequence
  derived and/or modified CDS sequence (opt3) from CCHFV(Sudan Al-Fulah 3-2008, Artificial)__HQ378184.1__Gn-4aa-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaagagcuucaaauugugugaaaauuccgcuacuggcaaaucuugcguuauugauucggugccaguaaagugucgacaggguuacugcuuacguaucacccaggaggggagaggacaugugaaacugucaaggggcagcgaggucgugcuagacgcaugugauacaaguugcgaaauaaugaucccgaagggcaccggggacauucucguugauuguuccggaggucagcaacacuuucugaaggacaaccuuguggaucugggcugccccaaaaucccuuugcucgggaagauggccauuuauaucugucggaugucuaaucauccaaaaacuacaauggcguuccuguuuugguucagcuuuggauacgucauaaccugcauucugugcaaggcuaucuucuaucucuuaauuaucaucggcacgcuggguaaacgcuuuagacaguacagggagcuuaagccccagacuuguaccauuugcgaaacaacuccugugaacgccauagacgcagagaugcacgauuugaauuguuccuauaacaucugcccauacugugccucacggcugaccagugacgggcuagcucgccauguaacacagugccccaagcgaaaagagaagguugaagagaccgaacucuaccugaaucuugagcggauuccuuggguggucaggaaacuguugcaagugagcgaaucuacgggaguggcacucaagcgguccucauggcugaucgucuuacugguucucuucacugugagccuuaguccaguacagucugccccgauaggccgucgcccccuguuuuuggacuccauugugaaaggcaugaagaaccuacugaauagcacaucgcucgagaccucucuguccaucgaggcuccuuggggagccaucaacguccagucaacuuauaaaccaacagugaguaccgcgaauauugcacuuagcugguccucuguugaacacagagggaacaagauccuggugagcgguaggucagagaguauuaugaaguuggaagagagaacgggcauauccugggaucucggggucgaagacgccagcgagucuaaacuguuaaccgugucaguaauggaucugagucagauguacagccccguuuucgaguaucuauccggagaccgacaaguggaagaguggccuaaggcuacauguacuggcgauugcccagaacgcugugguugcaccucuucgacaugucuccacaaagaguggccccauagcagaaauuggaggugcaacccgacuuggugcuggggcgucgggaccggauguacaugcuguggccuggacgugaaggaucuuuuuaccgacuacauguucgucaaauggaagguggaauauaucaagacugaggccauuguuugcguggaguugacgucccaggaacggcaguguucacugaucgaggcagggacacgcuuuaaccucggaccuguaaccaucacucugagugaacccagaaauauucaacagaaacuuccaccugagauaaucacccugcaccccaggauugaggaagguuucuucgauuugaugcauguccagaaggugcucucugcuagcacaguuugcaaacugcaguccuguacccacggcgugccaggggacuuacaagucuaccacaucggaaaccugcuaaagggcgauaaagugaauggucaucucauucacaagaucgagccccauuuuaacacuucauggaugagcugggacgggugcgaccuggauuauuacuguaauaugggcgacuggccuucuugcacauacacgggaguaacccagcacaaccaugccuccuucgugaaucuuuugaacauagaaacugauuauacaaagaauuuucacuuccacaguaaacguguuaccgcgcauggcgacacaccacagcuggaucucaaggcccggccgacuuacggggcaggagagaucaccguccugguggaaguggcugacauggaguuacacacgaaaaagauugagaucagcggucugaaauuugccucucuuaccuguacaggcugcuaugcuugcuccucagggauuaguuguaagguccgaauccauguugaugaacccgacgaguugacugugcacguaaagagcgaugacccugauguggucgccgcaucguccucucucauggccagaaaacuggaauuuggaaccgacagcacauuuaaggcuuucucagcgaugccaaaaacuucccuaugcuuuuacauaguggagaaggaauauuguaaauccugcucugaggaggauaccaagaaauguguuaacacgaagcuggaacagccccaaagcauucucaucgagcacaagggcacaauuaucgguaaacagaauaguaccugcacugcaaaggugucauguuggcuggaaagcgccaaaaguuucuuuuacgggcuuaaggacauguugucuggcauauucggaaacgucuuuaucggcauuuuccuguucuuagcuccuuuugugcuccugguucuuuucuuuauguucggguggaggauccuguugugcuuucgcuguugccggagaacaaggggacucuucaaauaucgccaucugaaggacgaugaggaaaccggcuaccgacggauuaucgagcgucuaaauaacaagaaagguaagaauaaacugcucgacggggagagacuggccgauaggaagauagcagaacuuuucuccacuaaaacccacauugga

SEQ ID NO: 10598 - RNA, 2916 nt, Artificial Sequence
  derived and/or modified CDS sequence (opt3) from CCHFV(Sudan AB1-2009, Artificial)__HQ378187.1__Gn-4aa-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaaaucuuucaaguugugugaaaauuccgcuacuggcaaaaacugcgagauugauucuguuccagugaagugucgacaggguuacugcuuacguaucacccaggaggggagaggacauguaaaacugucgaggggcucagaagugguccuagacgcaugugauacaagcugcgagauaaugaucccgaagggcaccggggacauucucguggauuguaguggaggucagcaacacuuucugaaggacaaucuuaucgaucugggcugccccaaaauuccuuugcucgggaagauggccaucuauauaugucggauguccaaccauccaaaaacuacaauggcguuccuguuuugguucucuuuuggauaccugauuaccugcauccucugcaaggcuauuuucuauuuacugaucaucauuggcacgcuugguaaacgcuugaagcaguacagagaacugaagccccagacuuguaccauaugcgagacaacuccuguuaaugccaucgacgcagagaugcacgaucuaaacuguagcuauaauauuugcccauacugugccuccaggcucaccucagacgggcuggcucggcaugugauccagugccccaaacgcaaggaaaaagucgaggaaacagagcuuuaccugaacuuggaacgaauaccuugggugguaagaaagcuccugcaaguuagugagagcaccggaguggcauuaaaaaggucuuccuggcugauuguccuccuugugcuguuuacggugucauugagcccaguccagagugccccgaucggccggaagccccuauuccuggacucuaucgcuaaaggcaugaagaaucuccugaacuccacuagccuugagacaucgcugucuauugaagccccuuggggugcgaucaauguucaguccaccuauaagccaacugugucaacagcaaacauugccuugaguuggagcuccguagagcaccguggaaauaaaauacucgugucuggucgcagcgaaucaaucaugaagcuggaggaaagaaccggcauuaguugggauuuaggggucgaggacgcuuccgagagcaaacugcuaacggugucuguuauggaucucucacagauguacagucccguguuugaauaucugagcggagacaggcaagucgaggaauggccuaaggccaccuguacaggcgauugcccagagcggugugguugcacuuccucuaccugucuucacaaagaauggccccauucgcgaaacuggcgcugcaacccgacauggugcuggggcguggggacuggauguaccugcuguggcuuggacguaaaggaucuguucacagacuacauguuuguuaaguggaaaguggaguauaucaagaccgaggcaaucgucugcguggaacucacuagccaggagagacaguguucccugauugaagcugggacgagguucaaucuuggaccugucacaauaacccugucagagccccggaacauccaacagaaauugccaccugagauuaucacucuccacccccgcauugaagagggguuuuucgaucugaugcaugugcagaagguuuuaagugccucuaccgugugcaaacugcagagcuguacacacggcguaccaggggaccuacaagucuaccacaucggaaaucuccugaagggcgauaaggugaacggucaucuuauacacaaaaucgaaccccauuucaauaccuccuggaugucaugggacgggugcgacuuggauuauuacuguaacaugggcgacuggccuagcugcacuuacacaggaguuacgcagcacaaucaugcgucuuuugugaaccugcucaauauugagaccgauuauacuaagaacuuccacuuucacuccaaaagagucacagcccauggcgacaccccacagcuggauuuaaaggcaaggccgacauacggggcuggagaaaucacugugcugguagagguggccgacauggagcuucacaccaaaaagauugaaaucagugguuugaaguucgcuagccucacguguaccggcugcuaugccuguucuuccgggauaucaugcaaaguucguauucaugucgaugagcccgacgaacugacagugcacgugaagagugaugacccugaugucguugcagccagcucgucccuaauggcucggaaacuggaguuuggaacugacucuaccuucaaggcguuuagcgcaaugccaaaaacaucacucugcuucuacaucguggaacgagagcacuguaagaguugcaaugaggaagauacuaaaaagugugugaacaccaagcuggagcagccccaauccauucuuaucgaacauaaaggcacgauaaucgguaagcagaauagcacaugcaccgccagagcuagcuguugguuggaguccguaaaaucauuuuucuaugggcugaagaacauguuaagcggcauuuuuggaaaugucuucaugggcaucuuucucuuccuggccccuuucauucuucugaucuuguuuuucauguuuggguggaggauacucuucugcuuuaaauguugccgccggacuagaggacuguucaaguacaggcaccuaaaggacgacgaagagacaggcuaucgccgaauuaucgagcggcugaacaacaaaaaggguaaaaauaagcuccuggauggggaacgucuugcagacagaaggaucgccgaguuguuuaguaccaaaacucauauugga

SEQ ID NO: 10599 - RNA, 2916 nt, Artificial Sequence
  derived and/or modified CDS sequence (opt3) from CCHFV(NIVA 118595, Artificial)__JN572083.1__Gn-4aa-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugaaauccuucaaguugugugaaaauagcgcuacugguaaaucuugcgagauugauucgaucccuguaaagugucgacagggguacugcuuaaaaauuacccaggagggacguggccaugugaagcugucaagaggcagcgaagucgugcuagacgcaugugauaguuccugcgagguuaugaucccaaaggggacaggagacauacucguggauuguucugguggccagcaacacuuucugaaagacaaccuuaucgaucuggggugcccgaagauucccuugcucggaaaaauggccaucuauauuuguaggaugagcaaucauccuaagaccacuauggcguuccuguuuugguucuccuuuggcuacgucaucacaugcauacugugcaaagugauuuucuaucucuuaaucauuuuugguacccuggggaagcgguucaagcaguaccgcgaacuuaaaccacagacguguacuaucugcgagaccacacccguaaacgcuaucgacgccgagaugcacgauuugaauuguucauauaacauuugcccuuacugugcaaguagacugacuagcgacggacuagccaggcauguuacccagugcccaaagcggaaagaaaagguggaggaaacagagcucuaccugaaucuugaacgcauacccugggucgugcgaaaacuguugcaagugucugaguccaccggcaucgcucucaagagaucaagcuggcugauugucuuacugguucucuuuacggugaguaucacuccuguacagucugcaccaauaggcaggcggccgcuuuuccuggacuccauugugaaagggaugaagaacuugcuaaauagcacaucgcuggagaccucucucuccaucgaagcccccuggggagcuaucaacguccagucaacuuauaagccuacagugagugccgcgaauauugcacugagcugguccucuguugagcaccgugguaacaaaauccuugugagcggccgcucagaaaguauuaugaagcuggaggaaagaaccgggauauccugggauuugggagucgaggacgccagcgagucuaaacuccugacggugucaguaauggauuuaagucagauguacagcccaguuuuugaauaucuguccggcgacaggcaaguggaggaauggcccaaggcuaccuguacaggugauugcccugagcggugugggugcacuucuucgaccugucuacacaaagaauggccacauagccgaaauuggcgcugcaaccccacauggugcuggggcgucggaacuggcuguaccugcugugggcucgacgugaaggaucuguucacagacuacauguuugucaaguggaaaguggaguauaucaagaccgaggccauuguuugcguggaacuuacuucccaggagagacaguguucauugaucgaagcaggaacgagguucaaccuggguaguguaacaaucacccucucugagccgcggaauauucaacagaaacugccucccgagauaaucacucuucacccacgcauugaagagggcuucuuugaucugaugcauguccagaagguguugagcgcuuccaccguuugcaaacuccagucauguacacacggggugccuggagaccugcaagucuaccacaucggcaacuuacugaagggugauagagugaaugggcaucuaauucacaagaucgaacagcaucucaacaccagcuggaugucuugggacggcugcgaccuggauuauuacuguaauaugggagacuggcccuccugcacuuacacaggcguaacgcagcacaaccaugccaguuucgugaaucuuuugaacauagagaccgauuauacuaaaacauuucacuuccacagcaagaggguuaccgcgcauggggacacaccacagcuggaucucaaagcccgucccacuuacggagcuggugaaaucaccguccugguggagguggcugacauggaguuacacacgaagaaaauugaaaucucuggccugaaguuugccucccuuucauguaccgggugcuaugcuugcaguagcggaauuucguguaagguccggauccauguugaugagccugacgaauugacagugcacgugaaauccgaugacccagauguagucgccgcaucuagcucacucauggcccgaaagcuggagaguggcacugacuccaccuucaaagcauuuucugcgaugccgaagacaagccuaugcuucuacauaguggaaagagaguauuguaaagguugcuccaaggaggauacucaaaaauguguuaauaccaagcuggaacagccccagucaauucucaucgagcacaaggggacgauuaucggcaaacagaacaauacaugcaccgcaaaggccagcuguuggcuggaaagugugaaaucuuucuuuuacggacuuaagaacauguuguccggcauauuugggaaugucuuccugggaaucuuuagcuucuuagcuccuuucgugcuccugauucuguuuuucauguuuggcuggaggauccuuuucugcuuuaaauguugccgccggacuagagguuuguucaaguauaggcaucucaaggacgacgaggaaacaggguaccgcaaaauuaucgagcgacugaacaauaagaaaggaaagaacaaacuacuggauggcgagcggcucgccgaccguaagauagcagaacuguuuucgaccaagacucacauuggu

SEQ ID NO: 10600 - RNA, 2916 nt, Artificial Sequence
  derived and/or modified CDS sequence (opt3) from CCHFV(NIV 112143, Artificial)__JN572085.1__Gn-4aa-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugaaauccuucaaguugugugaaaauagcgcuacugguaaaucuugcgagauugauucgaucccuguaaagugucgacagggguacugcuuaaaaauuacccaggagggacguggccaugugaagcugucaagaggcagcgaagucgugcuagacgcaugugauaguuccugcgagguuaugaucccaaaggggacaggagacauacucguggauuguucugguggccagcaacacuuucugaaagacaaccuuaucgaucuggggugcccgaagauucccuugcucggaaaaauggccaucuauauuuguaggaugagcaaucauccuaagaccacuauggcguuccuguuuugguucuccuuuggcuacgucaucacaugcauacugugcaaagugauuuucuaucucuuaaucauuuuugguacccuggggaagcgguucaagcaguaccgcgaacuuaaaccacagacguguacuaucugcgagaccacacccguaaacgcuaucgacgccgagaugcacgauuugaauuguucauauaacauuugcccuuacugugcaaguagacugacuagcgacggacuagccaggcauguuacccagugcccaaagcggaaagaaaagguggaggaaacagagcucuaccugaaucuugaacgcauacccugggucgugcgaaaacuguugcaagugucugaguccaccggcaucgcucucaagagaucaagcuggcugauugucuuacugguucucuuuacggugaguaucacuccuguacagucugcaccaauaggcaggcggccgcuuuuccuggacuccauugugaaagggaugaagaacuugcuaaauagcacaucgcuggagaccucucucuccaucgaagcccccuggggagcuaucaacguccagucaacuuauaagccuacagugagugccgcgaauauugcacugagcugguccucuguugagcaccgugguaacaaaauccuugugagcggccgcucagaaaguauuaugaagcuggaggaaagaaccgggauauccugggauuugggagucgaggacgccagcgagucuaaacuccugacggugucaguaauggauuuaagucagauguacagcccaguuuuugaauaucuguccggcgacaggcaaguggaggaauggcccaaggcuaccuguacaggugauugcccugagcggugugggugcacuucuucgaccugucuacacaaagaauggccacauagccgaaauuggcgcugcaaccccacauggugcuggggcgucggaacuggcuguaccugcugugggcucgacgugaaggaucuguucacagacuacauguuugucaaguggaaaguggaguauaucaagaccgaggccauuguuugcguggaacuuacuucccaggagagacaguguucauugaucgaagcaggaacgagguucaaccuggguaguguaacaaucacccucucugagccgcggaauauucaacagaaacugccucccgagauaaucacucuucacccacgcauugaagagggcuucuuugaucugaugcauguccagaagguguugagcgcuuccaccguuugcaaacuccagucauguacacacggggugccuggagaccugcaagucuaccacaucggcaacuuacugaagggugauagagugaaugggcaucuaauucacaagaucgaacagcaucucaacaccagcuggaugucuugggacggcugcgaccuggauuauuacuguaauaugggagacuggcccuccugcacuuacacaggcguaacgcagcacaaccaugccaguuucgugaaucuuuugaacauagagaccgauuauacuaaaacauuucacuuccacagcaagaggguuaccgcgcauggggacacaccacagcuggaucucaaagcccgucccacuuacggagcuggugaaaucaccguccugguggagguggcugacauggaguuacacacgaagaaaauugaaaucucuggccugaaguuugccucccuuucauguaccgggugcuaugcuugcaguagcggaauuucguguaagguccggauccauguugaugagccugacgaauugacagugcacgugaaauccgaugacccagauguagucgccgcaucuagcucacucauggcccgaaagcuggaguucggcacugacaguaccuuuaaagcauucuccgcgaugccgaagacaucucuaugcuuuuacauaguggaaagagaguauuguaaagguugcagcaaggaggauacucaaaaauguguuaauaccaagcuggaacagccccaguccauucucaucgagcacaaggggacgauuaucggcaaacagaacaauacaugcaccgcaaaggccucauguuggcuggaaagcgugaaaaguuucuuuuacggacuuaagaacauguugucuggcauauucgggaaugucuuucugggaaucuucuccuucuuagcuccuuuugugcuccugauucuuuucuuuauguucggcuggaggauccuguuuugcuucaaauguugccgccggacuagagguuuguuuaaguauaggcaucucaaggacgacgaggaaacaggguaccgcaaaauuaucgagcgacugaacaauaagaaaggaaagaacaaacuacuggauggcgagcggcucgccgaccguaagauagcagaacuguucagcaccaagacucacauuggu

SEQ ID NO: 10601 - RNA, 2916 nt, Artificial Sequence
  derived and/or modified CDS sequence (opt3) from CCHFV(SCT ex Afghanistan, Artificial)__KC344856.1__Gn-4aa-Gc
agcgaggaauccggcgacgauugcaucucuagaacccagcugcucaggacagagacugccgaagugcacaacgacaauuacgggggacccggugauaagauuacgauauguaacggcucaaccaucgucgaccaacggcuugggagugagcugggaugcuauacaauuaaucgcguuaagagcuucaaguugugugaaaacuccgcuacuggcaaaucuugcaagaucgauucgaccccugugaaaugucgacaggguuuuugcuuaaagauuacacaggaggggcguggacauguaaagcugucaagaggcagcgaggugguccuagacgcaugugauaguuccugcgaaaucaugauaccaaaaggcaccggggacauccucguggauuguucuggaggucagcaacacuuccugaaggacaaucuuauugaucugggcugcccgaacauccccuugcucgggaaaauggccauuuacaucuguaggaugagcaaucauccuaagacuacaauggcguuucuguucugguuuuccuucggauauguuauaaccugcaucuuuugcaaagugauuuucuaccugcucauugucgugggcacguuagguaagaaguuuaaacaguaucgggagcugaagccacagacuuguaccaucugcgaaacaacucccaccaacgcuaucgacgccgagaugcacgaucuuaauuguucauacaacauuugcccuuauugugcaagucgcuugacaagcgacgggcuggccagacauguaacccagugcccaaaaaggaaggagaaaguugaagagacggaacuauaccucaaucuggagcggauacccuggaucgugcgcaaacuucugcaagucucugaauccacuggaguggcuuugaaacgaucaagcuggcucauugugcuguuaguccugcucacaguuagucuuucuccugugcaguccgcaccaaucggcagaaagccgcuguucuugaacagcauaguaaagggcaugaaaaaucuacugaacucgaccaaucucgagacuucucuguccauugaggcccccuggggugcuaucaacgugcagucaacauuuaagccuaccgucaguacggccaacaucgcgcuuagcugguccucuguggaacacaggggaaauaaaauucugguuagcggucggucagagaguaucaugaaguuggaggaacguaccggcauuuccugggaccucgggguggaagaugcaagcgagucuaaaucacugacagucagugugauggacuuaagccagauguacuccccaguauucgaguaucugucuggagaucgccaaguugaagaguggcccaaggccacuuguaccggcgacugcccugaaagaugugguugcacaucgagcacuugucuacacaaggaguggccacauuccaggaacuggcggugcaaucccaccuggugcuggggcguggggacaggauguaccugcuguggccucgaugucaaagaccuguuuacugauuacauguucgugaaguggaaagucgaauauauaaagacggaggcuaucgugugcguugagcuuacaucacaggaacgacaguguaguuugauugaggccgggacccgcuucaaccugggaccggugacuaucacccucucugaaccuagaaauauccaacagaaacugcccccagagauuauaacacuucacccuaggaucgaggaaggguuuuucgaccugaugcauguacagaaggucuugagcgcauccaccgugugcaagcuccagucauguacucacggcguucccggggaucugcaaguguaccacauuggaaacuuacugaaaggcgacaagcuaaauggucauaugauccacaaaauugagccacauuuuaacacaagcuggaugucuugggaugggugcgaccucgacuauuacuguaauaugggcgauuggcccuccugcacguauaccggagucacucagcacaaccaugcugccuucgugaaucugcuuaacaucgaaacagacuacaccaagaauuuucacuuccacaguaaacggguaacagcgcauggcgauacuccucaguuggaccugaaggcccgcccaaccuacggggcaggagagauaacggugcucguugaagucgcugauauggagcugcacaccaagaaaaucgacauuagcgguuuaaaguuugccucucugacaugugcuggcugcuaugccugcuccucagggaucaguuguaaagugaggauucauguggaugagccggacgaacuuacuguccacguuaagagcgaggaucccgacaucguggcagccucgaccuccuugauagcuagaaaacucgaacugggaacagauucuacuuucaaggcguuuagcgcaaugccuaaaaccucacuaugcuucuacauuguggagcgugaauauuguaagaguugcuccaaggaggacacgcagaaauguguaaacacaaagcuggagcacccacaaggcauccucauugaacauaaagguaccaucauagggaagcagaaugauacuugcacagccaaagcuggcuguuggcuggagucugucaagagcuuuuucuacggacuuaagaacauguuguccggcaucuuugggaacguguucauuggaaucuuccuguuuuuagcccccuucguucuccugauucuguuuuucauguuuggcuggcggcuuuuguucugcuuuaaauguugccgaagaaccaggggucucuucaaguaucgccaccugaaagaagacgaggaaucaggguaccggagaaucauagagaggcuaaauaacaagaaaggaaagaauaagcugcucgacggcgagcgccuggcagaucgacggauugccgaacuuuuuagcacuaaaacccauaucggu

SEQ ID NO: 10602 - RNA, 2916 nt, Artificial Sequence
  derived and/or modified CDS sequence (opt3) from CCHFV(Zahedan 2007, Artificial)__KC867273.1__Gn-4aa-Gc
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugcguagcuucaaauugugugaaaauuccgcuacugguaagucuugcgagauugauucgaucccuguaaaauguaagcagggguuuugcuuaaaaauuacccaggagggacgaggccaugugaagcugucaagaggcagcgaagucgugcuagacguuugugauaguuccugcgaggugaugaucccaaaggggacaggagacauacucgucgauuguucugguggccagcaacacuuccugaaagacaaccuuguggaucuggggugcccgaagauccccuugcucggaaaaauggcaauuuacaucuguaggaugagcaaucauccuaagaccacuauggccuuucuguucugguuuuccuucggcuauguaauuacaugcauccugugcaaagcgauauuuuuccucuuaauuaucuuugguacccuggggaagcgguucaagcaguaccgcgaacuuaaaccacagacguguacuauuugcgagaccacacccguuaacgcuaucgacgccgagaugcacgauuugaauuguucauauaacaucugcccuuacugugcaaguagacugacuagcgacggacuagccaggcaugugacccagugcccacggcgcaaggaaaaagucgaggaaacagagcucuaucugaaucuugaacgaauacccuggguggugagaaagcuguugcaagucucugaguccaccggcacgguucucaaaaggucaagcuggcugauuguguuacugguacucuuuacugugagucuuucuccuguccaguccgcuccaaucggccggcguccgcuguucuuggacagcauugugaaggauaugaaaaaccuacuuaauucgacaucucucgagaccucccugucaaucgaagcacccuggggagccauaaacguucagaguacuuacaagccuacagugagcaccgcuaauauugcccuuuccuggucuagcgucgagcaccgcgggaacaaggugcugguaucagguagaagugaauccaucaugaaauuggaggaaaggacgggcaucagcugggaccucgggguugaggaugcgucugagucaaagcuguuaaccgugagugucauggaccugagccagauguacuccccaguguuugaauaucuaucuggagaucggcaagucgaggaauggcccaaagcaacauguacuggcgacugcccugagcgaugugguugcaccucgagcacaugucuccacaaggaauggccacauucccgcaauuggagaugcaaccccacuuggugcuggggcguggggaccggauguacaugcuguggccuggauguuaaagaccuuuucaccgauuacauguucgugaaguggaagguagaguauauuaaaacugaggccaucgucugcguggaauugacgucacaggagaggcaguguagucugauugaagcugggacacgguuuaaccucggaucuguuaccauaacucugagcgagccgcgcaauauccaacagaagcugccucccgagauuaucacccugcacccaaaaaucgaagaggguuucuuugacuugaugcaugugcagaagguccucuccgccucaacagugugcaaacugcagagcuguacccacggcguaccuggggauuuacaaguguaccacauuggaaaccugcuaaagggcgacagaguuaauggucaucucauacacaagaucgaacagcauuucaacacuucuuggauguccugggacgggugcgaucuggacuauuacuguaauaugggcgauuggcccaguugcacauauacgggagucacccagcacaaccaugcuagcuuugugaaucuuuugaacauugagacugacuacacaaaaaccuuccacuuucacucuaagagggugacagcacauggcgauacuccacagcuggaccucaaagcccgucccaccuacggggcgggagaaaucacgguccugguugagguggccgauauggaguuacacaccaagaaaauugaaaucuccggucugaaguucgcaggccuuacauguacugggugcuaugcuugcucaaguggaauaagcuguaaggugcggauccauguagacgagccugaugaauugaccguccacgugaaaucggacgauccagacguuguggccgcuuccucuagccucauggcccgaaagcuggaguuuggcacagauucaacuuucaaagcauuuagugccaugccgaagaccucccuaugcuucuacauugucgaaagagaguauuguaaaucuugcagcaaggaggacacgcaaaaaugugugaauacaaagcuggaacagccccaguccauccucauugagcacaaggguaccaucauagggaaacagaacaauacuugcacagcuaaggcgucauguuggcuggaaagcguuaaaaguuucuuuuacggccuuaagaacauguugggaggcauuuucgggaauguguuuaucggaauuuucaccuuucugacuccuuucaucuuacucauauuuuucuuuauguucggcuggaggauccuguuuugcuucaaauguugccgccggaccagaggucuuuuuaaguauaggcaucugaaggacgaugaggaaacaggguaccgcaaaauuaucgagcgauugaacaauaagaaaggaaagaaccggcuccuggacggcgagcgucuagcagauagaaaaauugccgaacuguucucuacgaagacccacaucggu

SEQ ID NO: 10603 - RNA, 2916 nt, Artificial Sequence
  derived and/or modified CDS sequence (opt3) from CCHFV(SPU 44/08, Artificial)__KJ682805.1__Gn-4aa-Gc
agcgaggaauccaacgacgauugccugucuagaacccagcuccuuaggacagagaaugccgaaauccacucagacaacuacggcgggcccggagauaagauuacuauauguaaugguaguacgaucguggaccaacggcugggcagcgaguuggggugcuauaccauuaaccgcgucaaauccuucaaguuaugugaaaauucugcuacaggaaaaucgugcgagaucgauucaacuccuguucgaugucgucagggcuuuugccugaagauuacccaggaggguagagggcaugugaaacuaagcaggggaagugaaguagugcucgacgcaugugauuccucuugcgagaucaugauaccaaagggcacaggcgacauccuggucgauuguagcgggggacagcaacacuuccuuaaggacaaccugguggauuuggguugcccgaauauuccccuccugggcaaaauggccaucuacauuugucggauguccaaccauccuaagaccacuauggcguuucuguucugguuuucauucggguauguuaucacaugcauacucugcaaagcuaucuuuuacuuacugauuguggucggaacccuuggcaagaaauucaagcaguaucgcgaauugaagccacagacguguacuauuugcgagaccaaucccgugaacgccaucgacgcagagaugcacgaucugaauuguaguuacaacaucugcccuuauugugccagcagacuaacaucugacggucucgcuaggcauguaaugcagugcccaaaacggaaggagaaaauugaagaaacugagcuguaccuuaaucuggaacgcauacccuggguugugcgaaaguugcuccaagucuccgagucaaccgggguggcacugaaaagaagcaguugguuagugauccugcucguccuucugacaguuucuuuguccccugugcagagcgccccaauuucgaggaagccgcuauuucuggacucuaucguaaaaggaaugaagaaccuccuuaauuccaccucacuugagacgagucugagcauagaagcucccuggggcgccauuaacgugcaguccacuuucaagccuacagucucugcggcaaacaucgccuugagcuggucaaguguggagcaccggggcaauaaaauccucguuuccgggcguagcgaaucuauuaugaagcuggaggaacgcaccggaaucucaugggauuuagguguggaggacgcuagugagagcaaacugcuaacugucuccgugauggaucucucucagauguacucgccaguauuugaauaucugagcggcgacagacaaguugaggaauggcccaaggccacauguaccggggauugcccugagagguguggaugcacguccucaaccugucuucacaaagaauggccacauagucggaacuggcgaugcaaucccacauggugcuggggcguggguacuggguguaccugcuguggcuuggacgucaaggaucuguucacagacuacauguuugugaaguggaaagucgauuauauuaagacugaggcaauagugugcguugagcucaccucucaggaacgccaguguagccugaucgaggcuggaacaagauucaaccuuggcccggugaccauuacucuguccgaaccuaggaauauccaacagaaauugcccccagagaucguaacgcuccacccucggauugaggaaggguucuuugaccugaugcauauacagaaggucuuaucagccagcacagugugcaaacugcagucuuguacccacggaguucccggugaucuacaaaucuaccacauuggcaaccuccugaagggggacaaggugaauggacaucuuauccacaaaauugagccacauuucaacacuuccuggaugaguugggacggcugcgauuuggacuauuacuguaauaugggugauuggcccagcugcucuuauaccggggucacacagcacaaccaugcggccuuugugaauaugcugaacaucgaaaccgacuacacuaagaauuuccacuuucacuccaaacgcguaacagcacauggcgauacgccucagcucgaccugaaggcuagaccaaccuacggagccggcgagauaacuguguuaguugaagucgcugauauggagcugcacaccaaaaagaucgagauuucagggcuuaaguucgccaguuugacauguacaggaugcuaugcaugcagcucggguaucuccuguaaagugaggauucauguggacgaaccggaugagcucacuguccacguuaagucugaagaccccgauaucguggccgcuagcucaagucugauggcgcguaaacuagaguuuggcaccgacuccacguucaaggcauuuucugccaugccuaaaaccagccugugcuucuacauaguggaacgggaguauuguaaguccugcucaaaagaggauacacagaaguguguaaacacuaagcucgaacaaccacagagcauucugaucgagcacaaagggaccauuaucggaaagcagaaugacacaugcacugcuaaagccaguuguuggcuugaaucuauaaaguccuuuuucuacggcuugaaaaacaugcugagcgguaucuuugggaacgucuucauuggcaucuucuuauuucucgcacccuucauuaugcugauccuguuuuucauguuuggauggcgaauacuguucugcuuuaaguguugcagaaggacccgcggcuuguucaaguaucggcaucucaaagacgaugaggaaauuggguacagaaagaucaucgagaggcugaauaacaaaaagggcaaaaauaagcuacuggacggagagcgccucgccgaucgaaagauugcugaacuguuuucgacgaaaacacacaucggu

SEQ ID NO: 10604 - RNA, 2916 nt, Artificial Sequence
  derived and/or modified CDS sequence (opt3) from CCHFV(SPU 383/87, Artificial)__KJ682806.1__Gn-4aa-Gc
agcgaggaauccaacgacgauugccugucuagaacccagcuccuuaggacagagaaugccgaaauccacucagacaacuacggcgggcccggagauaagauuacuauauguaaugguaguacgaucguggaccaacggcugggcagcgaguuggggugcuauaccauuaaccgcgucaaauccuucaaguuaugugaaaauucugcuacaggaaaaucgugcgagaucgauucaacuccuguucgaugucgucagggcuuuugccugaagauuacccaggaggguagagggcaugugaaacuaagcaggggaagugaaguagugcucgacgcaugugauuccucuugcgagaucaugauaccaaagggcacaggcgacauccuggucgauuguagcgggggacagcaacacuuccuuaaggacaaccugguggauuuggguugcccgaauauuccccuccugggcaaaauggccaucuacauuugucggauguccaaccauccuaagaccacuauggcguuucuguucugguuuucauucggguauguuaucacaugcauacucugcaaagugaucuuuuacuuacuggucgugguaggaacccuuggcaagaaauucaagcaguaucgcgaauugaagccacagacguguacuauuugcgagaccaaucccguuaacgcuauugacgccgagaugcacgaucugaauuguaguuacaacaucugcccuuauugugcaagcagacuaacaucugacggucucgccaggcaugugauccagugcccaaaacggaaggagaaaauugaagaaacugagcuguaccuuaaucuggaacgcauacccugggucgugcgaaaguugcuccaaguguccgagucaaccggggucgcucugaaaagaagcaguugguuaguuauccugcucgugcuucugacaguaucuuuguccccugugcagagcgcaccaauuucgaggaagccgcuauuucuggacucuaucgucaaaggaaugaagaaccuccuuaauuccaccucacuggagacgagucugagcauagaagcccccuggggcgcuauuaacgugcaguccacuuucaagccuacaguuucugccgcgaacaucgcauugagcuggucaaguguggagcaccggggcaauaaaauccucgucuccgggcguagcgaaucuauuaugaagcuggaggaacgcaccggaaucucaugggauuuagguguggaggacgccagugagagcaaacugcuaacuguauccguuauggaucucucucagauguacucgccaguguuugaauaucugagcggcgacagacaagucgaggaauggcccaaggcuacauguaccggggauugcccugagagguguggaugcacguccucaaccugucuucacaaagaauggccacauagucggaacuggcgaugcaaucccacauggugcuggggcguggguacuggguguaccugcuguggcuuggacgucaaggaucuguucacagacuacauguuugugaaguggaaaguugauuauauuaagacugaggccauagugugcguagagcucaccucucaggaacgccaguguagccugaucgaggcaggaacaagauucaaccuuggcccggucaccauuacucuguccgaaccuaggaauauccaacagaaauugcccccagagaucgugacgcuccacccucggauugaggaaggguucuuugaccugaugcauauacagaagguuuuaucagcuagcacagugugcaaacugcagucuuguacccacggaguccccggugaucuacaaaucuaccacauuggcaaccuccugaagggggacaaggugaauggacaucuuauccacaaaauugagccacauuucaacacuuccuggaugaguugggacggcugcgauuuggacuauuacuguaauaugggugauuggcccagcugcucuuauaccgggguaacacagcacaaccaugccgcguuugugaauaugcugaacaucgaaaccgacuacacuaagaauuuccacuuucacuccaaacgcguuacagcccauggcgauacgccucagcucgaccugaaggcaagaccaaccuacggagcuggcgagauaacugucuuaguggaaguggccgauauggagcugcacaccaaaaagaucgagauuucagggcuuaaguucgcuaguuugacauguacaggaugcuaugccugcagcucggguaucuccuguaaagucaggauucauguugacgaaccggaugagcucacugugcacgugaagucugaagaccccgauaucguagcagccagcucaagucugauggcucguaaacuagaguuuggcaccgacuccacguucaaggcguuuucugcaaugccuaaaaccagccugugcuucuacauagucgaacgggaguauuguaaguccugcucaaaagaggauacacagaagugugugaacacuaagcucgaacaaccacagagcauucugaucgagcacaaagggaccauuuuuggaaagcagaaugacacaugcacugccaaagcuaguuguuggcuugaaucuguuaaguccuucuuuuacggcuugaaaaacaugcugagcgguaucuucgggaacguguucauaggcgucuuuuuauuccucgcccccuuuaucaugcugauucuuuucuuuauguucggauggcgaauccuguuuugcuucaaguguugcagaaggacccgcggcuuguuuaaguaucggcaucucaaagacgaugaggaaauuggguacagaaagaucauagagaggcugaauaacaaaaagggcaaaaauaagcuacuggacggagagcgccucgcagaucgaaagauugccgaacuguucucgacgaaaacacacaucggu

SEQ ID NO: 10605 - RNA, 2916 nt, Artificial Sequence
  derived and/or modified CDS sequence (opt3) from CCHFV(SPU 130/89, Artificial)__KJ682807.1__Gn-4aa-Gc
agcgaggaacccaacuacgacugccuguccagaacccagcuccuuaggacagagaaugccgaaauccacucugauaacuauggcgggccuggagacaagauuacuauauguaaugguucaacgaucguggaucaacggcugggcagugaguuggggugcuacaccauuaaccgcgucaagagcuucaaauuaugugaaaauuccgcuacaggaaaaucuugcgagaucgacucgacuccaguucgaugucgucagggcuuuugccugaagauuacccaggaggguagagggcaugugaaacuaucaaggggaagcgaaguagugcucgaugcaugugacaguuccugcgagaucaugauaccgaagggcacaggcgauauccuggucgacuguucugggggacagcaacacuuccuuaaggauaaccugguggacuuggguugccccaauauuccucuccugggcaaaauggccaucuauauuugucggaugagcaaccauccaaagaccacuauggcguuucuguucugguuuuccuucggguacguuaucacaugcauacucugcaaagugaucuuuuauuuacugauugucgugggaacccuuggcaagaaauucaagcaguaccgcgaauugaagccccagacguguacuauuugcgagaccaauccuguaaacgcuaucgaugccgagaugcacgaccugaauuguucauauaacaucugcccauacugugcaaguagacuaacaagcgauggucucgccaggcauguuaugcagugccccaaacggaaggagaaaauugaagaaacugagcuguaccuuaaucuggaacgcauaccuugggugguccgaaaguugcuccaagugucugaguccaccgggguggcucugaaaagaucaagcugguuagucguucugcucgugcuucugacaguaaguuugucuccagugcaguccgcaccgaucagcaggaagccccuaucgcuggacucuauugucaaaggaaugaagaaccuccuuaauuccaccucacuugagacgagucugagcaucgaagccccuuggggcgcuauaaacgugcaguccacuuuuaagccaacaguuucugccgcgaacauugcauugagcuggucaaguguggagcaccggggcaauaaaauccucgucuccgggcguagcgaaucuaucaugaagcuggaggaacgcaccggaauuucaugggacuuagguguggaggaugccagugagagcaaacugcuaacuguauccguuauggaccucucucagauguauucgcccguguucgaauaccugagcggcgauagacaagucgaggaauggccuaaggcuacauguaccggggacugcccagagagguguggaugcacguccucaaccugucuucacaaagaauggccccauagucggaacuggcgaugcaauccgacauggugcuggggcguggguacuggguguaccugcuguggcuuggaugucaaggaccuguuuacagauuauauguucgugaaguggaaaguugacuacaucaagacugaggccauugugugcguagagcucaccucucaggaacgccaguguagccugauagaggcaggaacaagauuuaaccuuggcccugucaccaucacucuguccgaacccaggaauauucaacagaaauugccaccugagaucgugacgcuccacccccggaucgaggaaggguucuucgaucugaugcauauucagaagguuuuaucagcuagcacagugugcaaacugcagucuuguacccacggagucccaggugaccuacaaauauaucacaucggcaaccuccugaagggggauaaggugaauggacaucuuauucacaaaaucgagccccauuuuaacacuuccuggaugaguugggacggcugcgacuuggauuacuauuguaauaugggugacuggccuagcugcucuuacaccgggguaacacagcacaaccaugccgcguucgugaauaugcugaacauugaaaccgauuacacuaagaauuuucacuuccacuccaaacgcguuacagcccauggcgacacgccacagcucgaucugaaggcaagaccgaccuauggagcuggcgagaucacugucuuaguggaaguggccgacauggagcugcacaccaaaaaggucgagauaucagggcuuaaguuugcuaguuugacauguacaggaugcuacgccugcagcucggguaucuccuguaaaguuaggauucauguggaugaacccgacgagcucacugugcacguaaagucugaagauccugacaucgucgcagccagcucaagucugauggcucguaaacuagaguucggcaccgauuccacguuuaaggcguucucugcaaugccaaaaaccagccugugcuuuuauauuguggaacgggagcacuguaaguccugcucaaaagaggacacacagcgauguguuaacacuaagcucgaacaaccccagagcauccugauagagcauaaggggaccauuaucggaaaacagaaugauacaugcacugccaaggcuaguuguuggcuugaaucuauuaaauccuucuuuuacggcuugaagaacaugcugagcgguaucuucgggaacguguuuauaggcgucuucuuauuccucgccccuuuuaucauucugauccuuuucuuuauguucggauggaggauucuguuuugcuucaaauguugcagacgcacccggggcuugcucaaguauagacaccugaaggacgacgaggaaaucggguacaggaaaauaauugagcgccuaaauaacaagaaaggaaagaauaaacugcucgauggcgagcgacuggcagaccggaagaucgccgaacuguuuucgacgaagacacauaucggu

SEQ ID NO: 10606 - RNA, 2916 nt, Artificial Sequence
  derived and/or modified CDS sequence (opt3) from CCHFV(SPU 497/88, Artificial)__KJ682808.1__Gn-4aa-Gc
agcgaggaauccaacgacgauugccugucuagaacccagcuccuuaggacagagaaugccgaaauccacucagacaacuacggcgggcccggagauaagauuacuauauguaaugguaguacgaucguggaccaacggcugggcagcgaguuggggugcuauaccauuaaccgcgucaaauccuucaaguuaugugaaaauucugcuacaggaaaaucgugcgagaucgauucaacuccuguucgaugucgucagggcuuuugccugaagauuacccaggaggguaaagggcaugugaagcuaagcagaggaagugaaguagugcucgacgcaugugauuccucuugcgagaucaugauaccaaagggcacaggcgacauccuggucgauuguagcgggggacagcaacacuuccuuaaagacaaccugguggauuuggguugcccgaauauuccccuccugggcaagauggccaucuacauuuguaggauguccaaccauccuaaaaccacuaugguuuuucuguucugguuuucauucggguaugugaucacaugcauacucugcaaggucaucuuuuacuuacugauugugguaggaacccuuggcaaaaaguucaagcaguaucgggaauugaaaccacagacguguacuauuugcgagaccaaucccguuaacgcgaucgacgcugagaugcacgaucugaauuguaguuacaacaucugcccuuauugugccagccgccuaacaucugacggucucgcaagacaugugaugcagugcccaaagaggaaagaaaagauugaggaaacugagcuguaccuuaaucuggaacggauacccugggucgugcgcaaauugcuccaaguguccgagucaaccggggucgcccugaagcgaagcaguugguuaguuauccugcucgugcuucugacaguaucuuuguccccugugcagagcgcuccaauuucgagaaaaccgcuauuucuggacucuaucgucaagggaaugaggaaccuccuuaauuccaccucacuugagacgagucugagcauagaagcacccuggggcgccauuaacgugcaguccacuuucaagccuacaguuucugcugccaacaucgcguugagcuggucaaguguggagcaccggggcaauaaaauccucgucuccgggcguagcgaaucuauuaugaagcuggaggaacgcaccggaaucucaugggauuuagguguggaggacgcaagugagagcaaacugcuaacuguauccguuauggaucucucucagauguacucgccaguguuugaauaucugagcggcgacagacaagucgaggaauggcccaaggccacauguaccggggauugcccugagagguguggaugcacguccucaaccugucuucacaaagaauggccacauagucggaacuggcgaugcaaucccacauggugcuggggcguggguacuggguguaccugcuguggcuuggacgucaaggaucuguucacagacuacauguuugugaaguggaaaguugauuauauuaagacugaggcuauagugugcguagagcucaccucucaggaacgccaguguagccugaucgaggccggaacaagauucaaccuuggcccggucaccauuacucuguccgaaccuaggaauauccaacagaaauugcccccagagaucgugacgcuccacccucggauugaggaaggguucuuugaccugaugcauauacagaagguuuuaucagcaagcacagugugcaaacugcagucuuguacccacggaguccccggugaucuacaaaucuaccacauuggcaaccuccugaagggggacaaggugaauggacaucuuauccacaaaauugagccacauuucaacacuuccuggaugaguugggacggcugcgauuuggacuauuacuguaauaugggugauuggcccagcugcucuuauaccgggguaacacagcacaaccaugcugccuuugugaauaugcugaacaucgaaaccgacuacacuaagaauuuccacuuucacuccaaacgcguuacagcgcauggcgauacgccucagcucgaccugaaggccagaccaaccuacggagcaggcgagauaacugucuuaguggaaguggcugauauggagcugcacaccaaaaagaucgagauuucagggcuuaaguucgccaguuugacauguacaggaugcuaugcuugcagcucggguaucuccuguaaagucaggauucauguugacgaaccggaugagcucacugugcacgugaagucugaagaccccgauaucguagccgcaagcucaagucugauggcccguaaacuagaguuuggcaccgacuccacguucaaggcuuuuucugcgaugccuaaaaccagccugugcuucuacauagucgaacgggaguauuguaaguccugcucaaaagaggauacacagaagugugugaacacuaagcucgaacaaccacagagcauucugaucgagcacaaagggaccauuaucggaaagcagaaugacacaugcacugcacgagccaguuguuggcuugaaucuauaaaauccuuuuucuacggcuugaagaacaugcugagcgguaucuuugggaacguuuucauuggcaucuucuuauuuuucgcucccuuuauuaugcucauccuguucuuuauguucggauggagaauacuguuuugcuucaaauguugcaggcgcacccggggccuguuuaaguauagacauuugaaggacgaugaggaagugggguacaggaaaauuaucgagcgccucaauaacaagaaaggaaagaauaaacugcuagacggcgagcgacuggccgaucggaagaucgcagaacucuucucgacgaagacacacauuggu

SEQ ID NO: 10607 - RNA, 2916 nt, Artificial Sequence
  derived and/or modified CDS sequence (opt3) from CCHFV(SPU 18/88, Artificial)__KJ682810.1__Gn-4aa-Gc
agcgaggaauccaacgacgauugccugucuagaacccagcuccuuaggacagagaaugccgaaauccacucagacaacuacggcgggcccggagauaagauuacuauauguaaugguaguacgaucguggaccaacggcugggcagcgaguuggggugcuauaccauuaaccgcgucaaauccuucaaguuaugugaaaauucugcuacaggaaaaucgugcgagaucgauucaacuccuguucgaugucgucagggcuuuugccugaagauuacccaggaggguagagggcaugugaaacuaagcaggggaagugaaguagugcucgacgcaugugauuccucuugcgagaucaugauaccaaagggcacaggcgacauccuggucgauuguagcgggggacagcaacacuuccuuaaggacaaccugguggauuuggguugcccgaauauuccccuccugggcaaaauggccaucuacauuugucggauguccaaccauccuaagaccacuaugggguuucuguucugguuuucauucggauauguuaucacaugcauacucugcaaagugaucuuuuacuuacugauugucgugggcacccuugguaagaaauucaagcaguaucgcgaauugaagccacagacguguacuauuugcgagaccaaucccguaaacgcgaucgacgcugagaugcacgaucugaauuguaguuacaacaucugcccuuauugugccagcagacuaacaucugacgggcucgcaaggcauguuaugcagugcccaaaacggaaggagaaaauugaagaaacugagcuguaccuuaaucuggaacgcauacccugggugguccgaaaguugcuccaaguguccgagucaaccggaguggcccugaaaagaagcaguugguuagucauccugcucguucuucugacagugucuuuguccccuguacagagcgcuccaauuucgaggaagccgcuauuucuggacucuaucgugaaaggcaagaagaaccuccuuaauuccaccucacuugagacgagucugagcauagaagcacccuggggcgccauuaacguccaguccacuuucaaaccuacagugucugcugccaacaucgcguugagcuggucaaguguugagcaccgggggaauaagauccucguguccggacguagcgaaucuauuaugaaacuggaggaacgcaccgguaucucaugggauuuaggcgucgaggacgcaagugagagcaagcugcuaacuguguccguaauggaucucucucagauguacucgccaguuuuugaauaucugagcggggacagacaaguggaggaauggcccaaagccacauguaccggagauugcccugagagguguggcugcacguccucaaccugucuucacaaggaauggccacauagucggaacuggcgaugcaaucccacauggugcuggggugucgggacuggcuguaccugcuguggauuggacgugaaggaucuguucacagacuacauguuugucaaauggaagguggauuauauuaaaacugaggcuauaguuugcguggagcucaccucucaggaacgccaguguagccugaucgaggccggcacaagauucaaccuugggccgguaaccauuacucuguccgaaccuaggaauauccaacagaaguugcccccagagaucgucacgcuccacccucggauugaggaaggauucuuugaccugaugcauauacagaaaguguuaucagcaagcacaguuugcaagcugcagucuuguacccacggugugcccggcgaucuacaaaucuaccacauugggaaccuccugaagggagacaaagucaauggccaucuuauccacaagauugagccacauuucaacacuuccuggaugaguugggacgguugcgauuuggacuauuacuguaauaugggggauuggcccagcugcucuuauaccggcgugacacagcacaaccaugcugccuuuguaaauaugcugaacaucgaaaccgacuacacuaaaaauuuccacuuucacuccaagcgcgugacagcgcauggagauacgccucagcucgaccugaaagccagaccaaccuacggcgcaggggagauaacuguuuuagucgaaguggcugauauggagcugcacacaaagaagaucgagauuucaggacuuaaauucgccaguuugaccuguacagguugcuaugcuugcagcucgggcaucuccuguaaggugaggauucaugucgacgaaccggaugagcucacuguucacgugaaaucugaagaccccgauaucguggccgcaagcucaagucugauggcccguaagcuagaguuugggaccgacuccacguucaaggcuuuuucugcgaugccuaaaaccagccugugcuucuacauaguagaacgggaguauuguaaauccugcucaaaggaggauacacagaagugugucaacacuaaacucgaacaaccacagagcauucugaucgagcacaagggaaccauuaucggcaaacagaaugacacaugcacugguaaggcaggguguuggcuugaaaguauaaaauccuuuuucuacggcuugaagaacaugcugucuggaaucuuuggcaacguguucauugggaucuucuuauuucucgcccccuucauuaugcugauccuguuuuucauguuuggauggcgaauacuguucugcuuuaaguguugcagaaggacccgcggcuuguucaaauaucggcaucucaaggacgaugaggaaauugguuacagaaaaaucaucgagaggcugaagaauaaaaaggggaagaacaaacuacuggacggagagcgccucgcugaucgaaagauugccgaacuguuuagcacgaaaacacacaucggc

SEQ ID NO: 10608 - RNA, 2916 nt, Artificial Sequence
  derived and/or modified CDS sequence (opt3) from CCHFV(SPU 431/85, Artificial)__KJ682812.1__Gn-4aa-Gc
agcgaggaauccgacggcgauugcaucucuagaacccagcugcucaggacagagacuacggaaauucacucagacaacuacgggggacccggugauaagauaaccaucuguaauggcaguacaauuguggaccaacggcuugggagcgagcugggaugcuauacuaucaaccgcgucaaauccuucaaguugugugaaaauucugccaccggcaaaucgugcgagauugauucaacaccuguuaagugucgacaggguuuuugcuuaaaaaucacccaggaggggcguggacaugugaagcugagcagaggcagugaaauaguacuagacgcuugugauuccaacugcgagaucaugauuccaaagggcacuggggacauccucguggauuguucuggaggucagcaacacuuccugaaagacaaucuuauugaucugggcugcccgaacauccccuugcucgggaagauggcaauauacauuuguaggaugagcaaucauccuaaaacaaccauggccuuucuguucugguuuuccuucggauaugucaucacgugcauucugugcaaggugaucuuuuaccucuuaaucguugcgggcacuguggguaaaaaguucaagcaguaucgggaacugcgcccacagaccuguacaauuugcgagacuauacccgucaacgcuaucgacgccgagaugcacgaucuuaauuguucauacaacauuugcccuuauugugcaaguagauugaccagcgacgggcuggccaggcaugugaugcagugcccaaaacggaaggaaaaaguagaggaaacagagcuauaccucaaucuggaacgcauccccuggguugugcgaaagcugcugcaagucucugaguccaccggaguggcuuugaaaagaucaagcuggcucacggugcuguuaguccugcucauaguuagucuuucuccugugcaguccgcaccaauuggcaggaagccgcuguuuuuggacagcaucguaaaaggccggaagaaccuacuuaauucgacuucucucgagacaucccugucaaucgaagcccccuggggagcuauuaacgugcagaguaccuucaagccuacugucagcgccgcgaauaucgcacuuuccuggucuagcguggagcaccgugggaacaaaauucugguuucaggucgcagugaauccauaaugaaguuggaggaaagaacaggcaucagcugggaucucgggguggaggacgccucugagucaaaacuguuaaccgucagugugauggaucugagccagauguacuccccaguauuugaauaucuaucuggagacaggcaaguugaggaauggcccaaggcuacguguaccggcgauugcccugagcggugugguugcacaucgagcacuugucuccacaaagaauggccacauucccgaaacuggcgcugcaaucccaccuggugcuggggcguggggacaggauguacuugcuguggccuggacgucaaggaucuuuucaccgacuacauguuugugaaguggaaagucgaguauauuaagacagaggccaucgugugcguugaauugaccucacaggagagacaguguagucugaucgaagcagggacuagguucaaccucggaccggugacgauuacacugucugagccucggaauauacaacagaaacuucccccagagaucauuacccugcacccucgcaucgaagaggguuucuuugauuugaugcauguacagagaguccucagcgcuuccacugugugcaagcugcagucauguacccacggcguucccggggacuuacaaguguaccacauuggaaaccugcuaaaaggcgauaaggucaauggucaucucauccacaagauagaaccacauuucaacacaagcuggaugucuugggacgggugcgaccuggauuauuacuguaauaugggcgacuggcccuccugcaccuauacuggagugacacagcacaaccaugccgcguuuguaaaucuuuugaacaucgagacggauuacaccaaaaauuuccacuuucacaguaagagggugacugcccauggcgacacaccucagcuggaucucaaagcacguccaaccuacggggcuggagaaguuacaguccugguggagguggccgacauggaguuacacacuaagaaaauugaaaucagcggucugaaguucgcuucucuuaccuguacgggcugcuaugccugcuccucagggauuaguuguaaggucaaaauccauguugaugagccggacgaauugaccgugcacguaaagagcgaggaucccgacauaguggcagccggaucgucccucauggcucggaaacuggaauuuggcgcggauucuacauucaaggcauuuagcgccaugccuaaaacuucacuaugcuucuacauugucgagcgagaguauuguaagaguugcuccagagaagacaccaggaaaugugugaacacaaagcuggaucgcccacagucuauccucauugagcacaaggguacuaucauagggaaacaaaauaauaccugcacggcuaaggccagcuguuggcuggaauccguuaaaucauuuuucuacggccuuaagaacauguugagcggaaucuuuggcaacguguucauugggaucuuccuguuuauugcacccuucgucuuacucauccuguuuuucauguuuggauggcggauacuuuucugcuuuaaauguugcagaaggacacgcggccuguucaaguaucgacauuugaaggacgacgaggaaaccgguuaccggaaaauuaucgagcgucucaacaauaagaaagggaagaacaaacugcuagauggagagagacuggccgacaggaagaucgcugaacucuuuaguacuaagucucacauuggc

SEQ ID NO: 10609 - RNA, 2916 nt, Artificial Sequence
  derived and/or modified CDS sequence (opt3) from CCHFV(SPU 48/90, Artificial)__KJ682813.1__Gn-4aa-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaaauccuucaaguugugugaaaauuccgcuacuggcaaaucuugcguuauugauucggugccaguaaagugucgacaggguuacugcuuacguaucacccaggaggggagaggacaugugaaacugucaaggggcagcgaggucgugcuagacgcaugugauacaaguugcgaaauaaugaucccgaagggcaccggggacauucucguugauuguuccggaggucagcaacacuuucugaaggacaaccuuaucgaucugggcugccccaaaauuccuuugcucgggaagauggccaucuauauaugucggaugucuaaucauccaacuacaaccauggcguuccuguuuugguucagcuuuggauacgugauuacgugcauccugugcaaagcuauuuucuaucucuuaaucaucauuggcacucuggguaagcgcuuuagacaguacagggagcuuaaaccccagaccuguacaauaugcgaaacuaccccugucaacgccaucgacgcagagaugcacgauuugaauuguuccuauaacauuugcccauacugugccucacggcugacaagugacgggcuagcucgccaugugacccagugccccaagcgaaaggagaaaguagaagagacggaacucuaccugaaucuugagagaaucccuuggguugugaggaagcuguugcaagucagcgaaucuacuggaguggcacucaaacgguccucauggcugauaguguuacugguccucuucacaguuagccuuaguccagugcagucugccccgauuggccguaagccccuguuucgcgacuccaucguaaaaggcaugaagaacuugcuaaauagcaccucgcuggagacuucucucuccaucgaggcuccuuggggagccauuaacgugcagucaacauauaaaccaaccgucaguacggcgaauaucgcacugagcugguccucuguggaacacagagggaacaagauucuuguuagcgguaggucagagaguauaaugaagcuggaagaacggaccggcaucuccugggauuuggggguggaagacgccagcgagucuaaacuccugacagucucagugauggauuuaagucagauguacagccccguauucgaguaucuguccggagaccgacaaguugaagaguggccuaaggcuacuuguaccggcgauugcccagaacgcugugguugcacaucuucgacuugucuacacaaagaguggccccauagcagaaauuggaggugcaacccgaccuggugcuggggcguggggacaggauguaccugcuguggccucgacgucaaggaucuguuuacugacuacauguucgugaaauggaaggucgaauauauuaagacggaggccaucgugugcguugagcuuacaucccaggaacggcaguguucauugaucgaggcagggacccgcuuuaaccugggaccugugacuauuacccucagugaacccagaaauauacaacagaaacugccaccugagaucauuacacuucaccccaggaucgaggaagguuucuucgaucugaugcauguacagaaggucuugucugcuagcaccgugugcaaacuccaguccuguacucacggcguuccaggggaccugcaaguguaccacauuggaaacuuacugaagggcgauaaagucaauggucaucuaauccacaagauagagccccauuuuaacacaucauggaugagcugggacgggugcgaccucgauuauuacuguaauaugggcgacuggccuucuugcacguacaccggagugacucagcacaaccgugccuccuucguaaaucugcuuaacaucgaaacagauuauaccaagaauuuucauuuccacaguaaacgggugacagcgcacggcgacacuccacaguuggaucugaaggcccgaccgaccuacggggcaggagagauuacgguucucgucgaaguggcugacauggagcugcauaccaaaaagaucgagauuagcgguuuaaaauuugccucucugacauguacuggcugcuaugcuugcuccucagggaucaguuguaaggugagaauacacgucgaugaacccgacgagcuuaccguucauguaaagagcgaugacccugaugugguggccgcaucguccucuuugauggccaggaaacucgaguucggaacagacagcacuuuuaaggcuuucucagcgaugccaaaaaccagucugugcuuuuacauugucgagaaggaauauuguaaauccugcucugaggaggauacgaagaaaugugugaacacaaagcuagaacagccccaaagcauccugauugagcacaagggcaccaucauagguaaacagaauagcacuugcacagcaaagguuucauguuggcucgaaagcgccaaaaguuucuuuuacgggcugaaggacaugcuuucuggcaucuucggaaacguguuuauuggcaucuucuuguuccuggcuccuuuuauuuuacucauccuguucuuuauguucggguggcgcauacuucugugcuuuaaauguugccggagaaccaggggauuguucaaguaucgccaccucaaggacgaugaggaaacuggcuaccgacggauuaucgagcgucugaauaacaaaaaggguaaaaauaagcuacuggacggggagagacucgccgauaggcgcaucgcagaacuguuuuccaccaaaacacauauugga

SEQ ID NO: 10610 - RNA, 2916 nt, Artificial Sequence
  derived and/or modified CDS sequence (opt3) from CCHFV(SPU 187/90, Artificial)__KJ682814.1__Gn-4aa-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaaauccuucaaguugugugaaaauuccgcuacuggcaaaucuugcgagauugauucgguuccagugaagugucgacaggguuacugcuuacguaucacccaggaggggagaggacauguaaaacugucaaggggcagcgaagugguccuagacgcaugugauacaaguugcgagauaaugaucccgaagggcaccggggacauucucguggauuguuccggaggucagcaacacuuucugaaggacaaccuuaucgaucugggcugccccaaaauuccuuugcucgggaagauggccaucuauauaugucggaugucuaaucauccaaaaacuacaauggcguuccuguuuugguucagcuuuggauacguuauuaccugcauccugugcaaggcuauuuucuaucucuuaaucaucauuggcacgcuggguaaacgcuuuaagcaguacagagaacuuaagccccagacuuguaccauaugcgagacaacuccugugaacgccaucgacgcagagaugcacgauuugaauuguuccuauaacauuugcccauacugugccucaaggcugaccagugacgggcuagcucggcaugucacacagugccccaaacgcaaggaaaaaguggaggaaaccgagcucuaccugaaucuugaacgaaucccuuggguaguuagaaagcuguugcaagugagcgagucuacgggagucgcacucaaaagguccucauggcugauaguguuacugguccucuucacugugagccuuaguccaguucagucugccccgauuggccggcguccccuguuuuuggacuccaucgugaagggcaugaaaaaccuacugaauagcacaucgcucgagaccucucuguccaucgaagcuccuuggggagccauuaacguacagucaacuuauaagccaacagugaguaccgcgaauaucgcacuuagcugguccucugucgagcaccgcgggaacaagauucuggugagcgguagaucagaaaguauaaugaaauuggaggaaaggacgggcaucuccugggaucucgggguugaggacgccagcgagucuaagcuguuaaccgugucagucauggaucugagucagauguacagccccguguucgaauaucuauccggagaccggcaaguagaggaauggccuaaagcuacauguacuggcgauugcccagagcgaugugguugcaccucuucgacaugucuccacaaggaauggccccauagccgcaauuggagaugcaacccgacuuggugcuggggcguugggaccggauguacaugcuguggccuggacgugaaagaucuuuuuaccgacuacauguucgucaaguggaagguggaguauauuaaaacugaggccaucgucugcguggaauugacgucccaggagaggcaguguucacugaucgaagcagggacacgguuuaaccucggaccuguuaccauuacucugagugagccccgcaauauacaacagaaacuuccaccugagaucauuacccugcaccccagaaucgaagaggguuucuucgauuugaugcaugugcagaaaguacucucugcuagcacagucugcaagcugcaguccuguacccacggcgugccaggggacuuacaaguuuaccacauuggaaaccugcuaaaaggcgauaaggugaauggucaucucauccacaagauagaaccccauuuuaacacuucauggaugagcugggacgggugcgaccuggauuauuacuguaauaugggcgacuggccuucuugcacauacacgggagucacccagcacaaccaugccuccuucgugaaucuuuugaacaucgagacugauuauaccaaaaauuuucacuuccacaguaagaggguaacagcgcauggcgacacaccacagcuggaucucaaagcccguccgacuuacggggcaggagaaauuaccgugcugguugaggucgcugacauggaguuacacacgaagaaaaucgaaauuagcggucugaaguuugccucucuuaccuguacaggcugcuaugcuugcuccucagggaucaguuguaaggugcggauacauguggaugagcccgacgaauugacuguccacguuaaaagcgaugacccugaugugguggccgcaucguccucucucauggcccgaaagcuggaguucggaaccgacagcauuuuuaaggcuuucucagcgaugccaaagacaagucuaugcuuuuacaucguagaaagagagcacuguaaauccugcucugaggaagauacuaagaaaugugucaacaccaagcuggagcagccccaaagcauucucaucgaacauaagggcacgauaaucgguaaacagaauagcacaugcaccgcaaagacuucauguuggcuggagagcgugaaaaguuucuuuuaugggcuuaagaacauguugucuggcauuuucggaaauguuuuuaucggcauuuuccuguucuuagccccuuuuauccuccugauacuuuucuuuauguucggguggaggauucuguuuugcuucaaauguugccgccggacaagaggauuguuuaaguacaggcaccucaaggacgacgaagagaccggcuaucgccgaaucaucgagcggcugaacaauaaaaaggguaaaaacaagcuacuggauggggaacgucucgcugacagaaggauugccgagcuguucuccacuaaaacccauaucgga

SEQ ID NO: 10611 - RNA, 2916 nt, Artificial Sequence
  derived and/or modified CDS sequence (opt3) from CCHFV(Haskovo-V46/13, Artificial)__KR092379.1__Gn-4aa-Gc
agcgaggaacugggcgacgauugcaucuccagaacccagcuccuuaggacagagacugccgaaauucacgacgauaacuacgggggacccggugacaagauaacgaucuguaauggcucuaccauuguggaucaacggcuggggucagaguugggaugcuauacaaucaaccgcggcaaaaguuucaaguuaugugaaaauagcgcuacugguaaaaccugcgagauugacuccacaccugucaagugucgacagggguuuugccugaaaaucacccaggagggacguggccauguuaagcuaucuagaggcucggaagugguacucgaugcaugugacucaagcugcgaggugaugauaccaaaggggacuggagauauccuggucgacuguagugguggccagcaacacuuccuuaaagauaaccugauugacuuggggugcccgcauaucccccuccugggaaagauggccauuuacaucuguaggauguccaaucacccucggacaaccauggcguuucuguucugguuuucuuucggcuaugugauaacgugcaucuuuugcaaagcucucuucuacagcuuaauuauuaucgguacucuggggaagaaaaucaagcaguaucgcgaacuuaagccacagaccuguacaauuugcgagacuacccccguuaacgccauagaugcagagaugcaugacuugaauuguuccuacaacaucugcccuuauugugccucaagacugacaagugacggacuagcuaggcacgugacccagugcccaaaacggaaggaaaaagucgaggaaacggagcucuaccugaaucuugaacgcauucccuggaucgugcgaaagcuguugcaaguaagcgagucuacuggcguugcacucaaaagauccucauggcugauaguguuacugguccuccuuccugugagccugaguccagugcagucugccccggucggcaggaagcccuuguuucuagauuccauuguuaaagggaugaagaaccugcucaauagcacaucgcuggagaccucucuuuccaucgaagcuccuuggggagccaucaacgugcagucaacuuucaagccaacaguaaguaccgcgaauauugcacugagcugguccucuguggagcaccgggguaacaaaaucuuggucacgggccguagcgaaucaauuaugaagcucgaggaacgcaccggggugaguugggaccugggaguugaggaugccuccgagagcaaauuacugacagugucuauaauggaccuaucacagauguacagucccgucuuugaauaucucagcggcgauagacaaguggaggaauggccuaaggcuacuuguaccggugacugcccagagaggugugggugcacauccucuacuugucugcauaaagaauggccccacucgcggaauuggcgaugcaacccgaccuggugcuggggcguaggaacaggcuguaccugcugugggguugaugugaaggaccuuuucacugaucauauguuugucaaguggaaaguggaguacaucaagacggaggccauugucugcguggaauugacaagccaggagcgccaguguucccugaucgaagcaggaaccagauucaaccucgguccuguuacuaucacccugucagagcccaggaauauucaacagaaacuuccaccugagauaaucacacugcaccccaagauugaagagggcuucuuugacuugaugcacgugcagaaaguacucagugcuucuaccgucugcaagcugcagagcuguacucaugggaucccaggagauuuacaaguguaucacauuggcaaccugcuaaagggugaccggguuaaugggcaucucauccacaaaauagaaccccauuucaacacauccuggaugucaugggacggcugcgaucuggacuacuauuguaauaugggagauuggccuagcugcacguacaccggcgugacucagcacaaccacgccgcguuugucaaucuuuugaacaucgagacagacuauaccaagacauuccauuuucacucuaaacgcgugacugcccauggggauaccccacagcuggaccucaaggcaagaccgacguacggagcuggugaaauuaccguacugguggagguugccgauauggaguuacacacuaaaaaggucgaaaucuccggccugaaguucgcuagucuuacauguaccgggugcuacgccugcagcucuggaauuuccuguaaagugaggauccacguggacgagcccgaugaauugacaguccauguuaagucaagugacccugaugugguggcagccggcacuagccucauggcucguaaacuggaguuugguaccgacucgacguucaaggcguuuuccgcaaugccaaaaacaucucuaugcuucuauauaguagaacgggaguacuguaagagcugcucagaggaugacacccagaaaugugucgacacuaagcuggaacaaccccagaguauucucaucgagcacaaggggacaauuaucggcaaacagaaugauaccugcacugcccgagcuuccuguuggcuggaaucugugaagucauuuuucuauggacuuaaaaacauguugggcuccguuuuugggaauuuccugauaggaaucuuacucuuccuggccccuuuugugcuucuggucuuguucuuuauguucggcuggaagauucucuuuugcuucaaauguugcagaaggacccgcggucuguuuaaguaccggcaucuaaaggacgaugaggaaacaggguauagaaggaucauugagcgccugaacagcaaaaagggcaaaaaucgacuccuggacggagagcggcuugcagaucguaagaucgccgaauuguucagcacgaaaacccacauaggu

SEQ ID NO: 10612 - RNA, 2916 nt, Artificial Sequence
  derived and/or modified CDS sequence (opt3) from CCHFV(24-R-2012, Artificial)__KR814856.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacacuucaugcgaggucaugauaccgaagggcacaggggauauccucguggacuguagcggaggucagcaacacuuccugaaagauaaccuuauugaccugggcugcccccauaucccuuugcucgggaagauggccauuuacaucuguaggaugaguaaucacccacggaccacgauggcguuucuguucugguuuuccuucggauauguuauaacuugcaucuuuugcaaagcucuguucuacucucucauuauuaucggcaccuuagguaagaaaaucaagcaguaucgcgaacugaagccccagacauguacuauuugcgagaccgccccugugaacgcaauagaugccgagaugcaugaccuuaauuguagcuacaacaucugcccauauugugcuuccagauugacaucagacgggcuggcaaggcacgucccccagugcccuaaacggaaggaaaaaguggaggaaaccgagcuauaccucaaucuggaacgcauuccauggaucguacgaaaacuucugcaaguuagugagagcacgggaguggccuugaaaagaucuuccuggcucauaguccuguuagugcugcucacugugucacuuagcccgguccagagugcucccguuggcaggaagccucuguuuuuggauucuauugugaaaggcaugaagaaccuacuuaauuccacaagccucgagaccucgcugucuaucgaagccccauggggagcgaucaacguacaguccacuuucaagcccacagugucaaccgcaaauauugcccuuaguuggagcuccgucgagcaccgggggaacaaaauccuggugacgggucguucugaaagcauuaugaaguuggaggaacgcaccggcguuucaugggaccucgggguggaggaugcuagugaguccaaacuguuaacagucagcauaauggaccugucucagauguacucaccuguguuugaauaucuaaguggagauagacaaguagaggaauggccaaaggccacuuguaccggcgacugccccgagaggugugguugcacaagcuccacuugucuccauaaagaauggccgcacucucggaauuggcgaugcaacccuaccuggugcuggggcguugggacaggauguaccugcuguggcguggaugucaaggaccuguucacugaucauauguuugugaaguggaaagucgaguacaucaagacggaggcaauugugugcguugaacuuacaucgcaggagcgccaguguagcuugaucgaagcugggaccagauucaaccugggacccgugacuaucacccucuccgagccaaggaauauucaacagaaacugccucccgagauaaucacacuucacccaaagguagaagaggguuucuuugaccugaugcacguccagaaaguguugucagccaguaccguuugcaagcuccagucuuguacucauggcauucccggggaucugcaaguguaucacaucggaaacuuacugaagggcgaccgggucaauggucaucuaauucacaaaaucgaaccucauuucaacacaagcuggauguccugggacgggugcgaucucgacuacuauuguaauaugggcgauuggccaucaugcacguacaccggagugacucagcacaaccacgcggccuuuguaaaucugcuuaacauagagacagacuauaccaagacauuccauuuucacagcaaacgcgugacugcacauggcgauaccccgcaguuggaccugaaggcuagacccacguacggggccggagaaaucaccguucucgucgagguggcugauauggagcugcacacaaagaagguggaaauuucugguuuaaaguucgccucccuggcauguacuggcugcuacgccugcaguagcgggaucucuuguaaagucaggauucacguugacgagccugaugaacuuaccgugcaugugaaguccaaugacccagauguagucgcugcgucaacaaguuugauggcacguaaacucgaguuuggaacugacagcaccuucaaggccuuuucggcuaugcccaaaacgucccugugcuucuauaucguggaacgggaguacuguaagucuugcagcgaggaagauacacagaaauguguugacaccaagcuagagcaaccucagucaauacugauugaacacaagggcacuaucauugguaaacagaacgacacaugcaccgccaaggcaaguuguuggcucgaguccgugaaaucuuucuuuuaugggcugaagaauaugcuuggcagcgucuuuggaaacuucuucaucggcauauugcuguuuuuagccccauucgugcuccugguucuguuuuucauguuuggguggaaaauccuguucugcuuuaaguguugccgaagaacuaggggauugcucaaguaccgccugcuaaaagaugacgaagagaccggcuaucggagaauuaucgagaggcugaauaacaagaaagguaagaaucgccuccuggauggggaacgacuugcugaccggaaaauugccgaguuguucuccacaaagacgcauaucgga

SEQ ID NO: 10613 - RNA, 2916 nt, Artificial Sequence
  derived and/or modified CDS sequence (opt3) from CCHFV(36-ST-2014, Artificial)__KR814857.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuacagccucauuaucaucggcacuuuagguaaaaagauuaagcaguaucgggaacugaaaccccagaccuguacaauaugcgagacugccccuguuaacgcaaucgaugccgagaugcaugaccuuaauuguuccuacaacauuugcccauauugugcuucacgcuugaccagugacgggcuggcaagacacgugacacagugccccaagaggaaagaaaaggucgaggaaaccgagcuauaccucaaucuggaacggaucccuuggauagugcgcaaacuucugcaaguaagcgagucuacgggaguugccuugaagcgauccucauggcucauugugcuguuaguccugcucacugugagccuuaguccagugcagucugcuccggucggcagaaaaccccuguuuuuggauuccaucguuaagggcaugaagaaccuacugaauagcacaucgcucgagaccucucuguccaucgaagccccuuggggagcgauuaacgugcagucaacuuucaaaccaacaguaaguaccgcaaauaucgcccuuagcugguccucuguggagcacagggggaacaagauucuggucacgggucggagcgaaucaauaaugaaauuggaggaacguaccggcgugaguugggaccucgggguugaggaugcuuccgagagcaagcuguuaacagugucuaucauggaccugucacagauguacagucccgucuuugaauaucuaagcggagaucgccaaguggaggaauggccuaaagccacuuguaccggcgacugcccagagagaugugguugcacauccucuacuugucuccauaaggaauggccccacucgaggaauuggcggugcaacccgaccuggugcuggggcguagggacaggauguaccugcuguggcguugaugugaaggaccuguucacugaucauauguuuauuaaauggaaggucgaguacaucaaaacggaggcaaucgugugcgucgaacuuacaagccaggagcgacaguguuccuugauugaagcugggacccgcuucaaccugggaccugugacuauaacccucucagagcccagaaauauccaacagaagcugccaccugagauuaucacacuucaccccaaaauugaagaggguuucuuugaccugaugcacguucagaagguguugagugccucuaccguaugcaagcuccagagcuguacucauggcaucccaggggaucugcaaauauaucacaucggaaacuuacugaaaggcgacaggcuaaauggucaucucauucacaagaucgaaccccauuucaacacauccuggaugucaugggacgggugcgaucuggacuacuauuguaauaugggcgauuggccuagcugcacguacaccggagucacucagcacaaccacgcggccuuugugaaucuuuugaacauugagacagacuauaccaaaacauuccauuuucacucuaagcggguuacugcacauggcgauaccccacagcuggaccucaaagcucgcccgacguacggggccggagaaaucaccgugcuggucgagguggcugauauggaguuacacacaaagaagguagaaauauccggucugaaauucgccagucuugcauguacuggcugcuacgccugcagcucugggauuuccuguaaggugagaauccacguugacgagcccgaugaauugaccguccaugugaaaucaagugacccugauguggucgcugcgagcacaucgcucauggcaaggaagcuggaguuuggaacugacuccaccuucaaagccuuuucugcuaugccaaagacgagccuaugcuucuauauuguugaacgugaguacuguaaaucaugcagugaggaugacacaaagaaguguguggacaccaaacuggaucagccccaauccauccucauagaacacaagggcacuaucauugguaaacagaaugacacaugcaccgccaaggcaucuuguuggcuggagagcgugaaauccuuuuucuaugggcuuaagaacauguugggcucaguauuuggaaauuucuucgucggcauccuguuauuucucgccccuuucgugcugcuuguucuguuuuucaugugcggguggaaguuuuuguucuguuuuaaaugcugucggcgaacuagaggacucuucaaguacaggcaucugaaagaugacgaagagaccggcuaucgccggauuaucgaaagacuaaacagcaagaaagguaagaauaggcugcucgauggggagcgccuggcugaccgaaagauagccgagcuuuuuaguacaaaaucucacauugga

SEQ ID NO: 10614 - RNA, 2916 nt, Artificial Sequence
  derived and/or modified CDS sequence (opt3) from CCHFV(37-R-2013, Artificial)__KR814858.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacacuucaugcgaggucaugauaccgaagggcacaggggauauccucguggacuguagcggaggucagcaacacuuccugaaagauaaccuuauugaccugggcugcccccauaucccuuugcucgggaagauggccauuuacaucuguaggaugaguaaucacccacggaccacgauggcguuucuguucugguuuuccuucggauauguuauaacuugcaucuuuugcaaagcucuguucuacucucucauuauuaucggcaccuuagguaagaaaaucaagcaguaucgcgaacugaagccccagacauguacuauuugcgagaccgccccugugaacgcaauagaugccgagaugcaugaccuuaauuguagcuacaacaucugcccauauugugcuuccagauugacaucagacgggcuggcaaggcacgucccccagugcccuaaacggaaggaaaaaguggaggaaaccgagcuauaccucaaucuggaacgcauuccauggaucguacgaaaacuucugcaaguuagugagagcacgggaguggccuugaaaagaucuuccuggcucauaguccuguuagugcugcucacugugucacuuagcccgguccagagugcucccguuggcaggaagccucuguuuuuggauucuauugugaaaggcaugaagaaccuacuuaauuccacaagccucgagaccucgcugucuaucgaagccccauggggagcgaucaacguacaguccacuuucaagcccacagugucaaccgcaaauauugcccuuaguuggagcuccgucgagcaccgggggaacaaaauccuggugacgggucguucugaaagcauuaugaaguuggaggaacgcaccggcguuucaugggaccucgggguggaugacgcuagugaguccaaacuguuaacagucagcauaauggaucugucucagauguacucaccuguguuugaguaucuaaguggagacagacaaguagaagaguggccaaaggccacuuguaccggcgauugccccgaaaggugugguugcacaagcuccacuugucuccauaaagaguggccgcacucucggaauuggcgaugcaacccuaccuggugcuggggcguugggacaggauguaccugcuguggcguggacgucaaggaucuguucacugaccauauguuugugaaguggaaagucgaauacaucaagacggaggcaauugugugcguugagcuuacaucgcaggaacgccaguguagcuugaucgaggcugggaccagauucaaccugggacccgugacuaucacccucuccgaaccaaggaauauucaacagaaacugccucccgagauaaucacacuucacccaaagguagaggaagguuucuuugaucugaugcacguccagaaaguguugucagccaguaccguuugcaagcuccagucuuguacucauggcauucccggggaccugcaaguguaucacaucggaaacuuacugaagggcgaccgggucaauggucaucuaauucacaaaaucgagccucauuucaacacaagcuggauguccugggaugggugcgaccucgauuacuauuguaauaugggcgacuggccaucaugcacguacaccggagugacucagcacaaccacgcggccuuuguaaaucugcuuaacauagaaacagauuauaccaagacauuccauuuucacagcaaacgcgugacugcacauggcgacaccccgcaguuggaucugaaggcuagacccacguacggggccggagagaucaccguucucgucgaaguggcugacauggagcugcacacaaagaagguggagauuucugguuuaaaguucgccucccuggcauguacuggcugcuacgccugcaguagcgggaucucuuguaaagucaggauucacguugaugaaccugacgagcuuaccgugcaugugaaguccaaugauccagacguagucgcugcgucaacaaguuugauggcacguaaacucgaauuuggaacugauagcaccuucaaggccuuuucggcuaugcccaaaacgucccugugcuucuauaucguggagcgggaauacuguaagucuugcagcgaggaggacacacagaaauguguugacaccaagcuagaacaaccucagucaauacugauugagcacaagggcacuaucauugguaaacagaacgugacaugcaccgccaaggcaaguuguuggcucgaauccgucaaaucuuucuuuuaugggcugaagaauaugcuuggcagcguguuuggaaacuucuucaucggcauauugcuguuuuuagccccauucguucuccuggugcuguuuuucauguuuggguggaaaauccuguucugcuuuaaguguugccgaagaacuaggggauugcucaaguaccgccugcuaaaagaugacgaggaaaccggcuaucggagaauuaucgagaggcugaauaacaagaaagguaagaaucgccuccuggauggggagcgacuugcugaccggaaaauugccgaauuguucuccacaaagacgcauaucgga

SEQ ID NO: 10615 - RNA, 2916 nt, Artificial Sequence
  derived and/or modified CDS sequence (opt3) from CCHFV(44-ST-2010, Artificial)__KR814859.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucugcugugguucucuuuuggauaugugauuacgugcaucuucugcaaggcucucuuuuacagcuuaauuaucaucggcacucuggguaaaaagauuaagcaguaucgggaacuuaaaccccagaccuguacaauaugcgagacugccccuguuaacgcaaucgaugccgagaugcaugacuugaauuguuccuacaacauuugcccauauugugcuucacgccugaccagugacgggcuagcaagacacgugacacagugccccaagaggaaagaaaaggucgaggaaaccgagcucuaccugaaucuugaacggaucccuuggauagugcgcaaacuguugcaaguaagcgagucuacgggaguugcccucaagcgauccucauggcugauuguguuacugguccuccuuacugugagccugaguccagugcagucugcuccggucggcagaaaacccuuguuccuagauuccaucguuaagggcaugaagaaccugcucaauagcacaucgcuggagaccucucuuuccaucgaagccccuuggggagcgauuaacgugcagucaacuuuuaaaccaacaguaaguaccgcaaauaucgcccugagcugguccucuguggagcacagggggaacaagauuuuggucacgggucggagcgaaucaauaaugaaacucgaggaacguaccggcgugaguugggaccuggggguugaggaugcuuccgagagcaaguuacugacagugucuaucauggaccuaucacagauguacagucccgucuucgaauaucucagcggagaucgccaaguggaggaauggccuaaagccacuuguaccggcgacugcccagagagaugugguugcacauccucuacuugucugcauaaggaauggccccacucgaggaauuggcggugcaacccgaccuggugcuggggcguagggacaggauguaccugcuguggcguugaugugaaggaccuuuuuacugaucauauguucauuaaauggaaggucgaguacaucaaaacggaggcaaucgugugcgucgaauugacaagccaggagcgacaguguucccugauugaagcugggacccgcuuuaaccucggaccugugacuauaacccugucagagcccagaaauauccaacagaaacuuccaccugagauuaucacacugcaccccaagauugaagaggguuucuucgacuugaugcacguucagaaggugcucagugccucuaccguaugcaagcugcagagcuguacucauggcaucccaggggauuuacaaauauaucacaucggaaaccugcuaaaaggcgacaggcucaauggucaucugauucacaagaucgaaccccauuuuaacacauccuggaugucaugggacgggugcgaucuugacuacuauuguaauaugggcgauuggccuagcugcacguacaccggagucacucagcacaaccacgcggccuucgugaauuugcugaacauugagacagacuauaccaaaacauuucauuuccacucuaagcggguuacugcacauggcgauaccccacagcucgaccugaaagcucgcccgacguacggggccggagaaaucaccguguuagucgagguggcugauauggagcugcacacaaagaagguagaaauauccggucuuaaauuugccaguuuggcauguacuggcugcuacgccugcagcucugggauuuccuguaaggugagaauccacguugacgagcccgaugaacucaccguccaugugaaaucaagugacccugauguggucgcugcgagcacaucgcugauggcaaggaagcuagaguucggaacugacuccaccuuuaaagccuucucugcuaugccaaagacgagccugugcuuuuauauuguugaacgugaguacuguaaaucaugcagugaggaugacacaaagaaguguguggacaccaaacucgaucagccccaauccauccugauagaacacaagggcacuaucauugguaaacagaaugacacaugcaccgccaaggcaucuuguuggcuugagagcgugaaauccuucuuuuauggguugaagaacaugcugggcucaguauucggaaacuuuuucgucggcaucuuacucuuccuggccccuuuugugcuucugguuuuguucuuuaugugcggguggaagauucucuucuguuuuaaaugcugucggcgaacuagaggacuguucaaguacaggcaucuaaaagaugacgaagagaccggcuaucgccggaucauagaaagacugaauagcaagaaagguaagaauaggcuccuggauggggagcgccuugcugaccgaaagauugccgaguuguuuaguacaaaaucucacaucgga

SEQ ID NO: 10616 - RNA, 2916 nt, Artificial Sequence
  derived and/or modified CDS sequence (opt3) from CCHFV(46-ST-2012, Artificial)__KR814860.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaagagauccucauggcucauaguccuguuagugcugcucacggugagccuuaguccgguccagucugcucccguuggcaggaagccucuguuuuuggauuccauugugaaaggcaugaagaaccuacugaauagcacuucgcucgagacaucucuguccaucgaagccccauggggagcgaucaacguacagucaaccuucaagcccacugugaguacagcaaauauugcccuuagcugguccucugucgagcaccgggggaacaaaauccuggugaccggucguagcgaaucaauuaugaaguuggaggaacgcacgggcguuaguugggaccucgggguggaggaugcuuccgagagcaaacuguuaaccgucucuauaauggaccugucacagauguacaguccuguguuugaauaucuaagcggagauagacaaguagaggaauggccaaaggccacauguacuggcgacugccccgagaggugugguugcaccuccucuacaugucuccauaaagaauggccgcacucgcggaauuggcgaugcaacccuacuuggugcuggggcguugggaccggauguacaugcuguggcguggaugucaaggaccuguucaccgaucauauguuugugaaguggaaagucgaguacaucaagacugaggcaauugugugcguugaacuuacgagccaggagcgccaguguuccuugaucgaagcugggacaagauucaaccugggacccgugaccaucacucucucagagccaaggaauauucaacagaaacugccucccgagauaaucacccuucacccaaagguagaagaggguuucuuugaccugaugcacguccagaaaguguugagugccucuacaguuugcaagcuccagagcuguacccauggcauucccggggaucugcaaguguaucacaucggaaacuuacugaagggcgaccggauuaauggucaucuaauccacaaaauagaaccucauuucaacacuuccuggaugucaugggacgggugcgaucucgacuacuauuguaauaugggcgauuggccaagcugcacauacacgggagucacccagcacaaccacgcggccuuugugaaucugcuuaacaucgagacugacuauacaaagaccuuccauuuucacucuaaacgcguaacagcacauggcgauacuccgcaguuggaccugaaggcuagacccaccuacggggccggagaaauuacggugcucguugaggucgcugauauggagcugcacaccaaaaagguggaaaucuccgguuuaaaguucgccagucuggcauguacaggcugcuacgccugcagcucugggauuuccuguaaagugaggauccacgucgacgagccugaugaacuuacuguucaugugaagucaagugacccagaugugguagcugcgagcaccucguugauggcacguaaacucgaguuuggaacagacuccacuuucaaggccuuuucugcuaugcccaaaaccagccugugcuucuauauagucgaacgggaguacuguaagucaugcagugaggaagauacgcagaaauguguggacacacgacuagagcaaccucaguccauucugaucgaacacaagggcaccauuaucgguaagcagaaugacacuugcacagccaaagcaucuuguuggcucgagagcguuaaguccuuuuucuaugggcugaaaaacaugcuuggcucaguguuuggaaauuucuucauaggcaucuugcuguuuuuagccccauucguccuccuggugcuguuuuucauguuuggguggaagauucuuuucugcuuuaaauguugcagaaggacccgcggauugcucaaguaccggcaucugaaggaugacgaagagacuggcuauagaaggaucauugagcgccuaaacaauaaaaaggguaaaaaccgacugcucgauggggaacggcuggcugaccguaagaucgccgagcuuuucagcaccaaaacacacauagga

SEQ ID NO: 10617 - RNA, 2916 nt, Artificial Sequence
  derived and/or modified CDS sequence (opt3) from CCHFV(47-ST-2013, Artificial)__KR814861.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauuguguaagaauagcgcuacuggcaaaaccugcgaaauugacuccacaccaguuaagugucgccaggguuuuugcuuaaagaucacccaggaggggcgaggacaugugaaacugucucguggcucggagguagugcuagaugcaugugacucaagcugcgaaauaaugaucccgaagggcacuggggauauucucgucgacuguaguggaggucagcaacacuuccugaaagauaaccuuaucgaccugggcugcccccauauuccuuugcucgggaagauggccaucuacauauguagaauguccaaucacccaaggacaaccauggcguuucuguucugguuuucuuucggauaugugauuacgugcaucuuuugcaaagcucuguucuacagccucauuaucaucggcacuuuagguaagaagauuaaacaguaucgggagcugaagccccagaccuguacaauaugcgaaacugccccuguuaacgcaaucgaugccgagaugcaugaccuuaauuguuccuacaacauuugcccauauugugcuucacgcuugaccagugacgggcuggcaagacacgugacacagugccccaaaaggaaggagaaagucgaagagaccgaacuauaccucaaucuggagcggaucccuuggauagugcgcaaacuucugcaaguaagcgaaucuacgggaguugccuugaagcgauccucauggcucauugugcuguuaguccugcucacugugagccuuaguccagugcagucugcuccggucggcagaaagccccuguuuuuggauuccaucguuaagggcaugaaaaaccuacugaauagcacaucgcucgagaccucucuguccaucgaggccccuuggggagcgauuaacgugcagucaacuuucaagccaacaguaaguaccgcaaauaucgcccuuagcugguccucuguggaacacagggggaacaaaauucuggucacgggucggagcgagucaauaaugaaguuggaagagagaaccggcgugaguugggaccucgggguugaagaugcuuccgagagcaaacuguuaacagugucuaucauggaccugucacagauguacagucccgucuuugaguaucuaagcggagaucgccaaguggaagaguggccuaaggccacuuguaccggcgaaugcccagagagaugugguugcacauccucuacuugucuccauaaggaauggccccacucgaggaauuggcggugcaacccgaccuggugcuggggcguagggacaggauguaccugcuguggcguugacgugaaagaucuguucacugaccauauguuuauuaaguggaaagucgaguacaucaagacggaggcaaucgugugcgucgaacuuacaagccaggagcgacaguguuccuugauugaagcugggacccgcuucaaccugggaccugugacuauaacccucucagagcccagaaauauccaacagaaacugccaccugagauuaucacacuucaccccaagauugaagaggguuucuuugaucugaugcacguucagaagguguugagugccucuaccguaugcaaacuccagagcuguacucauggcaucccaggggaccugcaaauauaucacaucggaaacuuacugaagggcgauagggucaauggucaucuaauucacaaaaucgaaccccauuucaacacauccuggaugucaugggacgggugcgaccucgauuacuauuguaauaugggcgacuggccuagcugcacguacaccggagugacucagcacaaccacgcggccuuuguuaaucugcuuaacauugagacagauuauaccaagacauuccauuuucacucuaaacgggugacugcacauggcgacaccccacaguuggaucugaaggcucgcccgacguacggggccggagaaaucaccguccucguggagguagcugacauggagcugcacacaaagaaaguggaaguuuccgguuuaaaguucgccagucuggcauguacuggcugcuacgccugcagcucugggauauccuguaaaguccguauucacguggaugagcccgacgaacuuaccgugcaugucaagucaagugauccugacguuguggcugcgagcacaucguugauggcaaggaaacucgaguuuggaacugauuccaccuucaaggccuuuucugcuaugccaaaaacgagccugugcuucuauaucguggaacgugaguacuguaagucaugcagugaggacgauacaaagaaauguguagacaccaagcuagaacagccccaauccauucugaucgagcacaaaggcacuauaaucgguaagcagaaugacacaugcaccgccaaagcaucuuguuggcucgaaagcgucaaguccuuuuucuaugggcugaagaacaugcuuggcucaguguuuggaaauuucuucguuggcauuuugcuguuuuuagccccuuucgugcuccugguccuguuuuucauguuuggguggaaaauccuuuucugcuuuaaguguugccggcgaacuagaggauuguucaaauacaggcaucucaaggaugacgaggaaaccggcuaucgccggauuaucgagagacugaacagcaaaaaggguaagaauaggcuacuggauggggagcgccucgcugaccgaaaaauagccgaacuguuuaguacaaagacgcacauugga

SEQ ID NO: 10618 - RNA, 2916 nt, Artificial Sequence
  derived and/or modified CDS sequence (opt3) from CCHFV(52-R-2014, Artificial)__KR814862.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacacuucaugcgaggucaugauaccgaagggcacaggggauauccucguggacuguagcggaggucagcaacacuuccugaaagauaaccuuauugaccugggcugcccccauguuccuuugcucgggaagauggccaucuacauuuguaggaugaguaaucacccacggaccacgauggcguuucuguucugguuuuccuucggauaugugaucacuugcauauuuugcaaagcucuguucuacucucucauuaucauuggcaccuuagguaagaaaaucaagcaguaucgcgaacugaagccccagacauguacuaucugcgagaccgccccugucaacgcaauugaugccgagaugcaugaccuuaauuguagcuacaacauaugcccauauugugcuuccagauugacaucagacgggcuggcaaggcacgugccccagugcccuaaacggaaggaaaaaguagaggaaaccgagcuauaccucaaucuggaacgcaucccauggauuguucgaaaacuucugcaagugagugagagcacgggagucgccuugaaaagaucuuccuggcucaucgugcuguuagugcugcucacugucucacuuagcccgguucagagugcucccgugggcaggaagccucuguuuuuggauucuauaguaaaaggcaugaagaaccuacuuaauuccacaagccucgagaccucgcugucuauugaagccccauggggagcgaucaacgugcaguccacuuucaagcccacagucucaaccgcaaauaucgcccuuaguuggagcuccguggagcaccgggggaacaaaauucugguuacgggucguucugaaagcaucaugaaguuggaggaacgcaccggcgugucaugggaccucggggucgaugacgcuagugaguccaaacuguuaacagugagcauuauggaucugucucagauguacucaccuguauuugaguaucuaaguggagacagacaaguugaagaguggccaaaggccacuuguaccggcgauugccccgaaaggugugguugcacaagcuccacuugucuccauaaagaguggccgcacucucggaauuggcgaugcaacccuaccuggugcuggggcguggggacaggauguaccugcuguggcgucgacgugaaggaucuguucacugaccauauguuugucaaguggaaaguggaauacauaaagacggaggcaaucguuugcguggagcuuacaucgcaggaacgccaguguagcuugauugaggcugggaccagauucaaccugggacccguaacuaucacccucuccgaaccaaggaauauccaacagaaacugccucccgagauuauaacacuucacccaaaggucgaggaagguuucuuugaucugaugcacgugcagaaaguuuugucagccaguaccgugugcaagcuccagucuuguacucauggcauccccggggaccugcaagucuaucacauuggaaacuuacugaagggcgaccgggugaauggucaucuaauccacaaaauugagccucauuucaacacaagcuggauguccugggaugggugcgaccucgauuacuauuguaauaugggcgacuggccaucaugcacguacaccggaguaacucagcacaaccacgcggccuuugugaaucugcuuaacaucgaaacagauuauaccaagacauuccauuuucacagcaaacgcguuacugcacauggcgacaccccgcaguuggaucugaaggcuagacccacguacggggccggagagauaaccguccucguggaaguggcugacauggagcugcacacaaagaaggucgagaucucugguuuaaaguucgccucccuggcauguacuggcugcuacgccugcaguagcgggauuucuuguaaaguuaggauccacguggaugaaccugacgagcuuaccgugcauguaaaguccaaugauccagacgucguggcugcgucaacaaguuugauggcacguaaacucgaauuuggaacugauagcaccuucaaggccuuuucggcuaugcccaaaacgucccugugcuucuauauuguugagcgggaauacuguaagucuugcagcgaggaggacacacagaaauguguggacaccaagcuagaacaaccucagucaauccugauagagcacaagggcacuauuaucgguaaacagaacgauacaugcaccgccaaggcaggguguuggcucgaaagugucaaauccuuuuucuauggccugaagaauaugcuuggaucuguguuuggcaacuucuucauugggaucuugcuguuuuuagccccauucguucuccuggugcuguuuuucauguuuggauggaaaauacuguucugcuuuaaguguugccgaagaacuaggggcuugcucaaguaccgccugcuaaaagacgaugaggaaaccgguuaucggagaaucauugagaggcugaauaacaagaaagggaagaaucgccuccuggacggagagcgacuugcugaucggaaaaucgccgaauuguucagcacaaagacgcauauuggc

SEQ ID NO: 10619 - RNA, 2916 nt, Artificial Sequence
  derived and/or modified CDS sequence (opt3) from CCHFV(75-R-2012, Artificial)__KR814863.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccgcaccaguuaagugucgacaggguuuuugcuuaaaaaucacacaggaggggcguggacaugugaagcugucuagaggcucggaaguagugcuagaugccugugacucaagcugcgaggucaugauaccgaagggcaccggggauauccucguggacuguaguggaggucagcaacacuuccugaaagauaaccuuauugaccugggcugcccccauaucccuuugcucgggaagauggcgauuuacaucuguaggauguccaaucacccacggacuacaauggcuuuucuguucugguuuucuuucggauauguuauaaccugcaucuuuugcaaagcccuguucuacagccucauuauuaucggcacguuagguaagaaaaucaagcaguaucgcgaacugaagccccagacuuguaccauuugcgagacagcaccugugaacgccauagaugcugagaugcaugaccuuaauuguuccuacaacaucugcccauauugugcaucaagauugaccagugacgggcuggccaggcacgucccccagugcccuaaacggaaggaaaaaguggaggaaaccgagcuauaccucaaucuggaacgcauuccauggaucguacgaaaacuucugcaaguuagcgagucuacaggaguggcuuugaagagauccucauggcucauaguccuguuagugcugcucaccgugagccuuaguccgguccagucugcccccguuggcaggaagccucuguuuuuggauuccauugugaaaggcaugaagaaccuacugaauagcacgucgcucgagacuucucuguccaucgaagcgccauggggagcaaucaacguacagucaacauucaagcccaccgugaguacugccaauauugcucuuagcugguccucugucgagcaccgggggaacaaaauccuggugacaggucguagcgaaucaauuaugaaguuggaggaacgcaccggcguuaguugggaccucgggguggaggaugccuccgagagcaaacuguuaacggucucuauaauggaccugucacagauguacaguccuguguuugaauaucuaagcggagauagacaaguagaggaauggccaaaggcaaccuguacaggcgacugccccgagaggugugguugcacuuccucuaccugucuccauaaagaauggccgcacucgcggaauuggcgaugcaacccuacauggugcuggggcguugggacuggauguaccugcuguggcguggaugucaaggaccuguucacagaucauauguuugugaaguggaaagucgaguacaucaagaccgaggcuauugugugcguugaacuuacuagccaggagcgccaguguuccuugaucgaagccgggacgagauucaaccugggacccgugacaaucacccucucagagccaaggaauauucaacagaaacugccucccgagauaaucacucuucacccaaagguagaagaggguuucuuugaccugaugcacguccagaaaguguugagugcgucuaccguuugcaagcuccagagcuguacacauggcauucccggggaucugcaaguguaucacaucggaaacuuacugaagggcgaccgggucaauggucaucuaauucacaaaaucgaaccucauuucaacaccuccuggaugucaugggacgggugcgaucucgacuacuauuguaauaugggcgauuggccaagcugcacuuacacaggagugacgcagcacaaccacgccgcauuuguaaaucugcuuaacauagagaccgacuauacuaagacauuccauuuucacucuaaacgcgugaccgcucauggcgauacaccgcaguuggaccugaaggccagacccacuuacggggcuggagaaaucaccguucucgucgagguggccgauauggagcugcacacgaaaaagguggaaauuuccgguuuaaaguucgcaagucuggccuguaccggcugcuacgcuugcagcucugggaucuccuguaaagucaggauucacguugacgagccugaugaacuuacagugcaugugaagucaagugacccagauguagucgcggcaagcacuucguugauggcccguaaacucgaguuuggaaccgacuccacauucaaggcuuuuucugccaugcccaaaacuagccugugcuucuauaucguggaacgggaguacuguaagucaugcagugaggaagauacccagaaauguguugacacgaagcuagagcaaccucaguccauacugauugaacacaagggcacaaucauugguaaacagaaugacacuugcacugcaaaggccucuuguuggcucgagagcgugaaauccuuucuguaugggcuuaagaacauguugggcucagucuucggaaacuuuuucaucggcauacuguuauuccucgcuccauuugugcugcuuguucuguucuuuauguucggguggaaaaucuuguuuugcuucaaguguugccgaagaacaaggggacuccugaaguaccgccuacugaaagaugacgaagagaccggcuaucggagaauuaucgagaggcucaauaauaagaaagguaagaaccgccugcuugauggggaacgauuggccgaccggaaaauugcagagcuguuuagcacuaagacccauaucgga

SEQ ID NO: 10620 - RNA, 2916 nt, Artificial Sequence
  derived and/or modified CDS sequence (opt3) from CCHFV(75-ST-2010, Artificial)__KR814864.1__Gn-4aa-Gc
agcgaggaauccggcgacgauugcaucucuagaacccagcugcucaggacagagacugccgaaauucacgacgauaacuacgggggacccggugacaagauaacgaucuguaauggcucaaccauuguggaucaacggcuugggagugagcugggaugcuauacaaucaaccgcgucaagagcuucaaguugugugaaaauuccgcuacuggcaaaaccugcgagauugacucuacaccuguuaagugucgacaggguuuuugcuuaaaaaucacccaggaggggcguggacaugugaagcugucgagaggcucagaaguagugcuagaugcaugugacagcaguugcgaggucaugauaccaaagggcacuggggauauccucguggacuguuccggaggucagcaacacuuccugaaagauaaccuuauugaccugggcugcccgcauauccccuugcucgggaagauggccauuuacaucuguaggaugucuaaucacccucggacaaccauggcguuucuguucugguuuagcuucggauauguuauaacgugccuguuuugcaaagcucucuucuacuccuuaauuaucauuggcacucuggguaagaaaaucaagcaguaucgcgaacuuagaccacagaccuguacaaucugcgagacugcccccgugaacgcaauugaugccgagaugcaugacuugaauuguucauacaacauaugcccuuauugugcuaguaggcugaccagcgacgggcuagcacggcacgucccacagugccccaagcgcaaagaaaagguggaggaaacagagcucuaccugaaucuugaacgaaucccuuggauuguaagaaaacuguugcaaguuucugaguccaccggaguggcccucaagaggucaagcuggcugaucgucuuacuggugcuccuuacggugagucugucuccaguccaguccgcuccgguuggccggaaacccuuguuucuagauagcauagugaagggcaugaaaaaccugcucaauucgacuucucuggagacaucccuuucaauugaagccccuuggggagcgaucaacguacagaguaccuucaagccaacugugagcacagcaaauaucgcccuguccuggucuagcgucgagcaccgugggaacaagauuuuggugaccggucgcucagaaaguaucaugaaacucgaggaaagaacgggcguuuccugggaccuggggguggaggaugcuagcgagucuaaguuacugaccgucucaauuauggaccuaagucagauguacagccccguguuugaauaucucuccggagauaggcaaguagaggaauggccuaaagccacauguacuggcgacugcccagagcggugugguugcaccucuucgacaugucugcauaaggaauggccccacagccgaaauuggcgcugcaacccgacuuggugcuggggcguugggaccggauguacaugcuguggcguggaugucaaagaccuuuucaccgaucauauguuugugaaguggaaggucgaguacauaaaaacugaggcaaucgugugcguugaauugacgucccaggagagacaguguucacugauugaagcugggacaagguucaaccucggaccugugaccaucacucugagugagccccggaauauccaacagaaacuuccaccugagauuauaacccugcaccccaaaguagaagaggguuucuuugacuugaugcacguccagaaggugcucucugccagcacaguuugcaaacugcaguccuguacccauggcaucccaggggauuuacaaguguaucacauuggaaaccugcuaaagggcgaccgcgucaauggucaucucauccacaagauugaaccccauuucaacacuucauggaugagcugggacgggugcgaucuggacuacuauuguaauaugggcgauuggccuucuugcacauacacgggagugacccagcacaaccacgcggccuuuguaaaucuuuugaacaucgagacugacuauacaaaaaccuuccauuuucacuccaagagagugacagcacauggcgauacuccacagcuggaccucaaagcuaggccgaccuacggggccggagaaauaacgguucuggucgagguggcugauauggaguuacacaccaagaaaguggaaaucaguggucugaaguucgccagccuugcauguacaggcugcuacgccuguucuuccgggauuucaugcaagguccguauccacguugacgagcccgaugaauugacugugcaugugaaaaguagcgacccugauguagucgcugcgucgaccucccucauggcacggaagcuggaguuuggaacagacucuacuuucaaagccuuuagcgcuaugccaaagaccucacuaugcuucuauauuguggaacgagaguacuguaaaaguugcuccgaggaagauacgcagaaguguguugacacaaaacuggagcaaccccagucuauccucauagaacacaagggcaccauuaucgguaagcagaaugacacuugcacagccaaagcaagcuguuggcuggaguccgugaagucauuuuucuaugggcuuaaaaacauguugggcagcgucuuuggaaauuucuucauuggcauccuguuauuucucgccccuuucgugcugcuuguucuguuuuucauguuuggguggaagauauuguucugcuuuaaauguugcagaagggcucgcggacuccugaaguaccggcaucuaaaggaugacgaagagaccggcuauagaaaaaucauugagaggcugaacaauaagaaagguaagaaccgccuccuggauggggaacgacuugccgaccggaaaaucgcagaguuguucaguacuaagacccacauugga

SEQ ID NO: 10621 - RNA, 2916 nt, Artificial Sequence
  derived and/or modified CDS sequence (opt3) from CCHFV(3756-ST-2007, Artificial)__KR814866.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuacagccucauuaucaucggcacuuuagguaaaaagauuaagcaguaucgggaacugaaaccccagaccuguacaauaugcgagacugccccuguuaacgcaaucgaugccgagaugcaugaccuuaauuguuccuacaacauuugcccauauugugcuucacgcuugaccagugacgggcuggcaagacacgugacacagugccccaagaggaaagaaaaggucgaggaaaccgagcuauaccucaaucuggaacggaucccuuggauagugcgcaaacuucugcaaguaagcgagucuacgggaguugccuugaagcgauccucauggcucauugugcuguuaguccugcucacugugagccuuaguccagugcagucugcuccggucggcagaaaaccccuguuuuuggauuccaucguuaagggcaugaagaaccuacugaauagcacaucgcucgagaccucucuguccaucgaagccccuuggggagcgauuaacgugcagucaacuuucaaaccaacaguaaguaccgcaaauaucgcccuuagcugguccucuguggagcacaggggaaacaagauucuggucacgggucggagcgaaucaauaaugaaauuggaggaacguaccggcgugaguugggaccucgggguugaggaugcuuccgagagcaagcuguuaacagugucuaucauggaccugucacagauguacagucccgucuuugaauaucuaagcggagaucgccaaguggaggaauggccuaaagccacuuguaccggcgacugcccagagagaugugguugcacauccucuacuugucuccauaaggaauggccccacucgaggaauuggcggugcaacccgaccuggugcuggggcguagggacaggauguaccugcuguggcguugaugugaaggaccuguucacugaucauauguuuauuaaauggaaggucgaguacaucaaaacggaggcaaucgugugcgucgaacuuacaagccaggagcgacaguguuccuugauugaagcugggacccgcuucaaccugggaccugugacuauaacccucucagagcccagaaauauccaacagaagcugccaccugagauuaucacacuucaccccaaaauugaagaggguuucuuugaccugaugcacguucagaagguguugagugccucuaccguaugcaagcuccagagcuguacucauggcaucccaggggaucugcaaauauaucacaucggaaacuuacugaaaggcgacagggucaauggucaucuaauucacaagaucgaaccccauuucaacacauccuggaugucaugggacgggugcgaucucgacuacuauuguaauaugggcgauuggccuagcugcacguacaccggagugacucagcacaaccacgcggccuuuguuaaucugcuuaacauugagacagacuauaccaaaacauuccauuuucacucuaagcgggugacugcacauggcgauaccccacaguuggaccugaaagcucgcccgacguacggggccggagaaaucaccguccucguggagguagcugauauggagcugcacacaaagaagguggaaauauccgguuuaaaauucgccagucugacuuguaccggcugcuacgcaugcagcucugggauuuccuguaagguuagaauccacgucgacgagcccgaugaacuuacagugcaugugaaaucaagugacccugaugucguugccgcuagcacuucguugauggcgaggaagcucgaguuuggaaccgacuccacguucaaagcauuuucugccaugccaaagacaagccugugcuucuauauuguggaacgugaguacuguaaaucaugcagugaggaugacaccaagaaguguguggacacuaaacuagaacagccccaauccauccugauagagcacaagggcacaaucauugguaaacagaaugauaccugcacugcuaaggccucuuguuggcucgaaagcguaaaauccuuuuucuaugggcugaagaacaugcuuggcucagucuuugggagcuucuucgugggcaucuugcuguuuuuaaccccuuucguucuccuggugcuguuuuucauguuuggguggaagauucuuuucugcuuuaaauguugccggcgaacaagaggauuguucaaguacaggcaucucaaagacgaugaggaaacgggcuaucgccggaucauagagagacugaauaguaagaaagguaagaacaggcuacuggacggggagcgccucgcagaucgaaagauugccgaacuguuuucuaccaaaacucacaucgga

SEQ ID NO: 10622 - RNA, 2916 nt, Artificial Sequence
  derived and/or modified CDS sequence (opt3) from CCHFV(3809-ST-2007, Artificial)__KR814867.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaagagauccucauggcucauaguccuguuagugcugcucacggugagccuuaguccgguccagucugcucccguuggcaggaagccucuguuuuuggauuccauugugaaaggcaugaagaaccuacugaauagcacuucgcucgagacaucucuguccaucgaagccccauggggagcgaucaacguacagucaaccuucaagcccacugugaguacagcaaauauugcccuuagcugguccucugucgagcaccgggggaacaaaauccuggugaccggucguagcgaaucaauuaugaaguuggaggaacgcacgggcguuaguugggaccucgggguggaggaugcuuccgagagcaaacuguuaaccgucucuauaauggaccugucacagauguacaguccuguguuugaauaucuaagcggagauagacaaguagaggaauggccaaaggccacauguacuggcgacugccccgagaggugugguugcaccuccucuacaugucuccauaaagaauggccgcacucgcggaauuggcgaugcaacccuacuuggugcuggggcguugggaccggauguacaugcuguggcguggaugucaaggaccuguucaccgaucauauguuugugaaguggaaagucgaguacaucaagacugaggcaauugugugcguugaacuuacgagccaggagcgccaguguuccuugaucgaagcugggacaagauucaaccugggacccgugaccaucacucucucagagccaaggaauauucaacagaaacugccucccgagauaaucacccuucacccaaagguagaagaggguuucuuugaccugaugcacguccagaaaguguugagugccucuacaguuugcaagcuccagagcuguacccauggcauucccggggaucugcaaguguaucacaucggaaacuuacugaagggcgaccgggucaauggucaucuaauucacaaaaucgaaccucauuucaacacuuccuggaugucaugggacgggugcgaucucgacuacuauuguaauaugggcgauuggccaagcugcacauacacgggagugacccagcacaaccacgcggccuuuguaaaucugcuuaacauagagacugacuauacaaagaccuuccauuuucacucuaaacgcgugacagcacauggcgauacuccgcaguuggaccugaaggcuagacccaccuacggggccggagaaaucacgguucucgucgagguggcugauauggagcugcacaccaaaaagguggaaauuuccgguuuaaaguucgccagucuggcauguacaggcugcuacgccugcagcucugggaucuccuguaaagucaggauucacguugacgagccugaugaacuuacugugcaugugaagucaagugacccagauguagucgcugcgagcaccucguugauggcacguaaacucgaguuuggaacagacuccacuuucaaggccuuuucugcuaugcccaaaaccagccugugcuucuauaucguggaaaaggaguacugucggucaugcagugaggaagauacgcagaaauguguugacacaaagcuagagcaaccucaguccauacugauugaacacaagggcaccaucauugguaaacagaaugacacuugcacagccaaggcaucuuguuggcucgagagcgugaaauccuuuuucuaugggcugaagaacaugcuuggcucagucuuuggaaauuucuucaucggcauauugcuguuuuuaaccccauucgugcuccugguucuguuuuucauguuuggguggaaaauccuuuucugcuuuaaguguugccgaagaacuaggggauugcucaaguaccgccaucugaaagaugacgaagagaccggcuaucggagaauuaucgagaggcuaaacaauaagaaagguaagaaccgccugcucgauggggaacgacuggccgaccggaaaauugcugagcuuuucagcacaaagacgcacaucgga

SEQ ID NO: 10623 - RNA, 2916 nt, Artificial Sequence
  derived and/or modified CDS sequence (opt3) from CCHFV(3820-ST-2007, Artificial)__KR814868.1__Gn-4aa-Gc
agcgaggaacccggcgacgauugcaucuccagaacccagcugcucaagacagagacugccgaaauucacgacgauaacuacgggucuccuggagacaaaauaacgaucuguaaugguucaaccauuguggaucaaaggcuuggcagugagcuggggugcuauacaaucaaccgggucaagagcuucaaauugugugaaaauuccgcuacuggaaagaccugcgagauugacucuacaccaguuaaaugucgccagggcuuuugcuuaaagaucacccaggagggucgagggcaugugaagcugucgcguggaucagaaguagugcuagaugcaugugacagcaguugcgagauaaugaucccgaaaggcacuggcgauauucucgucgacuguuccgggggacagcaacacuuccugaaggauaaccuuaucgaccuggguugcccccauauuccuuugcucggcaaaauggccaucuacauauguagaaugucuaaucacccaaggacaaccauggcguuucuguucugguuuagcuucggguaugugauuacgugcaucuuuugcaaggcucuguucuacucccucauuaucaucggaacuuuaggcaaaaagauuaagcaguaucgggaacugaaaccccagaccuguacaauaugcgagacugccccuguuaacgcaaucgaugccgagaugcaugaccuuaauuguucauacaacauuugcccauauugugcuagucgcuugaccagcgacggucuggcaagacacgugacacagugccccaagaggaaagaaaaggucgaggaaaccgagcuauaccucaaucuggaacggaucccuuggauagugcgcaaacuucugcaaguaucugaguccacggggguugccuugaagcgaucaagcuggcucauugugcuguuaguccugcucgcugugagucuuucuccagugcaguccgccccggucggaagaaaaccccuguuuuuggauagcaucguuaagggcaugaagaaccuacuuaauucgacuucucucgagacaucccugucaaucgaagcgccuuggggcgcaauuaacgugcagaguaccuucaaaccaacuguaagcacagccaauaucgcucuuuccuggucuagcguggagcacagggggaacaagauucuggucaccggacggucagaaaguauaaugaaauuggaggaacguacggguguguccugggaccucggcguugaggaugccagcgagucuaagcuguuaaccgugucaaucauggaccugagucagauguacagccccgucuuugaauaucuauccggggaucgccaaguggaggaauggccuaaagcaacauguacuggagacugcccagagagauguggcugcaccucuucgacaugucuccauaaggaauggccccacagcaggaauuggcggugcaacccgacuuggugcugggguguagggaccggcuguacaugcuguggaguugaugugaaggaccuguucaccgaucauauguuuauuaaauggaaggucgaguacaucaaaacugaggcuaucgugugcgucgaacuuacgucccaggagcgacaguguucauugauugaagccggcacacgcuucaaccuggggccugugaccauaacucucagugagcccagaaauauccaacagaagcugccaccugagauuaucacccuucaccccaaaauugaagagggauucuuugaccugaugcacguucagaagguguugucugcgagcacaguaugcaagcuccaguccuguacccaugguaucccaggcgaucugcaaauauaucacaucgggaacuuacugaaaggagacagggucaauggccaucuaauucacaagaucgaaccccauuucaacacuucauggaugagcugggacgguugcgaucucgacuacuauuguaauaugggggauuggccuucuugcacauacacgggcgugacccagcacaaccacgccgcauuuguuaaucugcuuaacauugagacugacuauacaaaaaccuuccauuuucacuccaagcgggugacagcucauggagauacuccacaguuggaccugaaagcccgcccgaccuacggcgcuggggaaaucacgguccucguggagguagccgauauggagcugcacaccaagaagguggaaauaaguggauuaaaauucgcaagccugacauguacugguugcuacgccuguucuuccggcauuucaugcaagguuagaauccacgucgacgagcccgaugaacuuaccgugcaugugaaaaguagcgacccugaugucguugcugcgucgacauccuugauggcaaggaagcucgaguuugggacugacucuaccuucaaagccuuuagcgcuaugccaaagacgucacugugcuucuauauuguggaacgugaguacuguaaaaguugcuccgaggaugacacaaagaaguguguggacaccaaacuagaacagccccaaucuauccugauagagcacaagggaacuaucauuggcaaacagaaugauacaugcaccgccaaggcaagcuguuggcucgaauccguaaaaucauuuuucuauggucugaagaacaugcuugggagcgucuuuggcaguuucuucgugggaaucuugcuguuuuuagccccuuucguucuccuggugcuguuuuucauguuuggcuggaagauucuguucugcuuuaaauguugccggcgaacuagaggguuguucaaguacaggcaucucaaagacgaugaggaaaccggauaucgccggaucauagagagacuaaauucuaagaaaggcaagaacaggcugcuggacggugagcgccucgcugaucgaaagauugccgaacuguuuuccacaaaaacgcacaucggg

SEQ ID NO: 10624 - RNA, 2916 nt, Artificial Sequence
  derived and/or modified CDS sequence (opt3) from CCHFV(4495-ST-2008, Artificial)__KR814869.1__Gn-4aa-Gc
agcgaggaauccggcgacgauugcaucucuagaacccagcugcucaggacagagacugccgaaauucacgacgauaacuacgggggacccggugacaagauaacgaucuguaauggcucaaccauuguggaucaacggcuugggagugagcugggaugcuauacaaucaaccgcgucaagagcuucaaguugugugaaaauuccgcuacuggcaaaaccugcgagauugacucuacaccuguuaagugucgacaggguuuuugcuuaaaaaucacccaggaggggcguggacaugugaagcugucgagaggcucagaaguagugcuagaugcaugugacagcaguugcgaggucaugauaccaaagggcacuggggauauccucguggacuguuccggaggucagcaacacuuccugaaagauaaccuuauugaccugggcugcccgcauauccccuugcucgggaagauggccauuuacaucuguaggaugucuaaucacccucggacaaccauggcguuucuguucugguuuagcuucggauauguuauaacgugccuguuuugcaaagcucucuucuacuccuuaauuaucauuggcacucuggguaagaaaaucaagcaguaucgcgaacuuagaccacagaccuguacaaucugcgagacugcccccgugaacgcaauugaugccgagaugcaugacuugaauuguucauacaacauaugcccuuauugugcuaguaggcugaccagcgacgggcuagcacggcacgucccacagugccccaagcgcaaagaaaagguggaggaaacagagcucuaccugaaucuugaacgaaucccuuggauuguaagaaaacuguugcaaguuucugaguccaccggaguggcccucaagaggucaagcuggcugaucgucuuacuggugcuccuuacggugagucugucuccaguccaguccgcuccgguuggccggaaacccuuguuucuagauagcauagugaagggcaugaaaaaccugcucaauucgacuucucuggagacaucccuuucaauugaagccccuuggggagcgaucaacguacagaguaccuucaagccaacugugagcacagcaaauaucgcccuguccuggucuagcgucgagcaccgugggaacaagauuuuggugaccggucgcucagaaaguaucaugaaacucgaggaaagaacgggcauuuccugggaccuggggguugaggaugcuagcgagucuaaguuacugaccgugucaauaauggaccuaagucagauguacagccccgucuuugaauaucucuccggagauaggcaaguggaggaauggccuaaagccacauguacuggcgacugcccagagcggugugguugcaccucuucgacaugucugcauaaggaauggccccacagccgaaauuggcgcugcaacccgacuuggugcuggggcguagggaccggauguacaugcuguggcguugaugugaaagaccuuuucaccgaucauauguuugucaaguggaagguggaguacaucaaaacugaggcaauugucugcguggaauugacgucccaggagagacaguguucacugaucgaagcugggacaagguucaaccucggaccuguuaccaucacucugagugagccccggaauauucaacagaaacuuccaccugagauaaucacccugcaccccaaaguggaagaggguuucuuugacuugaugcacguacagaagguccucucugccagcacagugugcaaacugcaguccuguacccauggcauuccaggggauuuacaaguuuaucacaucggaaaccugcuaaagggcgaccgcgugaauggucaucucauucacaagaucgaaccccauuucaacacuucauggaugagcugggacgggugcgaucuggacuacuauuguaauaugggcgauuggccuucuugcacauacacgggagucacccagcacaaccacgcggccuuugugaaucuuuugaacauagagacugacuauacaaaaaccuuccauuuucacuccaagagaguaacagcacauggcgauacuccacagcuggaccucaaagcuaggccgaccuacggggccggagaaaucacggugcugguugaggucgcugauauggaguuacacaccaagaaaguggaaauuaguggucugaaguucgccagccuugcauguacaggcugcuacgccuguucuuccgggaucucaugcaaggugcguauucacgucgacgagcccgaugaauugacuguucaugugaaaaguagcgacccugaugugguagcugcgucgaccucccucauggcacggaagcuggaguuuggaacagacucuacuuucaaagccuuuagcgcuaugccaaagaccucacuaugcuucuauaucgucgaacgagaguacuguaaaaguugcuccgaggaagauacgcagagauguguggacacaaagcuggagcaaccccagucuauacucauugaacacaaaggcaccaucauugguaagcagaaugacacuugcacagccaaggcaagcuguuggcuggaguccguuaaaucauuuuucuaugggcuuaagaacauguugggcagcguguuuggaaauuucuucaucggcauacuguuauuucucgccccuuucguccugcuugugcuguuuuucauguuuggguggaaaaucuuguucugcuuuaaguguugcaggcgcgcucggggacuccugaaauacagacaucuaaaggaugacgaagagaccggcuauaggaagauuaucgagcgccugaacaauaaaaaggguaaaaaccgacuccuggauggggaacggcuugccgaccguaagauugcagaguuguucaguacuaaaacccacaucgga

SEQ ID NO: 10625 - RNA, 2916 nt, Artificial Sequence
  derived and/or modified CDS sequence (opt3) from CCHFV(4691-ST-2009, Artificial)__KR814871.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuacagccucauuaucaucggcacuuuagguaaaaagauuaagcaguaucgggaacugaaaccccagaccuguacaauaugcgagacugccccuguuaacgcaaucgaugccgagaugcaugaccuuaauuguuccuacaacauuugcccauauugugcuucacgcuugaccagugacgggcuggcaagacacgugacacagugccccaagaggaaagaaaaggucgaggaaaccgagcuauaccucaaucuggaacggaucccuuggauagugcgcaaacuucugcaaguaagcgagucuacgggaguugccuugaagcgauccucauggcucauugugcuguuaguccugcucacugugagccuuaguccagugcagucugcuccggucggcagaaaaccccuguuuuuggauuccaucguuaagggcaugaagaaccuacugaauagcacaucgcucgagaccucucuguccaucgaagccccuuggggagcgauuaacgugcagucaacuuucaaaccagcaguaaguacagccaauaucgcucuuagcugguccucuguggagcacagggggaacaagauucuggucaccggucggagcgaaucaauaaugaaauuggaggaacguacgggcgugaguugggaccucgggguugaggaugccuccgagagcaagcuguuaaccgugucuaucauggaccugucacagauguacagucccgucuuugaauaucuaagcggagaucgccaaguggaggaauggccuaaagcaacauguacuggcgacugcccagagagaugugguugcaccuccucuacaugucuccauaaggaauggccccacucgaggaauuggcggugcaacccgacuuggugcuggggcguagggaccggauguacaugcuguggcguugaugugaaggaccuguucaccgaucauauguuuauuaaauggaaggucgaguacaucaaaacugaggcuaucgugugcgucgaacuuacgagccaggagcgacaguguuccuugauugaagccgggacacgcuucaaccugggaccugugaccauaacucucucagagcccagaaauauccaacagaagcugccaccugagauuaucacccuucaccccaaaauugaagaggguuucuuugaccugaugcacguucagaagguguugagugcgucuacaguaugcaagcuccagagcuguacccauggcaucccaggggaucugcaaauauaucacaucggaaacuuacugaaaggcgacagggucaauggucaucuaauucacaagaucgaaccccauuucaacacuuccuggaugucaugggacgggugcgaucucgacuacuauuguaauaugggcgauuggccuagcugcacauacacgggagugacccagcacaaccacgccgcauuuguuaaucugcuuaacauugagacugacuauacaaaaaccuuccauuuucacucuaagcgggugacagcucauggcgauacuccacaguuggaccugaaagcccgcccgaccuacggggcuggagaaaucacgguccucguggagguagccgauauggagcugcacaccaagaagguggaaauauccgguuuaaaauucgcaagucuggccuguacaggcugcuacgcuugcagcucugggauuuccuguaagguuagaauccacgucgacgagcccgaugaacuuacugugcaugugaaaucaagugacccugaugucguugcggcaagcaccucguugauggccaggaagcucgaguuuggaacagacuccacuuucaaggcuuuuucugccaugccaaaaaccagccugugcuucuauauuguggaacgugaguacuguaaaucaugcagugaggaugacacgaagaaguguguggacacaaaacuagaacagccccaauccauccugauagagcacaagggcaccaucauugguaaacagaaugauacuugcacagcaaaggccucuuguuggcucgaaagcguaaaauccuuuuucuaugggcugaagaacaugcuuggcucagucuuuggaaauuucuucgugggcaucuugcuguuuuuagcuccuuucguucuccuggugcuguuuuucauguuuggguggaagauucuuuucugcuuuaaauguugccggcgaaccagaggauuguucaaguacaggcaucucaaagacgaugaggaaacuggcuaucgccggaucauagagagacugaacagcaagaaagguaagaauaggcuacuggacggggagcgccucgccgaucgaaagauugcagaacuguuuaguaccaaaacacacaucgga

SEQ ID NO: 10626 - RNA, 2916 nt, Artificial Sequence
  derived and/or modified CDS sequence (opt3) from CCHFV(4701-ST-2009, Artificial)__KR814872.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccguggucgaucaaaggcuugggucagagcugggaugcuauacaauuaaccggguuaagaguuucaaauugugugaaaauagcgcuacuggcaagaccugcgagaucgacuccacaccagugaaaugucgccaggguuuuugcuuaaagauuacccaggaggggcgaggacauguaaagcugucucguggcucggaagugguccuagaugcaugugacucaagcugcgagaucaugauaccgaaaggcacuggggauauccucguggacuguaguggaggucagcaacacuuccugaaggauaaccuuauugaccugggcugcccccauaucccuuugcucgggaaaauggccauuuacaucuguagaauguccaaucacccaaggacaaccauggcguuucuguucugguuuucuuucggauauguuauaacgugcaucuuuugcaaggcucuguucuacagccucauuauuaucggcacuuuagguaaaaagaucaagcaguaucgggaacugaaaccccagaccuguacaauuugcgagacugccccugugaacgcaauagaugccgagaugcaugaccuuaauuguuccuacaacaucugcccauauugugcuucacgcuugaccagugacgggcuggcaagacacgucacacagugccccaagaggaaagaaaagguggaggaaaccgagcuauaccucaaucuggaacggauuccuuggaucguacgcaaacuucugcaaguuagcgagucuacgggaguggccuugaagcgauccucauggcucauaguccuguuagugcugcucacugugagccuuaguccaguccagucugcuccgguuggcagaaaaccccuguuuuuggauuccauugugaagggcaugaagaaccuacugaauagcacaucgcucgagaccucucuguccaucgaagccccuuggggagcgaucaacguacagucaacuuucaaaccaacagugaguaccgcaaauauugcccuuagcugguccucugucgagcacagggggaacaagauccuggugacgggucggagcgaaucaauuaugaaauuggaggaacguaccggcguuaguugggaccucgggguggaggaugcuuccgagagcaagcuguuaacagucucuauaauggaccugucacagauguacagucccguguuugaauaucuaagcggagaucgccaaguagaggaauggccuaaagccacuuguaccggcgacugcccagagagaugugguugcacauccucuacuugucuccauaaggaauggccccacucgaggaauuggcggugcaacccgaccuggugcuggggcguugggacaggauguaccugcuguggcguggaugucaaggaccuguucacugaucauauguuuaucaaauggaagguggaguacauuaaaacggaggcaaucgucugcguggaacuuacaagccaggagcgacaguguuccuugaucgaagcugggacccgcuucaaccugggaccuguuacuauuacccucucagagcccagaaauauacaacagaagcugccaccugagaucauuacacuucaccccaaaaucgaagaggguuucuuugaccugaugcacgugcagaagguauugagugccucuaccgucugcaagcuccagagcuguacucauggcauuccaggggaucugcaaaucuaucacauaggaaacuuacugaaaggcgacagggugaauggucaucuaauccacaagauugaaccccauuucaacacauccuggaugucaugggacgggugcgaucucgacuacuauuguaauaugggcgauuggccuagcugcacguacaccggaguuacucagcacaaccacgcggccuuugugaaucugcuuaacaucgagacagacuauaccaaaacauuccauuuucacucuaagcgggucacugcacauggcgauaccccacaguuggaccugaaagcucgcccgacguacggggccggagaaauuaccgugcucguagagguggcugauauggagcugcacacaaagaagguugaaaucuccgguuuaaaauucgccagucugacuuguaccggcugcuacgcaugcagcucugggauauccuguaaggucaggauucacguggacgagcccgaugaacuuacagugcaugucaaaucaagugacccugauguuguggccgcuagcacuucguugauggcgagaaagcucgaguuuggaaccgacuccacguucaaagcauuuucugccaugccaaagacaagccugugcuucuauaucguggaacgugaguacuguaaaucaugcagugaggaugacaccaagaaguguguagacacuaaacuagaacagccccaauccauucugaucgagcacaagggcacaauaaucgguaaacagaaugauaccugcacugcuaaggccucuuguuggcucgaaagcgucaaauccuuuuucuaugggcugaagaacaugcuuggcucaguguuuggaggcuucuucguugggauuuugcuguuuuuagcaccuuucgugcuccugguccuguuuuucauguuuggauggaagauccuuuucugcuuuaaauguugccggcgaaccagaggcuuguucaaguacaggcaucucaaagacgaugaggaaacagguuaucgccggauuaucgagagacugaauagcaagaaagggaagaacaggcuacuggacggagagcgccucgccgaucgaaagauagcugaacuguuuaguacgaaaacccacauuggc

SEQ ID NO: 10627 - RNA, 2916 nt, Artificial Sequence
  derived and/or modified CDS sequence (opt3) from CCHFV(5170-R-2011, Artificial)__KR814873.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugucugugacucaagcugcgagauaaugaucccgaaaggcacuggggauauucucguggacuguaguggaggucagcaacacuuccugaaggauaaccuuaucgaccugggcugcccccauauuccuuugcucgggaaaauggcaaucuacauauguagaauguccaaucacccaaggacaaccauggccuuucuguucugguuuucuuucggauauguuauuacgugcaucuuuugcaaggcgcuguucuacagccucauuaucaucggcacuuuagguaaaaagauuaagcaguaucgggaacugaaaccccagaccuguacaauaugcgagacugcuccugugaacgccaucgaugcagagaugcaugaccuuaauuguuccuacaacauuugcccauauugugccucacgcuugaccagugaagggcuggcuagacacgucacacagugccccaagaggaaagagaagguggaagagaccgaacuauaccucaaucuggagcggaucccuuggauaguacgcaaacuucugcaaguuagcgagucuacgggaguggcauugaagcgauccucauggcucauuguccuguuagugcugcucacugugagccuuaguccaguccagucugccccgguuggcagaaaaccccuguuuuuggacuccaucgugaagggcaugaagaaccuacugaauagcacaucgcucgaaaccucucuguccaucgaggcuccuuggggagccauuaacguacagucaacuuucaaaccaacagugaguaccgcgaauaucgcacuuagcugguccucugucgaacacaggggaaacaagauucuggugacgggucggagcgagucaauaaugaaauuggaggaacguaccggcguuaguugggaucucgggguggaggacgccuccgaaagcaagcuguuaacagucucuaucauggaucugucacagauguacagucccguguuugaguaucuaagcggagaccgccaaguagaagaguggccuaaagcuacuuguaccggcgauugcccagaaagaugugguugcacauccucuacuugucuccauaaggaguggccccacucgaggaauuggcggugcaacccgaccuggugcuggggcguugggacaggauguaccugcuguggcguggacgucaaggaucuguucacugaccauauguuuauuaaauggaagguggaguacaucaaaacggaagccaucgucugcguggagcuuacaagccaggaacgacaguguuccuugauugaggcagggacccgcuucaaccugggaccuguuacuauaacccucucagagcccagaaauauccaacagaagcugccaccugaaauuaucacacuucaccccaaaauugaggaagguuucuuugaucugaugcacgugcagaagguauugagugcuucuaccgucugcaagcuccagagcuguacucauggcaucccaggggaccugcaaauauaucacaucggaaacuuacugaaaggcgauagggugaauggucaucuaauucacaagaucgagccccauuucaacacauccuggaugucaugggacgggugcgaccucgauuacuauuguaauaugggcgacuggccuagcugcacguacaccggaguuacucagcacaaccacgccgcguuugugaaucugcuuaacauugaaacagauuauaccaaaacauuccauuuucacucuaagcgggucacugcccauggcgacaccccacaguuggaucugaaagcacgcccgacguacggggcuggagagaucaccgugcucguagagguggccgacauggaacugcacacaaagaagguugagauauccgguuuaaaauucgcuagucugacuuguaccggcugcuacgccugcagcucugggauuuccuguaaggucagaauccacguggaugaacccgacgagcuuacagugcaugucaaaucaagugauccugacguuguggcagccagcacuucguugauggcuaggaagcucgaauuuggaaccgauuccacguucaaagcguuuucugcaaugccaaagacaagccugugcuucuauauuguggagcgugaguacuguaaaucaugcagugaagacgauaccaagaaguguguagacacuaaacuagagcagccccaauccauccugauagaacacaagggcacaaucauugguaaacagaaugauaccugcacugccaaggcuucuuguuggcucgagagcgucaaauccuuuuucuaugggcugaagaacaugcuuggcucaguguuugggagcuucuucguuggcaucuugcuguuuuuagccccuuucgugcuccugguccuguuuuucauguuuggguggaagauucuuuucugcuuuaaauguugccggcgaaccagaggauuguucaaguacaggcaucucaaagacgacgaagagacaggcuaucgccggaucauagagagacugaauaguaagaaagguaagaacaggcuacuggauggggaacgccucgcagaccgaaagauugccgagcuguuuucuacgaaaacccacaucgga

SEQ ID NO: 10628 - RNA, 2916 nt, Artificial Sequence
  derived and/or modified CDS sequence (opt3) from CCHFV(Oman-199809166, Artificial)__KR864901.1__Gn-4aa-Gc
agcgaggaauccggcgaggacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaaaucuuucaaguugugugaaaauuccgcuacugguaaaucuugcgagauugacaacaccccuguuaaguguaaacagggguuuugcuuaaagaucacacaggaaggacgaggccaugugaagcugucgcgugauucagagguagugcuagacgcaugugauagcaguugcgaaauaaugaucccaaaaggcaccggggacauucucgucgauuguuccggaggucagcaacacuuccugaaggacaaucuuaucgaucugggcugcccgaacauucccuugcucgggaaaauggccaucuacauauguagaaugucuaaucauccuaagacuacaauggcguuucuguucugguuuagcuucggauaugugauuaccugcauccugugcaaaguuaucuuuuaccucuuaauuguggucggcacgcuggguaagaaguucaaacaguauagggagcuuaagccacagacuuguaccaucugcgagacaacucccgugaacgcuauugacgccgaaaugcacgauuugaauuguuccuacaacauaugcccuuauugugcaucacggcugaccagugacgggcuagcccgccauguaaugcagugcccaaaaagaaaggagaaaaucgaagagacagaacucuaccugaaucuugagaggauucccuggguugugcggaagcuguugcaagucagcgagucuaccggaguggcucucaaacgcuccucauggcugaucguguuacugguccuccuuacgguuagccugaguccugugcagucugcaccaauaggccgaaagccguuguuucuagacuccauugccaagggcaugaaaaaccugcucaauagcacuucgcuggaaacaucucuuuccaucgaggcucccuggggagccaucaacguacagucaaccuucaagccuacugugaguacagcgaauauugcacugagcugguccucugucgaacacagagggaacaaaaucuuggugagcgguaggucagagaguauuaugaagcucgaggagcggaccggcauauccugggaucuggggguugaggacgccagcgaaucuaaauuacugacggugucagucauggaucuaagucagauguacagcccaguguuugaguaucucuccggagaccgucaaguagaagaguggcccaaggcuaccuguacaggcgauugcccugaacgcugugguugcacuucuucgaccugucugcacaaggaguggccacauagcagaaacuggaggugcaaucccacauggugcuggggcguugggacuggauguaccugcuguggccuugacgugaaagauuuguucacagacuacauguuugucaaguggaaaguggaguauaucaagaccgaagccauugucugcguggagcugacuucccaggaacggcaguguucacucaucgaggcagggacgcgauucaaccugggaccgguuacaaucacccuuagugagccucgcaauauucaacagaaacugcccccagaaauagugacuuugcacccuagaaucgaggaagguuucuuugaucucaugcauguacagaagguccugucugcuagcaccgugugcaaguuacaguccuguacacacggcguucccggggaccugcaaguguaccacauuggaaaccuacucaaaggcgauaaggucaauggucaucugauccacaaaguggagccacauuucaacaccucauggaugagcugggacgggugcgaccuugauuauuacuguaauaugggcgacuggcccucuugcacuuauacaggaguaacgcagcacaaccaugccgcguuugugaauuugcugaacauugaaaccgauuacacuaagaauuuccacuuucacuccaaaaggguuacagcccauggcgacaccccucagcucgaucugaaggcacggccaaacuacggggcuggagagaucacagucuuaguggagguggccgacauggaacugcacacuaagaaaauagagaucaguggucuuaaguucgcuagcuugaccuguacgggcugcuaugccugcagcuccgggauuucauguaaaguccgcauccauguugaugaaccggacgagcucaccgugcacgugaagagugaagaucccgacauuguagcagccagcucgucccugauggcuagaaaacuagaguuuggaacagauucuacuuucaaggcguuuagcgcaaugccuaaaaccucacugugcuucuacaucgucgagagggaauauuguaagaguugcuccaaggaggacacacagaaaugugugaaugccaagcucgaacguccacaaucuauacugauugagcacaaaggcacuaucauugguaagcagaacgauaccugcacggcuaaagccagcuguuggcuugaauccguuaagucauuuuucuacggguugaagaauaugcugagcggcaucuuuggaaacguguucauaggcaucuucuuauuucucgcacccuucauucugcuuauccuguuuuucauguuuggguggcggauuuuguucugcuuuaaauguugccgaagaacaaggggacucuucaaguaucgccaucugaaagacgacgaggagaccggcuaccggaagaucauagaaagacuaaacaauaaaaaggguaagaacaaacugcucgauggggagaggcuggccgaccgcaagauugcugaacuuuuuaguacuaaaacacacaucgga

SEQ ID NO: 10629 - RNA, 2916 nt, Artificial Sequence
  derived and/or modified CDS sequence (opt3) from CCHFV(200406546-Turkey, Artificial)__KR864902.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugucugugacucaagcugcgaggugaugauaccgaagggcacuggggauauccucguugacuguaguggaggucagcaacacuuccugaaagauaaccuuauugaccugggcugcccccaugugccuuugcucgggaggauggcaaucuacauuugucggauguccaaucacccacgcacaaccauggccuuucuguucugguuuucuuucggauaugucaucacgugcauauuuugcaaggcgcuguucuacagccucauuaucauuggcacuuuagguaaaaaguuuaaacaguauagagaacugaagccccagaccuguacaaucugcgagacugcuccugugaacgccaucgaugcagagaugcaugaccuuaauuguuccuacaacauuugcccauauugugccucaagguugaccagugacgggcuggcucggcacguaccccagugcccuaagcgcaaagaaaagguugaggaaacagagcuauaccucaaucuggaacgaauaccauggaucgugagaaaacuucugcaagucagcgagucuaccggaguggcauugaagagguccucauggcucauugugcuguuaguccugcucacgguuagccuuaguccggugcagucugcccccguaggccggaaaccucuguucuuggauuccaucgugaagggcaugaaaaaccuacugaauagcacuucgcucgagacaucucuguccauagaagcuccauggggugccauuaacguccagucaaccuuuaagcccacugugaguacagcgaauaucgcacuuagcugguccucuaucgagcaccguggaaacaagauucugguuaccggucgcagcgaaucaaucaugaaauuggaggaaagaacgggcgugaguugggaccucggggucgaggaugccuccgagagcaagcuguuaaccgugucuauuauggaccugucacagauguacaguccuguauucgaauaucuaagcggagauaggcaaguugaggaauggccaaaagcuacauguacuggcgacugccccgagcggugugguugcaccuccucuacaugucuccauaaggaauggccgcacucgcgaaauuggcgcugcaacccuacuuggugcuggggcguggggaccggauguacaugcuguggcgucgaugugaaagaccuguuuaccgaucauauguucgucaaguggaagguggaguacauaaaaacugaggccaucguuugcguggaacuuacgagccaggagagacaguguuccuugauugaagcagggacaagguucaaccugggacccguaaccaucacucucucagagccacggaauauccaacagaagcugccucccgagauuauaacccuucacccaaaagucgaagagggguuuuucgaccugaugcacgugcagaagguuuugagugcuucuacagugugcaaacuccagagcuguacccauggcauccccggggaucugcaagucuaucacauuggaaacuuacugaagggcgaccgcgugaauggucaucuaauccacaagauugaaccucauuuuaacacuuccuggaugucaugggacgggugcgaucucgacuacuauuguaauaugggcgauuggccaagcugcacauacacgggaguaacccagcacaaccacgccgcguucgugaaucugcuuaacaucgagacugacuauacaaaaaccuuucauuuccacucuaagagaguuacagcccauggcgauacuccgcaguuggaccugaaagcaaggcccaccuacggggcuggagaaauaacgguccucguggagguggccgauauggagcugcacaccaagaaagucgaaaucuccgguuuaaaguuugcuagucuggccuguacaggcugcuacgcaugcagcucugggauuuccuguaagguucguauccacguggacgagccugaugaacuuacugugcauguaaaaucaagugacccagaugucguggccgcuagcaccucguugacagcgcggaagcucgaguucggaacugacuccaccuuuaaagcauucucugccaugcccaagacgagccugugcuuuuauauuguugaaaaagaguacuguaagucaugcaaugaggaugacacacagaaauguguggacaccaagcuagaacaaccucagaguauccugauagagcacaagggcacuauuaucgguaaacagaacgauacaugcaccgcuaaggccuccuguuggcucgaaucugucaagagcuucuuuuaugggcugaaaaauaugcuuggcuccguguucggaaacuucuuuauuggcaucuugcuguucuuagcaccauuuguucuccuggugcuuuucuuuauguucggguggaaaauacuguuuugcuucaaguguugccgaagaacuaggggauuguuuaaguaccgccaucucaaagacgaugaggaaaccggcuauaagcggaucauugagagacugaauaacaaaaaggguaaaaauaggcuacuggacggggagcgccucgccgaucgaaagaucgcugaacuguucucaacaaagacgcacauugga

SEQ ID NO: 10630 - RNA, 2916 nt, Artificial Sequence
  derived and/or modified CDS sequence (opt3) from CCHFV(1-CR/HU-2015, Artificial)__KU161584.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucacacagugccccaaacggaaggaaaaaguggaggaaaccgagcuauaccucaaucuggaacgcauuccuuggaucguacgaaaacuucugcaaguuagcgagucuacgggaguggccuugaaaagauccucauggcucauaguccuguuagugcugcucacugugagccuuaguccaguccagucugcuccgguuggcaggaagccccuguuuuuggauuccauugugaaaggcaugaagaaccuacugaauagcacaucgcucgagaccucucuguccaucgaagccccuuggggagcgaucaacguacagucaacuuucaagccaacagugaguaccgcaaauauugcccuuagcugguccucugucgagcaccgggggaacaaaauccuggugacgggucguagcgaaucaauuaugaaguuggaggaacgcaccggcguuaguugggaccucgggguggaggaugcuuccgagagcaaacuguuaacagucucuauaauggaccugucacagauguacagucccguguuugaauaucuaagcggagauagacaaguagaggaauggccuaaggccacuuguaccggcgacugcccagagaggugugguugcacauccucuacuugucuccauaaagaauggccccacucgcggaauuggcgaugcaacccgaccuggugcuggggcguugggacaggauguaccugcuguggcguggaugucaaggaccuguucacugaucauauguuugugaaguggaaagucgaguacaucaagacggaggcaauugugugcguugaacuuacaagccaggagcgccaguguuccuugaucgaagcugggaccagauucaaccugggaccugugacuaucacccucucagagcccaggaauauucaacagaaacugccaccugagauaaucacacuucaccccaagauugaagaggguuucuuugaccugaugcacguacagaaagucuugagugccucuaccgugugcaagcuccagagcuguacucauggcaucccaggggaucugcaaguuuaucacauuggaaacuuacugaagggcgaccgggugaauggucaucuaauccacaaaauagaaccccauuucaacacauccuggaugucaugggacgggugcgaucucgacuacuauuguaauaugggcgauuggccuagcugcacguacaccggagucacucagcacaaccacgcggccuuugugaaucugcuuaacaucgagacagacuauaccaagacauuccauuuucacucuaaacgcguaacugcacauggcgauaccccacaguuggaccugaaggcuagaccgacguacggggccggagaaauuaccgugcucguugaggucgcugauauggagcugcacacaaagaagguggaaaucuccgguuuaaaguucgccagucuggcauguacuggcugcuacgccugcagcucugggauuuccuguaaagugaggauccacgucgacgagcccgaugaacuuaccguucaugugaagucaagugacccugaugugguagcugcgagcacaucguugauggcacguaaacucgaguuuggaacugacuccaccuucaaggccuuuucugcuaugccaaaaacgagccugugcuucuauauagucgaacgggaguacuguaagucaugcagugaggaugacaccaaaaaguguguggacacaaagcuagaacagccccaauccauucugaucgagcacaaaggcacuauuaucgguaagcagaaugauacaugcaccgccaaagcaucuuguuggcucgaaagcguuaaguccuuuuucuaugggcugaaaaacaugcuuggcucaguguuuggaaauuucuucauaggcaucuugcuguuuuuagccccuuucguccuccuggugcuguuuuucauguuuggguggaagauucuuuucugcuuuaaguguugccgaagaacuaggggauuguucaaauaccgccaucucaaggacgaugaggaaaccggcuaucggagaaucauugagaggcugaacaauaaaaaggguaaaaaccgccuacuggacggggagcgacucgcugaucggaagaucgccgaacuguuuagcacaaagacgcacauagga

SEQ ID NO: 10631 - RNA, 2916 nt, Artificial Sequence
  derived and/or modified CDS sequence (opt3) from CCHFV(Gaib, Artificial)__KX013445.1__Gn-4aa-Gc
agcgaggaauccucugacgauugcaucucaagaacccagcugcucaggacagagacugccgaaauucacaacgacaauuacggcgggcccggagauaagauaacgaucuguaacgguaguaccauuguggaccaacggcuuggcagcgagcuggggugcuauacaaucaaucgcgucaaauccuucaaguugugugaaaacucugcuacuggaaaaucgugcgagauugauucaaucccuguuaagugucgacagggcuuuugcuuaaaaauaacccaggagggucgugggcaugugaagcugagcagaggaagugaaguagugcuagacgcaugugauuccucuugcgagaucaugauuccaaagggcacaggcgacauccucgucgauuguagcgggggacagcaacacuuccugaaagacaaucuuauugaucuggguugcccgaacauccccuugcucggcaagauggccauauacauuuguaggauguccaaucauccuaaaaccacuauggcguuucuguucugguuuucauucggguaugugaucacaugcauuuucugcaaggcuaucuucuaccugcucaucauuguuggaaccuuaggcaaaaaguuuaagcaguaucgggaacugaaaccacagacguguacuauaugcgagaccacacccgugaacgccaucgacgcagagaugcacgaucuuaauuguaguuacaacauuugcccuuauugugccagccgcuugacuucugacggucuggcuagacaugucgugcacugcccaaagaggaaagaaaagaucgaggaaaccgagcuauaccucaaucuggaacggguacccuggguugugcgcaaacuucugcaggucuccgagucaacagggguggcauugaagcgaagcaguuggcucauagugcuguuaguccugcucaccguuucucuuuccccugugcaaagcgccccaauuggaagaaaaccgcuguucucggacucuaucguaaagggcaugaagaacuugcuaaauuccacgucacuggagacuucgcucagcaucgaagcucccuggggcgccauuaacgugcaguccacauuuaaaccuaccgucucuacugcgaauaucgcacugagcuggucaaguauugagcacagggggaacaagauacuuguguccggacggagcgaaucuaucaugaaacuggaggaacguacagguauuucaugggauuugggcguugaggacgccagugagagccgccuccugaccguguccgucauggauuuaucucagauguacucgccaguguucgaauaucugagcggggacagacagguagaggaauggcccaaggcuacguguaccggagauugcccugagagguguggcugcacauccucaacuugucuacauaaagaauggccacacagucggaacuggcgaugcaaucccaccuggugcugggguguugggacaggcuguacuugcuguggacucgacgugaaggaucuguuuaccgacuacauguucgucaaguggaaaguggaguauaucaagacagaggccaucgucugcguggaacuuaccucucaagagcgccaguguagcuugauugaagcaggcacuagauucaaccuggggccgguuacgauaacacucuccgagccuaggaauauccagcaaaaacugcccccagagauuaucacccuucauccucggauugaagagggauuuuucgaucugaugcacgugcagaagguauugucagcuagcacugucugcaaacuccagucuuguacccacggugugcccggcgaccugcagguuuaccauaucgggaacuuacugaagggagauaaggugaauggccaccuaauacauaaaaucgaaccacacuuuaacacauccuggaugaguugggacgguugcgaccucgauuauuacuguaauaugggggacuggcccagcugcaccuauacuggcgucacacaacauaaccacgccgcguucgugaaucugcuuaacauugagacggauuacaccaagaauuuucacuuccauucuaaacgcguaacugcccacggagacacaccucaguuggaucugaaggcaagaccaaccuacggcgcuggggaaaucacagugcucguugaggucgccgacauggagcugcauacuaaaaagauugaaaucuccggauuaaaguuugcuucacugaccuguacggguugcuaugccugcaguagcggcauaucguguaaagugaggauucacguggaugagccggacgaacuuaccguccacguuaaguccgaggaucccgacaucguggcagccucuagcucauugauggcucguaaacucgaauuugggacagauaguacuuuuaaggcguucuccgcaaugccuaaaaccucucugugcuuuuacauuguggagcgggaguauuguaagagcugcucccgagaagacacacagaaauguguaucaacuaagcuagagcagccacaaagcauccugauagaacauaagggaaccaucauuggcaaacagaacaauacgugcacaaccaagacuacauguuggcucgagagugucaaaucuuucuuuuacggucugaagaacaugcuuuccagcaucuucgggaauguguucguuggcauuuuuaguuucuuggcccccuuuauccuguuaauacucuucuuuauguucggauggaggauucuguuuugcuucaaauguugcagacgcacccggggccuuuuuaaguauagacaccugaaggaugacgaagagacuggguacaggcgcaucaucgagcgauugaacaacaaaaagggaaaaucaaagcuccuggacggcgaacggcuagcugaucguaaaauugccgagcuguucucuaccaagacacauaucggu

SEQ ID NO: 10632 - RNA, 2916 nt, Artificial Sequence
  derived and/or modified CDS sequence (opt3) from CCHFV(Hodzha, Artificial)__KX013448.1__Gn-4aa-Gc
agcgaggaauccggcgacgauugcaucucuagaacccagcugcucaggacagagacugccgaaauucacggggacgauuacggaggucccggcgacaagauaacgaucuguaacgggucaaccauuguggaucaacggcuuggaagugagcugggcugcuauacaaucaaucgcgucaagagcuucaaguugugugaaaacuccgcuacugguaaaucuugcgagauugacucgaccccuguuaagugucgacagggguacugcuuaaaaaucacacaggagggacguggccaugugaagcugucaagaggcagcgaaguagugcuagaugcaugugacaguuccugcgaggucaugauaccaaaggggaccggagauauccucguggacuguucugguggccagcaacacuuucugaaagauaaucuuauugaccuggggugcccgaggauccccuugcucggaaagauggccauuuauaucugucggaugagcaaccauccugaaacuacaauggcguuccuguuuugguucuccuuuggcuacguuauaaccugcauucugugcaaagcuaucuucuaucucuuaauuaucguggguacgcuggggaagcgcuuuaaacaguacagagagcuuaagccacagacuuguaccaucugcgagacaacucccgccaaugcaauugaugccgaaaugcacgacuugaacuguucauauaauauaugcccuuacugugcuaguaggcugaccagcgacggacuagcacggcaugucacacagugcccaaagcgcaaagagaagguggaagagaccgaacucuaccugaaccuugagcgaauccccuggauuguaagaaaacuguugcaaguuucugaguccacgggcguggcccucaagaggucaagcuggcugaucgucuuacugguccucuucgcugugagucuuucuccugugcaguccgccccaauaggccggcguccgcuguuuuuggauagcauuguuaaagggaagaaaaaucuacugaacucgacuucucucgaaacaucccugucaaucgaggcgcccuggggagcaaucaaugugcagaguaccuauaagccuacuguaagcacagccaacauugcucuuuccuggucuagcguggaacaccgcgguaauaagauccuggucucaggcagaagugaguccauuaugaaauuggaagagaggaccgggauaagcugggaccucggaguggaggaugccucugaaucaaagcuguuaacgguuagugugauggaccugagccagauguacuccccagucuucgaguaucuaucuggcgaucggcaaguggaagaguggcccaaagcaaccuguacaggugacugcucggaacgaugugggugcacuagcuccaccugucuccacaaggaguggccucauucacgcaacuggagaugcaauccaacauggugcuggggcguaggaacuggcuguaccugcugugggcuggauguuaaagaccuuuuuacagauuacauguucgugaaguggaaggucgacuauaucaaaaccgaggcuauugugugcgucgaauugaccagucaggagaggcaguguucucugguggaagccggaacgcgguuuaaccucggucccguuacaaucacccugagcgagccgcgcaacauccaacagaaacuuccucccgagauuauaacucugcacccaagaaucgaagagggcuucuucgauuugaugcaugugcagaaaguacucuccgcgucaaccgucugcaagcugcagagcuguacacacggggugccuggagacuuacaaguuuaccacauuggcaaucugcuaaaaggugacaaggugaacgggcaucucauccacaagauugaaccccauuuuaauaccucuuggauguccugggauggcugcgaccuggauuauuacuguaacaugggagacuggccaaguugcacuuacacaggcgucacgcagcacaaucaugccagcuucgugaaccuuuugaauaucgagaccgauuauacuaaaucuuuucacuuccacuccaagaggguaacagcacauggggacacuccccagcuggaucucaaagcucguccuacauacggagccggugaaauaacugugcugguugaggucgcugacauggaguuacacaccaagaaaaucgaaauuacgggccugaaguuugccucacuuaccuguacagggugcuaugcaugcaguagcggaaucucguguaaggugcggauucauguggaugagccagacgaauugacuguccacguuaaauccgaugacccggaugugguggccgcuucuagcucacucauggcgcgaaagcuggaguucggcaccgacaguacauuuaaagcauucuccgccaugcccaagacuucucuaugcuuuuacaucguagaaagagaguauuguaaaagcugcuccaaggaggacacccagaaaugugucaacacgaagcuggaacaaccucagucaauacucauugagcagaaggguacaaucauugggaaacagaauaauaccugcacugcuaaggccagcuguuggcuggaaagugugaaaucuuucuuuuacggccuuaagaacauguuguccggaaucuucggcaacguuuuuguggggauauuccuguucuuagcaccauuuauccuccugauucuuuucuuuauguucggauggaggauccuguuuugcuucaaauguugccgccggacaagaggcuuguuuaaguauaagcaccucaaagaugacgaggaaaccgguuacaggcgcauuaucgagcgacugaauaacaagaaagggaagaauaaacuacuggauggagagcggcucgccgaccguagaauagcugaacuguucagcacuaagacccauauuggc

SEQ ID NO: 10633 - RNA, 2916 nt, Artificial Sequence
  derived and/or modified CDS sequence (opt3) from CCHFV(IbAn7620, Artificial)__KX013451.1__Gn-4aa-Gc
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaaauccuucaaguugugugaaaauuccgcuacuggcaaaaacugcgagauugauucuguuccagugaagugucgacaggguuacugcuuacguaucacccaggaggggagaggacauguaaaacugucgaggggcucagaaauagugcuagacgcaugugauacaagcugcgagaucaugauuccgaagggcaccggggacauccucgucgauuguaguggaggucagcaacacuuucugaaggacaaucuuauugaucugggcugccccaaaaucccuuugcucgggaagauggccauauauauuugucggauguccaaccauccaaaaacuacaauggcguuccuguuuugguucucuuuuggauacgugauuaccugcauucugugcaaggcuaucuucuaucucuuaaucauuauaggcacgcuggguaaacgccuuaagcaguacagagaauugaagccccagacuuguaccaucugcgagacaacuccuguuaaugccauugacgcagagaugcacgaucugaacuguagcuauaauaucugcccauacugugccuccaggcuaaccucagacgggcucgcucggcaugugauacagugccccaaacgcaaggaaaaagucgaggaaacagagcuguaccuuaaccuggaacgaaucccuugggugguaagaaaguugcuccaaguuagugagagcaccggaguggcacugaaaaggucuuccugguuaaucguccugcucgugcuuuuuacggugucacugagcccaguccagagugccccgaucggccggaagcccuuguuccuagacucuauugcuaaaggcaugaagaauccucugaacuccacuagccucgagacaucgcugucuaucgaagccccauggggugcgauugauguucaguccaccuauaagcccacugugucaacagcaaauauagcccuuaguuggagcuccguagagcaccguggaaacaaaauccuggugucuggucgcagcgaaucaauuaugaaguuggaggaaagaaccggcaucaguugggaccucggggucgaggaugcuuccgagagcaaacuguuaacggugucuguuauggaccugucacagauguacaguccuguguuugaauaucuaagcggagauaggcaagucgaggaauggccaaaggccaccuguacaggcgacugccccgagcggugugguugcacuuccucuaccugucuccacaaagaauggccgcauucgcgaaauuggcgcugcaacccuacauggugcuggggcguggggacuggauguaccugcuguggccuggauguaaaggaccuuuucacagauuacauguuuguuaaguggaaaguggaguauaucaagaccgaggcaauugucugcguggaauugacuagccaggagagacaguguucccugauagaagcugggacgagguucaaccucggacccgucacaaucacccugucagagccacggaauauucaacagaaacuuccucccgagaucauuacucugcacccacgcaucgaagagggguuuuucgacuugaugcaugugcagaagguucucagugccucuaccgugugcaaacugcagagcuguacacacggcguacccggggauuuacaagucuaccacauaggaaaccugcuaaagggcgacaaggugaauggucaucucauccacaaaauugaaccucauuucaacaccuccuggaugucaugggacgggugcgaucuggacuauuacuguaauaugggcgauuggccaagcugcacuuacacaggaguuacgcagcacaaccaugcgucuuuugugaaucuuuugaacaucgagaccgacuauacuaagaauuuccacuuucacuccaaaagagucacagcccauggcgauaccccgcagcuggaccucaaggcaaggcccacauacggggcuggagaaauuacugugcugguagagguggccaacauggaguuacacaccaaaaagaucgaaauaaguggucugaaguucgcuagccuuacguguaccggcugcuaugccuguucuuccgggauuucaugcaaaguucguauccaugucgaugagccugacgaauugacagugcacgugaagagugaugacccagaugucguugcagccagcucgucccucauggcucggaaacuggaguuuggaacugacucuaccuucaaggcguuuagcgcaaugcccaaaacaucacuaugcuucuacauuguggaacgagagcacuguaagaguugcuccgaggaagauacuaaaaagugugugaauaccaagcuggagcagccucaaucuauccucauagaacauaaaggcacgaucauugguaagcagaacagcacaugcaccgccaaagcuagcuguuggcuggagucaguaaagagcuuuuucuaugggcuuaaaaauauguugaguggcaucuuuggaaacgucuucaugggcauuuuucuguucuuagccccauucauccuccugauacuguuuuucauguuuggguggaggauucuuuucugcuuuaaguguugcagacgcacucggggauuguucaaguacagacaccucaaagacgacgaagagacaggcuauaggcgcaucaucgagcgacugaauaacaagaaagguaagaacaaacuacuggauggggaacggcucgcagaccguagaauugccgagcuguuuucuaccaagacucauaucgga

SEQ ID NO: 10634 - RNA, 2916 nt, Artificial Sequence
  derived and/or modified CDS sequence (opt3) from CCHFV(K128_76, Artificial)__KX013454.1__Gn-4aa-Gc
agcgacgaguccggcgaugacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaagagcuucaaguugugugaaaauuccgcuacugguaaaucuugcgaaauugacucgaucccuguuaagugucgacagggguacugcuuaaaaauaacccaggagggacguggccaugugaagcugucaagaggcagcgagguagugcuagaugcaugugacaguuccugcgaagucaugaucccaaaggggacaggagauauucucguggacuguucugguggccagcaacacuuucugaaagauaaccuuaucgaccuggggugcccgaagauucccuugcucggaaaaauggccaucuauauauguaggaugagcaaucauccuaagaccacuauggcguuccuguuuugguucuccuuuggcuacguuauuacaugcaucgugugcaaagcuauuuucuaucugcucaucaucgucgguaccuuagggaagcgguuuaagcaguaccgcgagcugaaaccacagacguguacuauuugcgaaaccacacccacuaacgccauagaugcagagaugcacgaccuuaauuguucauauaacaucugcccuuacugugccaguagauugaccagcgacggacuggcuaggcaugugacacacugcccaaagcggaaagagaagguagaagagaccgaacuauaccucaaucuggagcgcauucccuggguugugcgaaaacuucugcaggucucugaauccacgggcguggcauugaagagaucaagcuggcucaucgugcuguuaguccuguucgccguuagucucucuccugugcaauccgcuccaauaagcaggcggccgcuuuuucaggauucgauuguaaaaggcaugaagaaccugcucaauucuacuucccuagagacaucacugaguaucgaggcccccuggggagcgaucaacgugcagagcaccuauaagccugcagucuccgccgcuaauauugcccucucuuggagcucaguggaacaccgugggaguaaaauccugguuuccggucgcagcgagucuauuaugaaacuugaagagagaacuggcauaucaugggaccuggggguggaagaugcaagugagagcaaauugcucacagucuccgugauggaccugucucagauguacucgccaguauucgaguauuuaagcggagauaggcaaguugaagaguggcccaaggcuaccuguacgggcgacugcccugaacggugugguugcaccuccucaacaugucugcauaaagaguggccacacagucgaaacuggcgcugcaaucccacuuggugcuggggcguggggaccggauguacaugcuguggccuagaugucaaggaccucuuuacugauuacauguucgugaaguggaaagucgaauauaucaagaccgaggccauugugugcguugagcugacaucucaggaaagacaguguagccuuaucgaggcggggaccagguuuaacuugggaccggugacuaucacgcuguccgaaccucggaacauucaacagaaauugcccccagagauaaucacacugcauccucgcauugaggaagguuucuucgaccuuaugcacguacagaagguccugucagccagcaccgugugcaaauugcagucuuguacucacggcguucccggggaucuccaaguguaccauaucggaaaucuguuaaagggcgacagagucaacggucaccugauucauaagaucgagccacacuuuaauaccuccuggaugaguugggacgggugcgaucuagacuauuacuguaacaugggcgauuggcccagcugcacauacaccggagugacucagcauaaucacgcaucuuucguaaaccuccugaauauagaaacagacuauacgaaauccuuucacuuccauucaaagagggugaccgcucacggcgauacuccucagcuugacuugaaagcccguccaaacuacggggcuggagagaucacaguucuggucgaaguggccgauauggagcuccauaccaagaaaauugagaucaguggucugaaguuugccagcuuaacauguacuggcugcuaugcaugcucguccgggauuucuuguaaggugcggauccacgucgacgaaccggaugagcugaccguucacgugaaaagcgacgaucccgacgugguagcugcgucaaguucccuuauggcacgaaaguuggaguucggaacggauucuaccuuuaaagccuucagcgcuaugccuaagacaucccucugcuuuuacauagucgagagagaauauuguaaaucaugcagcaaggaggacacucagaaaugugugaauaccaagcuggagcaaccacagaguauucuaaucgaacauaagggcacaauuaucgguaaacagaacaauacuugcaccgccaagacgucuuguuggcuggaguccguuaagagcuucuuuuacgggcucaaaaacaugcugucgggcauauucggaaauguguuugucggcaucuuccuuuucuuggcacccuuuauucuguuaauccucuucuuuauguucggguggaggauucuguuuugcuucaaauguugccgccggacaagaggacuuuuuagguauaagcaccuggaaaacgacgaggaaaccggcuaccgccgaaucauagagcgguugaauaacaagaaagguaagaacaaacuccuggauggggagcgucuagccgacagaaggauugcugaacuguucucaacuaagacacauaucgga

SEQ ID NO: 10635 - RNA, 2916 nt, Artificial Sequence
  derived and/or modified CDS sequence (opt3) from CCHFV(K168_40, Artificial)__KX013457.1__Gn-4aa-Gc
agcgacgaguccggcgaugacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaagagcuucaaauugugugaaaauuccgcuacugguaaaucuugcgaaguugacucgauuccugugaagugucgacagggguacugcuuaaaaaucacccaggagggacguggccauguaaagcugucaagaggcagcgaggugguccuagaugcaugugacaguuccugcgaagugaugauaccaaaggggacaggagauauccucguugacuguucugguggccagcaacacuuucugaaagauaaccuuauugaccuggggugcccgaagauccccuugcucggaaaaauggccauuuauaucuguaggaugagcaaucauccuaagaccacuauggcguuccuguuuugguucuccuuuggcuacgugauaacaugcauugucugcaaagcuaucuucuaucugcucauuaucguggguaccuuagggaagcgguuuaagcaguaccgcgagcugaaaccacagacguguacuaucugcgaaaccacacccacuaacgccauugaugcagagaugcacgaccuuaauuguucauauaacauaugcccuuacugugccaguagauugaccagcgacggacuggcuaggcauguaacacacugcccaaagcggaaagagaagguugaagagaccgaacuauaccucaaucuggagcgcauccccugggugguccgaaaacuucuucaggugucugaauccacgggcguggcauugaagagaucaagcuggcucauuguccuguuaguucuguucgccgugagucucucuccuguacaauccgcuccaaucggcaggcggccgcuuuuucuggaugggauagugaaaggaaugaagaacuugcuaaauagcacuucgcuggagacaucucucuccauugaggcccccuggggugcgaucaacguccagucaaccuauaagccuacugugagugcagccaauaucgcucugagcugguccucuguugaacaccguggcaacaaaauucuugugagcgggcgcucagagaguaucaugaagcuggaagagagaacaggaauuuccugggacuugggcgucgaagaugccagcgagucuaaacuccugaccgugucaguaauggacuuaagucagauguacagcccaguuuucgaguaucuguccggugauagacagguggaagaguggcccaaggcaacguguaccggggacugcccugaacgguguggcugcacaucuucgacuugucuacauaaagaguggccacacagccgaaauuggcgcugcaaccccaccuggugcuggggagucggcacaggguguacuugcuguggacucgaugugaaggaccuguuuaccgauuacauguucgucaaguggaaaguggaauauauaaagacagaggcuaucguuugcguggagcuuaccucccaagaaagacaguguucauugauugaggccgguacuagguuuaaccugggcccgguaacgaucacacucagugaaccucggaauauccagcaaaaacugcccccagagauuauaacccuucauccucgcaucgaggaaggguucuucgaccugaugcacguccagaagguguugucugcgagcacuguuugcaaacuccaguccuguacccacggagugcccggcgaucugcaggucuaccauauugguaacuuacugaagggggacaaggugaauggccaccuaauccauaaaauugagccacacuuuaacacaucauggaugagcugggacggaugcgaucucgacuauuacuguaauaugggcgauuggcccucuugcaccuacacugggguaacacaacauaaccacgccuccuucaucaaucugcuuaacauagaaacggacuauaccaagaguuuucacuuccauagcaaaagagugacugcacacggagauacaccucaguuggaccugaaggcuaggccaaauuacggugccggcgagaucaccguucucgucgaaguggcugauauggagcugcauaccaaaaagauugagaucucuggguuaaaguuugccucccugacuuguaccggaugcuaugcaugcucaaguggcauuagcuguaaagugcguauccacgucgacgaaccggaugagcuuacgguucacgugaagucggacgaucccgacgugguagccgcuuccucuagcuugauggcgcggaaacucgaguucgguaccgauucaacauuuaaggcauucagugccaugccuaaaacuucccugugcuuuuacauagucgagcgagaauauuguaagucuugcagcaaagaggacacccagaagugugugaacacaaagcuagagcauccacaguccauucugaucgaacacaaagggacuauuaucggcaagcaaaauaacacaugcacggcuaaaacaucauguuggcucgagagcguuaagaguuucuuuuacggacugaaaaauaugcuuucuggcauauucgggaacguguuugucggaaucuucuuguuccuggcccccuuuauuuuacucauccuguucuuuauguucggcuggaggauucuguuuugcuucaaguguugcaggcgcacccggggucuguuuagauauaagcauuuggaagacgaugaggaaacuggguacaggcgcaucauagagcgacucaauaacaaaaagggcaaaaacaagcugcuagacggagagcggcuggcagaucguagaauugccgaacucuucuccacaaaaacccacaucggu

SEQ ID NO: 10636 - RNA, 2916 nt, Artificial Sequence
  derived and/or modified CDS sequence (opt3) from CCHFV(K168_125, Artificial)__KX013460.1__Gn-4aa-Gc
agcgacgaguccggcgaugacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaagagcuucaaauugugugaaaauuccgcuacugguaaaucuugcgaaguugacucgauuccugugaagugucgacagggguacugcuuaaaaaucacccaggagggacguggccauguaaagcugucaagaggcagcgaggugguccuagaugcaugugacaguuccugcgaagugaugauaccaaaggggacaggagauauccucguugacuguucugguggccagcaacacuuucugaaagauaaccuuauugaccuggggugcccgaaggugcccuugcucggaaaaauggccaucuauauuuguaggaugagcaaucauccuaagaccacuauggcguuccuguuuugguucuccuuuggcuacgucaucacaugcauagugugcaaagcuauuuucuaucugcucaucauuguagguaccuuagggaagcgguuuaagcaguaccgcgagcugaaaccacagacguguacuaucugcgaaaccacacccacuaacgccaucgaugcagagaugcacgaccuuaauuguucauauaacauuugcccuuacugugccaguagauugaccagcgacggacuggcuaggcauguuacacacugcccaaagcggaaagagaagguggaagagaccgaacuauaccucaaucuggagcgcauacccugggucgugcgaaaacuucuucaggugucugaauccacgggcgucgcauugaagagaucaagcuggcucaucguucuguuagugcuguucgccguaagucucucuccugugcaauccgcuccaauuggcaggcggccgcuuuuucuggauagcaucgucaaagggaagaagaacuugcuaaauucgacuucucuggagacaucccucucaauagaggcccccuggggagcgauuaacgugcagaguaccuauaaaccuacuguuagcgcagccaauaucgcucuguccuggucuagcguggaacaccgugguaacaagauccuugucucaggccgcagugaguccauuaugaaacuggaagagagaacagggaucagcugggacuugggaguggaagaugccucugagucaaagcuccugaccguaaguguuauggacuuaagccagauguacuccccaguguucgaguaucugucuggcgauaggcaggucgaagaguggcccaaagcaacguguaccggugacugcccugaacggugugggugcacaucgagcacuugucuacauaaggaguggccacacucccgaaauuggcgcugcaaccccaccuggugcuggggcgugggaacaggcuguacuugcugugggcucgaugucaaggaccuguuuaccgauuacauguucgugaaauggaagguugaauauauuaaaacagaggcuauagugugcguagagcuuaccucacaagaaagacaguguaguuugaucgaggccggaacuagguuuaaccuggguccggucacgauuacacucucugaaccucggaauauccagcaaaagcugcccccagagaucauuacccuucauccucgcauagaggaaggcuucuucgaccugaugcacgugcagaaaguuuugagcgcguccacugugugcaagcuccagucauguacccacgggguccccggagauuuacagguguaccauaucggcaaccugcugaagggugacaaaguaaaugggcaccuaauucauaagaucgagccacacuuuaacacaagcuggaugucuugggacggcugcgaucucgacuauuacuguaauaugggagauuggcccuccugcaccuacacuggcgugacacaacauaaccacgccaguuucauuaaucugcuuaacaucgaaacggacuauaccaagagcuuucacuuccauucuaaaagaguuacugcacacggggauacaccucaguuggaccugaaagcuaggccaaauuacggagccggugagauaaccguccucguggaaguggcugauauggagcugcauacaaagaagaucgagauuuccggcuuaaaauuugccucacugacuuguaccgggugcuaugcaugcaguagcggaaucucguguaagguccguauucacguugacgaaccggaugagcuuacggugcacgugaaauccgacgaucccgacguagucgccgcuucuagcucauugauggcgcggaagcucgaguucggcaccgauaguacauuuaaagcauucuccgccaugccuaagacuucucugugcuuuuacaucguggagcgagaauauuguaaaagcugcuccaaggaggacacccagaaguguguuaacacaaaacuagagcauccacagucaauacugauugaacacaaggguacuaucauugggaaacaaaauaauaccugcacggcuaagacaagcuguuggcucgagagugugaaaucuuucuuuuacggccugaagaacaugcuuuccggaaucuucggcaacgucuuuguggggauauucuuguuccuggcccccuuuaucuuacucauucuguucuuuauguucggauggagaauccuguuuugcuucaaguguugcaggcgcacccggggccuguuuagauauaaacauuuggaagacgaugaggaaacugguuacaggcgcauuaucgagcgacucaauaacaagaaagggaagaacaaacugcuagacggagagcggcuggcagaucguagaauagccgaacucuucagcacaaagacccacauuggc

SEQ ID NO: 10637 - RNA, 2916 nt, Artificial Sequence
  derived and/or modified CDS sequence (opt3) from CCHFV(K229_194, Artificial)__KX013463.1__Gn-4aa-Gc
agcgaggaacccggcgacgauugcaucuccagaacccagcuucucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaagggcaaccuuaucgaucuggggugcccccauauuccuuugcucggaaaaauggccaucuacauauguagaauguccaaucacccaaggacaaccauggcguuucuguucugguuuucuuucggcuaugugauuacgugcaucuuuugcaaggcucuguucuacagccucauuaucaucgguacuuuagggaaaaagauuaagcaguaucgggaacugaaaccccagaccuguacaauaugcgagacugccccuguuaacgcaaucgacgccgagaugcaugaucuuaauuguuccuacaacauuugcccauauugugcuucacgcuugaccagugacggacuggcaagacacgugacacagugccccaagaggaaagaaaaggucgaggaaaccgagcuauaccucaaucuggaacggaucccuuggauagugcgcaaacuucugcaaguaagcgagucuacgggcguugccuugaagcgauccucauggcucauugugcuguuaguccugcucacugugagccuuaguccagugcagucugcuccggucggcagaaaaccccuguuuuuggacuccaucguuaaggggaagaaaaaccuacugaauagcacaucgcucgagaccucucuguccaucgaagccccuuggggagcgauuaacgugcagucaacuuucaagccaacaguaaguaccgcaaauaucgcccuuagcugguccucuguggagcacagggguaacaaaauucuggucacgggccggagcgaaucaauaaugaaguuggaggaacguaccggggugaguugggaucucggaguugaggacgcuuccgagagcaaacuguuaacagugucuaucauggaucugucacagauguacagucccgucuuugaauaucuaagcggcgaccgccaaguggaggaauggccuaaggccacuuguaccggugauugcccagagagaugugggugcacauccucuacuugucuccauaaggaauggccccacucgaggaauuggcggugcaacccgaccuggugcuggggcguaggaacaggcuguaccugcugugggguugacgugaaagaucuguucacugaccauauguuuauuaaguggaaagucgaguacaucaagacggaggcaaucgugugcgucgaacuuacaagccaggagcgacaguguuccuugauugaagcuggaacccgcuucaaccuggguccugugacuauaacccucucagagcccagaaauauccaacagaaacugccaccugagauuaucacacuucaccccaagauugaagagggcuucuuugaucugaugcacguucagaagguguugagugccucuaccguaugcaaacuccagagcuguacucaugggaucccaggagaccugcaaauauaucacaucggcaacuuacugaagggugauaggcuaaaugggcaucucauucacaaaaucgaaccccauuucaacacauccuggaugucaugggacggcugcgaccuggauuacuauuguaauaugggagacuggccuagcugcacguacaccggcgucacucagcacaaccacgcggccuuugugaaucuuuugaacauugagacagauuauaccaagacauuccauuuucacucuaaacggguuacugcacauggggacaccccacagcuggaucucaaggcucgcccgacguacggagccggugaaaucaccgugcuggucgagguggcugacauggaguuacacacaaagaaaguagaaauauccggccugaaguucgccagucuugcauguacugggugcuacagcuguucuuccggaauuucaugcaaagugagaauccacguugaugagcccgacgaauugaccguccaugugaagaguagcgauccugacguggucgccgcuucgacaucccucauggcgaggaaacuggaguuuggcacugauucuaccuucaaggcauuuagcgccaugccaaaaacgucacuaugcuucuauauuguugaacgugaguacuguaagaguugcuccgaggacgauacaaagaaauguguggacaccaagcuggaacagccccaaucuauccucauagagcacaaagguacuaucauugggaagcagaaugacacaugcaccgcuaaagccagcuguuggcuggaauccgugaagucauuuuucuauggccuuaagaacauguugggaagcguauuuggcaauuucuucgucgggauccuguuauuucucgcaccuuucgugcugcuuguucuguuuuucauguuuggauggaaaauuuuguucugcuuuaaguguugccggcgaacuagaggccucuucaaauacaggcaucugaaggaugacgaggaaaccgguuaucgcaaaaucauagagcggcuaaacaguaagaaggggaaaaauagacugcucgauggagagaggcuggccgaccgcaagauugcugaacuguuuucuacaaaaacgcacaucggc

SEQ ID NO: 10638 - RNA, 2916 nt, Artificial Sequence
  derived and/or modified CDS sequence (opt3) from CCHFV(K229_243, Artificial)__KX013466.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaagagauccucauggcucauaguccuguuagugcugcucacggugagccuuaguccgguccagucugcucccguuggcaggaagccucuguuuuuggauuccauugugaaaggcaugaagaaccuacugaauagcacuucgcucgagacaucucuguccaucgaagccccauggggagcgaucaacguacagucaaccuucaagcccacugugaguacagcaaauauugcccuuagcugguccucugucgagcaccgggggaacaaaauccuggugaccggucguagcgaaucaauuaugaaguuggaggaacgcacgggcguuaguugggaccucgggguggaggaugcuuccgagagcaaacuguuaaccgucucuauaauggaccugucacagauguacaguccuguguuugaauaucuaagcggagauagacaaguagaggaauggccaaaggccacauguacuggcgacugccccgagaggugugguugcaccuccucuacaugucuccauaaagaauggccgcacucgcggaauuggcgaugcaacccuacuuggugcuggggcguugggaccggauguacaugcuguggcguggaugucaaggaccuguucaccgaucauauguuugugaaguggaaagucgaguacaucaagacugaggcaauugugugcguugaacuuacgagccaggagcgccaguguuccuugaucgaagcugggacaagauucaaccugggacccgugaccaucacucucucagagccaaggaauauucaacagaaacugccucccgagauaaucacccuucacccaaagguagaagaggguuucuuugaccugaugcacguccagaaaguguugagugccucuacaguuugcaagcuccagagcuguacccauggcauucccggggaucugcaaguguaucacaucggaaacuuacugaagggcgaccgggucaauggucaucuaauucacaaaaucgaaccucauuucaacacuuccuggaugucaugggacgggugcgaucucgacuacuauuguaauaugggcgauuggccaagcugcacauacacgggagugacccagcacaaccacgcggccuuuguaaaucugcuuaacauagagacugacuauacaaagaccuuccauuuucacucuaaacgcgugacagcacauggcgauacuccgcaguuggaccugaaggcuagacccaccuacggggccggagaaaucacgguucucgucgagguggcugauauggagcugcacaccaaaaagguggaaauuuccgguuuaaaguucgccagucuggcauguacaggcugcuacgccugcagcucugggaucuccuguaaagucaggauucacguugacgagccugaugaacuuacugugcaugugaagucaagugacccagauguagucgcugcgagcaccucguugauggcacguaaacucgaguuuggaacagacuccacuuucaaggccuuuucugcuaugcccaaaaccagccugugcuucuauaucguggaaaaggaguacuguaaaucaugcagugaggaagauacgcagaaguguguugacacaaagcuagagcaaccucaguccauacugauugaacacaaaggcaccaucauugguaagcagaaugacacuugcacagccaaagcaucuuguuggcucgagagcgugaaguccuuuuucuaugggcugaaaaacaugcuuggcucagucuuuggaaauuucuucaucggcauauugcuguuuuuaaccccauucgugcuccugguucuguuuuucauguuuggguggaagauccuuuucugcuuuaaguguugccggcgaacuagaggauugcucaaauacaggcaucugaaggaugacgaagagaccggcuaucgccggauuaucgagagacuaaacaauaaaaaggguaaaaacaggcugcucgauggggaacgccuggccgaccgaaagauugcugagcuuuucagcacaaagacgcacaucgga

SEQ ID NO: 10639 - RNA, 2916 nt, Artificial Sequence
  derived and/or modified CDS sequence (opt3) from CCHFV(K315_14, Artificial)__KX013469.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccguggucgaucaaaggcuugggucagagcugggaugcuauacaauuaaccggguuaagaguuucaaauuguguaagaauagcgcuacuggcaaaaccugcgaaaucgacuccacaccagugaagugucgccaggguuuuugcuuaaagauuacccaggaggggcgaggacauguaaaacugucucguggcucggaggugguccuagaugugugugacucaagcugcgaaaucaugauaccgaagggcacuggggauauccucguugacuguaguggaggucagcaacacuuccugaaagauaaccuuauugaccugggcugcccccauaucccuuugcucgggaagauggcaauuuacaucuguagaauguccaaucacccaaggacaaccauggccuuucuguucugguuuucuuucggauaugugauaacgugcaucuuuugcaaagcgcuguucuacagccucauuauuaucggcacuuuagguaagaagaucaaacaguaucgggagcugaagccccagaccuguacaauuugcgaaacugcuccugucaacgccauagaugcagagaugcaugaccuuaauuguuccuacaacaucugcccauauugugccucacgcuugaccagugaggggcuggcuagacacgugacacagugccccaaaaggaaggaaaaaguagaggaaaccgagcuauaccucaaucuggaacggauuccuuggaucguucgcaaacuucugcaagugagcgagucuacgggagucgcauugaaacgauccucauggcucauagugcuguuagugcugcucacugucagccuuaguccaguucagucugccccggugggcagaaagccccuguuuuuggacuccauuguaaagggcaugaaaaagcuacugaacagcacaucgcucgagaccucucuguccaucgaagcuccuuggggagccaucaaugugcagucaacuuucaaaccaacagucaguaccgcgaacauugcacuuagcugguccucuguggagcacaggggaaauaagauccugguuacgggucggagcgaaucaauuaugaaauuggaggaacguaccggcgugaguugggaucucggggucgaggacgccuccgagagcaagcuguuaacagugucuauaauggaucugucacagauguacagucccguauuugaauaucuaagcggagaccgccaaguugaggaauggccuaaggcuacuuguaccggcgauugcccagagagaugugguugcacauccucuacuugucuccauaaagaauggccccacucgaggaacuggcggugcaauccgaccuggugcuggggcguggggacaggauguaccugcuguggcgucgacgugaaggaucuguucacugaccauauguuuaucaaauggaaggucgaguacauuaaaacggaggccaucgugugcguugaacuuacaagccaggagcgacaguguuccuugaucgaagcagggacccgcuucaaccugggaccugugacuauuacccucucagagcccagaaacauacaacagaagcugccaccugagaucauuacacuucaccccaagaucgaagaggguuucuuugaucugaugcacguacagaaagucuugagugcuucuaccgugugcaagcuccagagcuguacucauggcauuccaggggaccugcaaaucuaucacauaggaaauuuacugaaaggcgauaggguuaacggucaucuaauccacaagauugaaccccauuucaauacauccuggaugucaugggacgggugcgaccucgauuacuauuguaacaugggcgacuggccuagcugcacguacaccggagugacucagcacaaucacgccgcguuugucaaccugcuuaauaucgagacagauuauaccaaaacauuccauuuucacucuaagcgggugacugcccauggcgacaccccacaguuggaucugaaggcacgcccgacguacggggcuggagaaauuaccguacucguggagguugccgacauggagcugcacacaaagaaggucgaaaucuccgguuuaaaauucgcuagucugacuuguaccggcugcuacgccugcagcucugggauauccuguaaggugaggauucacguggaugagcccgacgaacuuacaguccauguuaaaucaagugauccugacgugguggcagccagcacuucguugauggcuagaaagcucgaguuuggaaccgauuccacguucaaagcguuuucugcaaugccaaagacaagccugugcuucuauaucguagaacgugaguacuguaagucaugcagugaggacgauaccaaaaagugugucgacacuaaacuagaacagccccaauccauucugaucgagcacaagggcacaauaaucgguaaacagaacgauaccugcacugccaaggcuucuuguuggcucgaaagcgugaaguccuuuuucuaugggcugaaaaauaugcuuggcucaguuuuugggagcuucuucgugggcauuuugcuguuuuuagccccuuucguccuccuggugcuguuuuucauguuuggguggaagauccuuuucugcuuuaaauguugccggcgaaccagaggauuguucaaguacaggcaucucaaagacgacgaggaaacaggcuaucgccggauuaucgagagacugaacaguaagaaggguaaaaauaggcuacuggauggggagcgccucgcagaccgaaagauagccgaacuguuuucuacgaaaacccacauugga

SEQ ID NO: 10640 - RNA, 2916 nt, Artificial Sequence
  derived and/or modified CDS sequence (opt3) from CCHFV(K323_27, Artificial)__KX013472.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuaccucuuaauuaucaucggcacucuggguaaaaagauuaagcaguaucgggaacuuaaaccccagaccuguacaauaugcgagacugccccuguuaacgcaaucgaugccgagaugcaugacuugaauuguagcuacaacauuugcccauauugugcuucccgccugaccucagacgggcuagcaagacacgugacacagugccccaagaggaaagaaaaggucgaggaaaccgagcucuaccugaaucuugaacggaucccuuggauagugcgcaaacuguugcaaguaagugagagcacgggaguugcccucaagcgaucuuccuggcugacuguguuacugguccuccuuacagugucacugagcccagugcagagugcuccggucggcagaaaacccuuguuucuagauucuauugccaagggcaugaagaaccugcucaauuccaccagccuggagacuucgcuuucuaucgaagcgccuuggggagcaaucaacguucaguccacauucaaaccaaccgugucaacggccaauauugcucugaguuggagcuccguagagcacagggggaacaagaucuuggugaccggucggucugaaagcauuaugaaacucgaggaacguacaggcgucucaugggaccuggggguggaggaugccagugaguccaaguuacugacuguuagcauaauggaccuaucucagauguacucacccguguuugaauaucucaguggagaucgccaagucgaggaauggccuaaagcaaccuguacaggcgacugcccagagagaugugguugcacuagcuccaccugucugcauaaggaauggccccacucuaggaauuggcggugcaacccgacauggugcuggggcguggggaccggauguacuugcuguggcguagauguuaaggaccuuuucacggaucauauguuuaucaaauggaagguggaguacauuaaaacagaggcuaucgucugcguggaauugaccgggcaggagcgacaguguucgcugaucgaagccggaacucgcuucaaccucgguccugucaccauuacacugagcgagcccagaaauauacaacagaaacuuccaccugagaucauuacccugcaccccaagaucgaagagggcuucuuugacuugaugcacgugcagaagguucucuccgcgucaacugugugcaagcugcagaguuguacacaugggauuccaggagauuuacaaaucuaucacauaggcaaccugcuaaaaggugacaggguaaaugggcaucucauccacaagauugaaccccauuucaacacgucuuggaugagcugggacggcugcgaucuggacuacuauuguaauaugggagauuggccuuccugcaccuacacuggcgucacacagcacaaccacgccgcauuugugaaucuuuugaacaucgagaccgacuauacaaaaacuuuccauuuucacucaaagcggguuaccgcucauggggauacgccacagcuggaccucaaagcccgcccgaccuacggagcuggugaaauuacagugcuggucgagguggccgauauggaguuacacacuaagaagguagaaaucagcggccugaaauucgcaucucuuaccuguacagggugcuacgccugcuccaguggaauaagcuguaaggugaggauucacguugacgagcccgaugaauugacuguccaugugaaaucuuccgacccugauguggucgcugcgucaaccagucucauggcaagaaagcuggaguuuggcacggacagcacauucaaagccuuuucggcuaugccaaagaccucccuaugcuucuauaucguugaacgugaguacuguaaaucuugcagcgaggaugacacuaagaaguguguggacacaaaacuggaacagccccaaucaauucucaucgagcacaaggguaccauaaucgggaaacagaaugauacuugcaccgccaaggcaaguuguuggcuggaauccgugaaaucauuuuucuauggccuuaagaacauguugggaagcguauuuggcuccuucuucgucgggauucuguuauuucucgccccuuucgugcugcuuguucuguuuuucauguuuggauggaagaucuuguucugcuuuaaauguugccggcgaacaagaggccucuucaaguacaggcaucugaaugacgaugaggaaacggguuaucgccggauuaucgagagacuaaacucuaaaaaggggaaaaauaggcugcucgacggagagcgccuggcugaucgaaagauagccgaacuuuuuagcaccaagacucacauuggc

SEQ ID NO: 10641 - RNA, 2916 nt, Artificial Sequence
  derived and/or modified CDS sequence (opt3) from CCHFV(K340_6, Artificial)__KX013475.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcacuaccggcaagacaugcgagauugacuccaccccaguuaaaugucgccaggguuuuugcuuaaagaucacucaggaggggcgaggacaugugaagcugucucguggcucggaaguagugcuagaugcuugugacucaagcugcgagauaaugaucccgaaaggcacaggggauauucucgucgacuguaguggaggucagcaacacuuccugaaggauaaccuuaucgaccugggcugcccccauauuccuccauuggggaaaauggcaaucuacauauguagaauguccaaucaccccaggaccacgauggccuuucucuucugguuuucuuucggauaugugauuacuugcaucuuuugcaaggcgcuguucuacagccugauuaucaucggcacccucgguaaaaagauuaagcaguaucgggaauuaaaaccucagacauguacuauaugcgagaccgcuccaguuaacgccaucgaugcagagaugcaugaccugaauuguuccuacaacauuugccccuauugugccucacgccuuacaagugacggguuggcuagacacgugacccagugcccuaagaggaaagaaaaggucgaggaaacggagcuguaccuaaaucucgaacggaucccauggauagugcgcaaacugcuucaaguaagcgagucuacuggaguugcacugaagcgauccucaugguugauugugcuccuggucuuacugacagugagccucaguccggugcagucugcccccgucggcagaaaaccucuuucccuggauagcaucguuaagggcaugaagaacuugcuaaauucgaccucucuggagacuucccucucaaucgaagcuccauggggagccauuaacgugcagaguacauuuaaacccaccguaagcacggcgaauaucgcacuguccuggucuagcguggagcacagggggaacaagauucuugucaccggucggucagaaaguauaaugaaacuggaggaacguacaggcguguccugggacuuggggguugaggaugccagcgagucuaagcuccugacugugucaaucauggacuuaagucagauguacagcccugucuucgaauaucuguccggagaucgccaaguggaggaauggccaaaagcuaccuguacaggcgacugccccgagagaugugguugcacuucuucgaccugucuacauaaggaauggccgcacagcaggaauuggcggugcaacccuacauggugcuggggcguagggaccggauguacuugcuguggcguugaugugaaggaccucuuuacggaucauauguucauuaaauggaaggucgaguacaucaaaacagaggccaucgugugcgucgaacugaccucccaggagcgacaguguucacuuauugaagcagggacucgcuuuaacuugggacccgugaccauaacacugagugagccaagaaauauccaacagaagcucccucccgagauuaucacccugcacccaaaaauugaagaggguuucuucgaccuuaugcacguucagaaggugcugucugcuagcacuguaugcaaguugcaguccuguacacauggcauccccggggaucuccaaauauaucacaucggaaaccuguuaaaaggcgacagggucaauggucaucugauucacaagaucgaaccucauuuuaacacgucauggaugagcugggacgggugcgaucuagacuacuauuguaauaugggcgauuggccaucuugcaccuacacuggagugacacagcacaaccacgccgcguucguuaaucuccugaacauugagaccgacuauacaaaaacuuuucauuuccacuccaagcgggugaccgcccauggcgauacgccgcagcuugacuugaaagcacgccccaccuacggggcuggagaaaucacaguccugguggagguaacugauauggagcuccacaccaagaagguggaaauaaguggucugaaauuugccagcuuaacauguacuggcugcuacgcuugcucuagugggauuucauguaagguuagaauccacgucgacgagccugaugaacugaccgugcaugugaaaaguagcgacccagaugucguugccgcaucgacgucccuuauggccaggaaguuggaguucggaacagacucuaccuuuaaggcuuucagcgcgaugcccaaaacuucacucugcuuuuauauuguggaacgugaguacuguaaaaguugcuccgaggaugacacaaagaaguguguggacaccaaacuggaacagccucaaucuauccuaauagagcacaagggcacuaucauugguaaacagaaugauaccugcacagcaaaggccagcuguuggcuggaauccguaaaaucauucuuuuaugggcucaagaacaugcugggcagcgucuucggauccuuuuucgugggcauccuuuuguuccuggcuccauuuguuuuacucgugcuguucuuuauguucggguggaagauuuuguuuugcuucaaauguugccggcgaacgagaggacuguuuaaguacaggcauuucaaagacgaugaggaaaccggcuaucgccggaucauagagagacuuaauucuaagaaagguaagaacaggcuccuggacggggagcgccuagccgaucgaaagauugcagaacuguuuuccacuaaaacacacaucgga

SEQ ID NO: 10642 - RNA, 2916 nt, Artificial Sequence
  derived and/or modified CDS sequence (opt3) from CCHFV(Mamon, Artificial)__KX013478.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugucagaugcaugugacagcaguugcgaggucaugauaccgaagggcacuggggauauccuaguggacuguuccggaggucagcaacacuuccucaaagauaaccugauugaccuuggcugcccccauaucccucuguuggggaagauggccauuuacaucuguaggaugucuaaucacccacggacaaccguugcguuucucuucugguuuagcuucggauaugugauaacgugcaucuuuugcaaagcucuguucuacucccugauuauuaucggcacucucgguaagaaaaucaagcaguaucgcgaauuaaagccccagaccuguacaauuugcgagacugccccugucaacgcaauagaugccgagaugcaugaccugaauuguucauacaacaucugcccauauugugcuaguagacuuaccagcgacggguuggcaaggcacgugccccagugcccuaaacggaaggaaaaaguagaggaaacagagcuguaccuaaaucucgaacgcauuccauggaucguucgaaagcugcuucaagugucugaguccaccggagucgcccugaaaagaucaagcugguugauagugcuccugguguuacugacggucagucucucuccgguucaguccgcucccgugggcaggaagccucuuuuucuggauagcauuguaaaaggcaugaagaacuugcuaaauucgacuucucuggagacaucccucucaaucgaagccccauggggagcgaucaacgugcagaguaccuucaagcccacugucagcacagcaaauauugcccuguccuggucuagcguggagcaccgggggaacaaaauccuuguuaccggucguucagaaaguauuaugaagcuggaggaacgcacgggcguguccugggacuugggggucgaggaugcuagcgagucuaaacuccugaccgugucaauaauggacuuaagucagauguacagcccuguauuugaauaucuguccggagauagacaaguugaggaauggccaaaggccacauguacuggcgacugccccgagaggugugguugcaccucuucgacaugucuacauaaagaauggccgcacagccggaauuggcgaugcaacccuacuuggugcuggggcguggggaccggauguacaugcuguggcgucgaugugaaggaccucuucaccgaucauauguuugucaaguggaaaguggaguacaucaagacugaggcaauuguuugcguggaacugacgucccaggagcgccaguguucacuuaucgaagcugggacaagauucaacuugggacccguaaccaucacucugagugagccaaggaauauucaacagaaacucccucccgagauaaucacccugcacccaaaggucgaagaggguuucuuugaccuuaugcacgugcagaaaguucugucugccagcacagugugcaaguugcaguccuguacccauggcauucccggggaucuccaagucuaucacaucggaaaccuguuaaagggcgaccgggugaauggucaucugauucacaaaaucgaaccucauuucaacacuucauggaugagcugggacgggugcgaucuagacuacuauuguaauaugggcgauuggccaucuugcacauacacgggaguaacccagcacaaccacgcggccuuugugaaucuccugaacauagagacugacuauacaaagaccuuccauuuucacuccaaacgcguuacagcacauggcgauacuccgcagcuugacuugaaggcuagacccaccuacggggccggagaaaucacgguccugguggagguggcugauauggagcuccacaccaaaaaggucgaaauuaguggucugaaguucgccagcuuagcauguacaggcugcuacgccuguucuuccgggaucucaugcaaaguuaggauucacguggacgagccugaugaacugacugugcauguaaagaguagcgacccagaugucguggcugcgucgaccucccuuauggcacguaaauuggaguuuggaacagacucuacuuucaaggccuuuagcgcuaugcccaaaaccucacucugcuucuauaucguugaacgggaguacuguaagaguugcuccgaggaagauacgcagaaauguguggacacaaagcuggagcaaccucagucuauacuaauugaacacaagggcaccaucauugguaaacagaaugacacuugcacagccaagaccagcuguuggcuggaguccgucaaaucauuuuucuaugggcucaagaacaugcugggcagcguguuuggaaauuucuucaucggcauacuuuuguuucuggcaccauucguuuuacucgugcuguuuuucauguuuggguggaaaauccuuuucugcuuuaaguguugccgaagaacuaggggacuguugaaguaccgccaucucaaagaugacgaagagaccggcuaucggagaauuaucgagaggcugaacaauaagaaagguaagaaccgccuacuggauggggaacgacucgccgaccggaaaauugcugagcuguucaguacaaagacgcacaucgga

SEQ ID NO: 10643 - RNA, 2916 nt, Artificial Sequence
  derived and/or modified CDS sequence (opt3) from CCHFV(Min, Artificial)__KX013481.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaaaagauccucauggcucauaguccuguuagugcugcucacggugagccuuaguccgguccagucugcucccguuggcaggaagccucuguuuuuggauuccauugugaaaggcacuaagaaccuacugaauagcacaucgcucgagaccucucuguccaucgaagccccauggggagcgaucaacguacagucaacuuucaagcccacagugaguaccgcaaauauugcccuuagcugguccucugucgagcaccgggggaacaaaauccuggugacgggucguagcgaaucaauuaugaaguuggaggaacgcaccggcguuaguugggaccucgggguggaggaugcuuccgagagcaaacuguuaacagucucuauaauggaccugucacagauguacaguccuguguuugaauaucuaagcggagauagacaaguagaggaauggccaaaggccacuuguaccggcgacugccccgagaggugugguugcacauccucuacuugucuccauaaagaauggccgcacucgcggaauuggcgaugcaacccuaccuggugcuggggcguugggacaggauguaccugcuguggcguggaugucaaggaccuguucacugaucauauguuugugaaguggaaagucgaguacaucaagacggaggcaauugugugcguugaacuuacaagccaggagcgccaguguuccuugaucgaagcugggaccagauucaaccugggacccgugacuaucacccucucagagccaaggaauauucaacagaaacugccucccgagauaaucacacuucacccaaagguagaagaggguuucuuugaccugaugcacguccagaaaguguugagugccucuaccguuugcaagcuccagagcuguacucauggcauucccggggaucugcaaguguaucacaucggaaacuuacugaagggcgaccggauuaauggucaucuaauccacaaaauagaaccucauuucaacacauccuggaugucaugggacgggugcgaucucgacuacuauuguaauaugggcgauuggccaagcugcacguacaccggagucacucagcacaaccacgcggccuuugugaaucugcuuaacaucgagacagacuauaccaagacauuccauuuucacucuaaacgcguaacugcacauggcgauaccccgcaguuggaccugaaggcuagacccacguacggggccggagaaauuaccgugcucguugaggucgcugauauggagcugcacacaaagaagguggaaaucuccgguuuaaaguucgccagucuggcauguacuggcugcuacgccugcagcucugggauuuccuguaaagugaggauccacgucgacgagccugaugaacuuaccguucaugugaagucaagugacccagaugugguagcugcgagcacaucguugauggcacguaaacucgaguuuggaacugacuccaccuucaaggccuuuucugcuaugcccaaaacgagccugugcuucuauauagucgaacgggaguacuguaagucaugcagugaggaagauacacagaaauguguggacaccaagcuagagcaaccucaguccauucugaucgaacacaagggcacuauuaucgguaaacagaaugacacaugcaccgccaaggcaucuuguuggcucgagagcguuaaauccuuuuucuaugggcugaagaacaugcuuggcucaguguuuggaaauuucuucauaggcaucuugcuguuuuuagccccauucguccuccuggugcuguuuuucauguuuggguggaaaauucuuuucugcuuuaaguguugccgaagaacuaggggauugcucaaguaccgccaucugaaagaugacgaagagaccggcuaucggagaaucauugagaggcuaaacaauaagaaagguaagaaccgccugcucgauggggaacgacuggcugaccggaaaaucgccgagcuuuucagcacaaagacgcacauagga

SEQ ID NO: 10644 - RNA, 2916 nt, Artificial Sequence
  derived and/or modified CDS sequence (opt3) from CCHFV(Nakiwogo, Artificial)__KX013484.1__Gn-4aa-Gc
gccgagggcgugagcaacgacugcgucuccagaacccagcugaucaagacagaaguugcugagauucacgaagauucuuacgggggacccggugagaaaauaacuaucuguaauggcucaacgauuguggaccaaaggcucgggagugaacuuggaugcuauaccaucaaccggguaaagacauacaaacugugugagaauagcgcaacugagaagggcugcgaaauugauuccgugccugucaaauguaagcaggguuucugcuugaaggugacccaggaggggcgcggacauguuaaauuaucucgaggcacagaaaucgugcuggacgucugugauaccucgugcgagcuaaugauaccaaagggcacuggggacauccucguggauuguucaggaggucagcaacacuuucugcaggacaaccuuauugaucugggcugcccgaauguacccuugcucgggaaaauggccaucuauauuugucguaugagcaaccauccuaagacaaccauggcguuccuguuuugguucaguuuuggauacguuaucacgugcguggucugcaaagugcuguucuaucucuuaauagugauuggcacucuggguaagaaacuuaagcaguacagagaguugaagccacagaccuguaucgucugcgaauccauucccguuaaugugaucgacgcugagaugcacgaacugaacuguaauuauaacaucugcccuuacugugccucuaggcuaacaagcgaugggcucguacggcaugugacucaaugcccaaaacgcaaggagaaagucgaagagaccgagcuguaccuuaaucuggaaaggauucccugguuggugagacggcuccugcagguuuccgagucaacaggaauggcauuaaagcgcaguuguuggaugaccacgcugcucauacuucugguggucagcuugucuccugugcaguccgccccaguaggccgaaaaccgcuauaucuggacucaaucgcuaagggcaugaaaagccuccugaacaguacuaaucuugaaacaucucuguccauugaggcacccuggggugccaucaacguucagagcaccuuuaagccuacugugucggcugccaauauagcguugucuugguccucagucgaacacagaggaaacaagauucucgugagugguaggagcgaguccaucaugaaacuggaggaacggacaggcaucucuuggagcuuaggggucgaggaugcaucagaaaguaagacccugacgguguccguuauggaccuaagccaaauguacucuccaguguucgaguaucucucaggagaccgucagguagaagaguggcccaaagcuaccugcacaggcgauuguccugagcgcugcgguuguacuagcaguaccugccugcacaaggaauggccacauuccagaaacuggaggugcaaucccacaugguguuggggcgucgggacuggaugcaccuguugcggccuugacgugcgggauuuguuuacagacuacaugaugguuaaguggaaaguggaguaugucaagaccgaagccauuauguguguggagcugacuucucaggagcgacaaugcucgcucaucgaagccgggacgcgcuucaaccugggaccgguaacaauuacccuuagcgagccuagaaaugugcagcagaggcugcccuccgaaauaguuacuuugcacccaaaaaucgaggaaggguuuuucgaucucaugcauguccagaaggugcuguuuuguaaacacucauuacaagcaaccaguugcacacacggcgugccuggggaccugcaggucuaccauguuggaaaccuacucaagggcgauaaggugaauggucacucuauucauaaaaucgagagccacuucaacaccuccuggaugucaugggacgggugugaucuggacuauuucugcaauaugggcgauuggcccagcuguacuuacacaggagugacgcagcauaaccgggcugccuuuguaaauaugcuuaacaucgagaccgacuacacuaagacauuccacuuucacucuaaacgcgucaccgcgcauggcgacacaccacaguuggaucugaaggccagacccacuuauggggcaggagaagugaccguucucguggaggucgcugaccuggaauuacacacgaaaaagauugagguguccggucugaaguucgccagucuuaccugcagcggcugcuacgcuuguucuuccgggauaucaugcaaaguuaggauccaugugaaugaaccugaugaguuuacaguacacgucaagaguaacgacccagaugugguggccgcaggaagcucguugauggcccguaaaauugagcucggcgcugacuccacuuucaaggcguuuucuagcaugccgaaaaauucacuguguuucuauaucgucgaacgggauuacugcaguuccuguaccgacgaugacacacaaaagugcguuaacacuaaacuagagcacccccagucuauucugaucgaacauaaggguaccauaaucgggaagcagaaugauacguguccuacaaaaaccagcugcuggcucgaguccgugaagucauuuuucuauggccugaaaaacaugcuuggaggcauuuuugggaacguauucuugggaaucuuucuguucuuagcaccauucgcccuccugauucuguuuuucuuuuucggcuggcgacuuuuguuuugucucaagugcuguagaaggacucgcggucugcuaaaauacaagcagcugaaggacgaagaggaggcuggguauaaaaagaucauagaacggcucaaugauaaaaagggaaaaagcagacuguucgacggcgagaggcuugccgaccgcaagauugcagaauuguuuaguacaaagacccacaucggu

SEQ ID NO: 10645 - RNA, 2916 nt, Artificial Sequence
  derived and/or modified CDS sequence (opt3) from CCHFV(Saf, Artificial)__KX013487.1__Gn-4aa-Gc
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuaccugaaagauaaccuuauugaccugggcugcccccauaucccuuugcucgggaagauggccauuuauaucuguaggauguccaaucacccacggacaaccauggcguuccuguuuugguucucuuuuggauacguuauaacgugcauuuucugcaaagcucuguuuuauagccucaucauuaucggcacuuuagguaagaaaaucaagcaguaccgcgaacugaagccccagaccuguacaauuugcgagacugccccugugaacgcaauagaugccgagaugcaugaccuuaauuguuccuauaacaucugcccauacugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaagagauccucauggcucauaguccuguuagugcugcucacggugagccuuaguccgguccagucugcucccguuggcaggaagccucuguucuccgauagcauugugaaaggcaugaagaacuugcuaaauucgacuucucuggagacaucccucucaaucgaagccccauggggagcgaucaacguacagaguaccuuuaagcccacugugagcacagcaaauauugcccuguccuggucuagcgucgagcaccgggggaacaaaauccuugugaccggucguucagaaaguauuaugaagcuggaggaacgcacgggcguuuccugggacuuggggguggaggaugcuagcgagucuaaacuccugaccgucucaauaauggacuuaagucagauguauagcccuguguucgaauaccuguccggagauagacaaguagaggaauggccaaaggccacauguacuggcgacugccccgagaggugugguugcaccucuucgacaugucuacauaaagaauggccgcacagccggaauuggcgaugcaacccuacuuggugcuggggcguugggaccggauguacaugcuguggcguggaugucaaggaccucuuuaccgaucauauguucgugaaguggaaagucgaguauaucaagacugaggcaauugugugcguugaacugacgucccaggagcgccaguguucacuuaucgaagcugggacaagauuuaacuugggacccgugaccaucacucugagugagccaaggaauauucaacagaaacucccucccgagauaaucacccugcacccaaagguagaagaggguuucuucgaccuuaugcacguccagaaagugcugucugccagcacaguuugcaaguugcaguccuguacccauggcauucccggggaucuccaaguguaccacaucggaaaccuguuaaagggcgaccgggucaauggucaucugauucacaaaaucgaaccucauuuuaacacuucauggaugagcugggacgggugcgaucuagacuauuacuguaauaugggcgauuggccaucuugcacauauacgggagugacccagcacaaccacgcggccuucguaaaucuccugaacauagagacugacuacaugaagacauuucauuuccacuccaaacgcgugaccgcacauggcgauacaccgcagcuugacuugaaggcuagacccacuuacggggccggagaaaucaccguucuggucgagguggcugauauggagcuccacacgaaaaagguggaaauuaguggucugaaguuugucagcuuagccuguaccggcugcuaugcauguucuuccgggaucucaugcaaaguuaggauucacguggacgagccugaugaacugacagugcauguaaagaguagcgacccagaugucguggccgcuucgacuucccuuauggcgcguaaauuggaguucggaaccgacucuacauuuaaggcauucagcgccaugcccaaaacuucacucugcuuuuacaucguugaacgggaguauuguaagaguugcuccgaggaagauacccagaaauguguggacacgaagcuggagcaaccucagucuauacuaauugaacacaagggcacaaucauugguaaacagaaugauaccugcacugcuaaggccagcuguuggcuggaguccgucaaaucauucuuuuacgggcucaagaacaugcugggcagcguguucggaaacuuuuucaucggcauacuuuuguuccuggcaccauuuguuuuacucgugcuguucuuuauguucggguggaaaauccuguuuugcuucaaguguugccgaagaacaaggggacuuuugaaguaucgccaucucaaagacgacgaagagaccggcuaccggagaauuaucgagaggcugaauaauaagaaagguaagaaccgccuacuggauggggaacgacucgccgaccggaaaauugcugagcuguuuaguacuaagacccacaucgga

SEQ ID NO: 10646 - RNA, 2916 nt, Artificial Sequence
  derived and/or modified CDS sequence (opt3) from CCHFV(Ast199, Artificial)__KX056051.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuacagccucauuaucaucggcacuuuagguaaaaagauuaagcaguaucgggaacugaaaccccagaccuguacaauaugcgagacugccccuguuaacgcaaucgaugccgagaugcaugaccuuaauuguuccuacaacauuugcccauauugugcuucacgcuugaccagugacgggcuggcaagacacgugacacagugccccaagaggaaagaaaaggucgaggaaaccgagcuauaccucaaucuggaacggaucccuuggauagugcgcaaacuucugcaaguaagcgagucuacgggaguugccuugaagcgauguuccuggcucauugugcuguuaguccugcucacugugucacuuagcccagugcagagugcuccggucggcagaaaaccccuguuuuuggauucuaucguuaagggcaugaagaaccuacucaauuccacaagccuggagaccucgcugucuaucgaagccccuuggggagcgauuaacgugcaguccacuuucaaaccaacaguaucaaccgcaaauaucgcccuuaguuggagcuccguggagcacagggggaacaagauucuggucacgggucggucugaaagcauaaugaaauuggaggaacguaccggcgugucaugggaccucgggguugaggaugcuagugaguccaagcuguuaacagugagcaucauggaccugucucagauguacucacccgucuuugaauaucuaaguggagaucgccaaguggaggaauggccuaaagccacuugcaccggcgacuguccagagagaugcgguuguacaagcuccacuugccuccauaaggaauggccccacucuaggaauuggcggugcaacccgaccugguguuggggcguagggacaggaugcaccuguugcggcguugaugugaaggaccuguucacugaucauauguuuauuaaauggaaggucgaguacaucaaaacggaggcaaucgugugugucgaacuuacaucgcaggagcgacagugcagcuugauugaagcugggacccgcuucaaccugggaccugugacuauaacccucuccgagcccagaaauauccaacagaagcugccaccugagauuaucacacuucaccccaaaauugaagaggguuucuuugaccugaugcacguucagaagguguugucagccaguaccguauguaagcuccagucuugcacucauggcaucccaggggaucugcaaauauaucacaucggaaacuuacugaaaggcgacaggcuaaauggucaucucauucacaagaucgaaccccauuucaacacaagcuggauguccugggacgggugugaucuggacuacuauugcaauaugggcgauuggccuucauguacguacaccggagucacucagcacaaccacgcggccuuugugaaucuuuugaacauugagacagacuauaccaaaacauuccauuuucacagcaagcggguuacugcacauggcgauaccccacagcuggaccucaaagcucgcccgacguacggggccggagaaaucaccgugcuggucgagguggcugauauggaguuacacacaaagaagguagaagugucuggucugaaauucgccucccuugcaugcacuggcugcuacgccuguaguagcgggauaucuugcaagguuaggauucacgucgacgagcccgaugaauugaccgugcaugugaaauccucagacccugaugucguugcugcgaguacaagccucauggcaagaaagcuggaguuuggaacugacucgaccuucaaagccuuuuccgcuaugccaaagacgucucuauguuucuauaucguggaacgugaguacugcaaaagcuguucagaggaugacacaaagaagugcguggacaccaaacuggaacagccccaaaguauucucaucgagcacaagggcacuauaaucgguaaacagaaugauacauguaccgccaaggcauccugcuggcuggaaucuguaaaaucauuuuucuaugggcuuaagaacauguugggcuccgucuuuggaaauuucuucgugggcauucuguuauuucucgccccuuucguucugcuugugcuguuuuucaucuuuggguggaagauuuuguucuguuuuaaaugcugucggcgaacuagaggacucuucaaguacaggcaucugaaagacgaugaggaaaccggcuaucgcaagaucauagagcggcuaaacagcaaaaaggguaagaauagacugcucgacggggagaggcuggcugaucgcaaaauugccgaacuuuuuagcacaaagacgcacaucgga

SEQ ID NO: 10647 - RNA, 2916 nt, Artificial Sequence
  derived and/or modified CDS sequence (opt3) from CCHFV(Ast149, Artificial)__KX056054.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuacagccucauuaucaucggcacuuuagguaaaaagauuaagcaguaucgggaacugaaaccccagaccuguacaauaugcgagacugccccuguuaacgcaaucgaugccgagaugcaugaccuuaauuguuccuacaacauuugcccauauugugcuucacgcuugaccagugacgggcuggcaagacacgugacacagugccccaagaggaaagaaaaggucgaggaaaccgagcuauaccucaaucuggaacggaucccuuggauagugcgcaaacuucugcaaguaagcgagucuacgggaguugccuugaagcgauccucauggcucauugugcuguuaguccugcucacugugagccuuaguccagugcagucugcuccggucggcagaaaaccccuguuuuuggauuccaucguuaagggcaugaagaaccuacugaauagcacaucgcucgagaccucucuguccaucgaagccccuuggggagcgauuaacgugcagucaacuuucaaaccaacaguaaguaccgcaaauaucgcccuuagcugguccucuguggagcacagggggaacaagauucuggucacgggucggagcgaaucaauaaugaaauuggaggaacguaccggcgugaguugggaccucgggguugaggaugcuuccgagagcaagcuguuaacagugucuaucauggaccugucacagauguacagucccgucuuugaauaucuaagcggagaucgccaaguggaggaauggccuaaagccacuuguaccggcgacugcccagagagaugugguugcacauccucuacuugucuccauaaggaauggccccacucgaggaauuggcggugcaacccgaccuggugcuggggcguagggacaggauguaccugcuguggcguugaugugaaggaccuguucacugaucauauguuuauuaaauggaaggucgaguacaucaaaacggaggcaaucgugugcgucgaacuuacaagccaggagcgacaguguuccuugauugaagcugggacccgcuucaaccugggaccugugacuauaacccucucagagcccagaaauauccaacagaagcugccaccugagauuaucacacuucaccccaaaauugaagaggguuucuuugaccugaugcacguucagaagguguugagugccucuaccguaugcaagcuccagagcuguacucauggcaucccaggggaucugcaaauauaucacaucggaaacuuacugaaaggcgacaggcuaaauggucaucucauucacaagaucgaaccccauuucaacacauccuggaugucaugggacgggugcgaucuggacuacuauuguaauaugggcgauuggccuagcugcacguacaccggagucacucagcacaaccacgcggccuuugugaaucuuuugaacauugagacagacuauaccaaaacauuccauuuucacucuaagcggguuacugcacauggcgauaccccacagcuggaccucaaagcucgcccgacguacggggccggagaaaucaccgugcuggucgagguggcugauauggaguuacacacaaagaagguagaaguguccggucugaaauucgccagucuugcauguacuggcugcuacgccugcagcucugggauauccuguaagguuaggauucacgucgacgagcccgaugaauugaccgugcaugugaaaucaagugacccugaugucguugcugcgagcacaucgcucauggcaagaaagcuggaguuuggaacugacuccaccuucaaagccuuuucugcuaugccaaagacgagccuaugcuucuauaucguggaacgugaguacuguaaaucaugcagugaggaugacacaaagaaguguguggacaccaaacuggaacagccccaauccauucucaucgagcacaagggcacuauaaucgguaaacagaaugauacaugcaccgccaaggcaucuuguuggcuggaaagcguaaaauccuuuuucuaugggcuuaagaacauguugggcucagucuuuggaaauuucuucgugggcauucuguuauuucucgccccuuucguucugcuugcucuguuuuucaucuuuggguggaagauuuuguucugcuuuaaauguugccggcgaacuagaggacucuucaaguacaggcaucugaaagacgaugaggaaaccggcuaucgcaagaucauagagcggcuaaacagcaaaaaggguaagaauagacugcucgacggggagaggcuggccgaucgcaaaauugcagaacuuuuuaguacaaagacgcacaucgga

SEQ ID NO: 10648 - RNA, 2916 nt, Artificial Sequence
  derived and/or modified CDS sequence (opt3) from CCHFV(Ast137, Artificial)__KX056057.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccauccacauauguagaauguccaaucauccaaggacaaccauggcguuucuguucugguuuucuuucggauacgugauuacgugcaucuuuugcaaggcucuguucuauagccucauuaucaucggcacuuuagguaaaaagauuaagcaguaccgggaacugaaaccccagaccuguacaauaugcgagacugccccuguuaacgcaaucgaugccgagaugcacgaccuuaauuguuccuauaacauuugcccauacugugcuucacgcuugaccagugacgggcuggcaagacacgugacacagugccccaagaggaaagaaaaggucgaggaaaccgagcuauaucucaaucuggaacggaucccuuggauagugcgcaaacuucugcaaguaagcgagucuacgggaguugccuugaagcgauccucauggcucauugugcuguuaguccugcucacugugagccuuaguccagugcagucugcuccggucggcagaaaaccccuguuuuuggauuccaucguuaagggcacaaagaaccuacugaauagcaccucgcucgagacuucucuguccaucgaagccccuuggggagcgauuaacgugcagucaacauucaaaccaaccguaaguacggcaaauaucgcccuuagcugguccucuguggagcauagggggaacaagauucuggucaccggucggagcgaaucaauaaugaaauuggaggaacguacaggcgugaguugggaccucgggguugaggaugcuuccgagagcaagcuguuaacugugucuaucauggaccugucacagauguacagucccgucuuugaauaccuaagcggagaucgccaaguggaggaauggccuaaagccaccuguacaggcgacugcccagagagaugugguugcacuuccucuaccugucuccacaaggaauggccccauucgaggaauuggcggugcaacccgacauggugcuggggcguagggaccggauguacuugcuguggcguugaugugaaggaccuguucacggaucacauguuuauuaaauggaaggucgaguauaucaaaacagaggcaaucgugugcgucgaacuuaccagccaggagcgacaguguuccuugauugaagcugggacucgcuucaaccugggaccugugaccauaacacucucagagcccagaaauauccaacagaagcugccaccugagauuaucacccuucaccccaaaauugaagaggguuucuuugaccugaugcauguucagaagguguugagugccucuacuguaugcaagcuccagagcuguacacacggcaucccaggggaucugcaaauauaccauaucggaaacuuacugaaaggcgacaggcuaaauggucaccucauucauaagaucgaaccccacuucaacacguccuggaugucaugggacgggugcgaucuggacuauuacuguaauaugggcgauuggccuagcugcaccuauacuggagucacacagcacaaccaugcggccuuugugaaucuuuugaacauugagaccgacuacacaaaaacuuuccacuuucauucuaagcggguuaccgcacacggcgauacgccacagcuggaccucaaagcucgcccgaccuauggggccggagaaaucacagugcuggucgagguggcugauauggaguuacacacuaagaagguagaaguguccggucugaaauucgccagucuugcauguaccggcugcuacgccugcagcucugggauauccuguaagguuaggauucaugucgacgagcccgaugaauugacagugcacgugaaaucaagugacccugaugucguugcugcgagcacuucgcucauggcaagaaagcuggaguuuggaaccgacuccacguucaaagccuuuucugcuaugccaaagacaagccuaugcuucuacaucguggaacgugaguauuguaaaucaugcagugaggaugacaccaagaaguguguggacacuaaacuggaacagccccaauccauucucaucgagcauaagggcacaauaaucgguaaacagaaugauaccugcacugccaaggcaucuuguuggcuggaaagcguaaaauccuuuuucuacgggcuuaagaacauguugggcucagucuuuggaaauuucuucgugggcauucuguuauuucucgccccuuucguucugcuugugcuguuuuucaucuuuggguggaagauuuuguucugcuuuaaauguugccggcgaaccagaggacucuucaaguauaggcaccugaaagacgaugaggaaacaggcuaccgcaagaucauagagcggcuaaacagcaaaaaggguaagaauagacugcucgacggggagaggcuggcugaucgcaaaauugccgaacuuuuuaguacgaagacccauaucgga

SEQ ID NO: 10649 - RNA, 2916 nt, Artificial Sequence
  derived and/or modified CDS sequence (opt3) from CCHFV(Ast133, Artificial)__KX056060.1__Gn-4aa-Gc
agcgaggaacccgacgaugacugcaucuccagaacccagcugcucaagacagagacugccgaaauucacgaugacaacuacggcgggccuggagauaaaauaacgaucuguaaugguucuaccauuguggaccaaaggcuuggcucagagcuggggugcuauacaaucaaccgggucaagaguuucaaauugugugaaaauagcgcuacuggaaagaccugcgagauugauuccacaccaguuaaaugucgccagggcuuuugcuuaaagaucacccaggagggucgagggcaugugaagcugucucguggaucggaaguagugcuagacgcaugugauucaagcugcgagauaaugaucccgaaaggcacuggcgacauucucgucgauuguagugggggacagcaacacuuccugaaggacaaccuuaucgaucuggguugcccccauauuccuuugcucggcaaaauggccaucuacauauguagaauguccaaucacccaaggacaaccauggcguuucuguucugguuuucuuucggguaugugauuacgugcaucuuuugcaaggcucuguucuaccucuuaauuaucaucggaacucugggcaaaaagauuaagcaguaucgggaacuuaaaccccagaccuguacaauaugcgagacugccccuguuaacgcaaucgacgccgagaugcaugacuugaauuguagcuacaacauuugcccauauugugcuucccgccugaccucagauggucuagcaagacacgugacacagugccccaagaggaaagaaaaggucgaggaaaccgagcucuaccugaaucuugaacggaucccuuggauagugcgcaaacuguugcaaguaagugagagcacggggguugcccucaagcgaucuuccuggcugauuguguuacugguccuccuuacugugucacugagcccagugcagagugcuccggucggaagaaaacccuuguuuucugacuccaucguuaagggcaugaagaaccuacugaauagcacaucgcucgagaccucucuguccaucgaagccccuuggggcgcgauuaacgugcagucaacuuucaaaccaacaguaaguaccgcaaauaucgcccuuagcugguccucuguggagcacagggggaacaagauucuggucacgggacggagcgaaucaauaaugaaauuggaggaacguaccggugugaguugggaucucggcguugaggacgcuuccgagagcaagcuguuaacagugucuaucauggaucugucacagauguacagucccgucuuugaauaucuaagcggggaccgccaaguggaggaauggccuaaagccacuuguaccggagauugcccagagagauguggcugcacauccucuacuugucuccauaaggaauggccccacucgaggaauuggcggugcaacccgaccuggugcugggguguagggacaggcuguaccugcuguggaguugacgugaaggaucuguucacugaccauauguuuauuaaauggaaggucgaguacaucaaaacggaggcaaucgugugcgucgaacuuacaagccaggagcgacaguguuccuugauugaagcuggcacccgcuucaaccuggggccugugacuauaacccucucagagcccagaaauauccaacagaagcugccaccugagauuaucacacuucaccccaaaauugaagagggauucuuugaucugaugcacguucagaagguguugagugccucuaccguaugcaagcuccagagcuguacucaugguaucccaggcgaccugcaaauauaucacaucgggaacuuacugaaaggagacagggucaauggccaucuaauucacaagaucgaaccccauuucaacacauccuggaugucaugggaugguugcgaccucgauuacuauuguaauaugggggacuggccuagcugcacguacaccggcgugacucagcacaaccacgcggccuuuguuaaucugcuuaacauugagacagauuauaccaaaacauuccauuuucacucuaagcgggugacugcacauggagacaccccacaguuggaucugaaagcucgcccgacguacggcgccggggaaaucaccguccucguggagguagcugacauggagcugcacacaaagaagguggaaauauccggauuaaaauucgccagucugacuuguaccgguugcuacgcaugcagcucuggcauuuccuguaagguuagaauccacgucgaugagcccgacgaacuuacagugcaugugaaaucaagugauccugacgucguugccgcuagcacuucguugauggcgaggaagcucgaguuugggaccgauuccacguucaaagcauuuucugccaugccaaagacaagccugugcuucuauauuguggaacgugaguacuguaaaucaugcagugaggacgacaccaagaaguguguggauacuaaacuagaacagccccaauccauccugauagagcacaagggaacaaucauuggcaaacagaaugauaccugcacugcuaaggccucuuguuggcucgaaagcguaaaauccuuuuucuauggucugaagaacaugcuugggucagucuuuggcagcuucuucgugggaaucuugcuguuuuuagcaccuuucguucuccuggugcuguuuuucauguuuggcuggaagauucuuuucugcuuuaaauguugccggcgaaccagaggguuguucaaguacaggcaucucaaagacgacgaggaaacaggauaucgccggaucauagagagacugaauaguaagaaaggcaagaacaggcuacuggauggugagcgccucgccgaccgaaagauugcugaacuguuuucuuccaaaacgcacaucggg

SEQ ID NO: 10650 - RNA, 2916 nt, Artificial Sequence
  derived and/or modified CDS sequence (opt3) from CCHFV(SK/2015/human, Artificial)__KX458183.1__Gn-4aa-Gc
agcgaggaauccggcgacgauugcaucucuagaaccaggcugcuccggacagagacugccgaaauucacggggacucauacggaggucccggcgauaagauaacgaucuguaacgggaguaccauuguggaccagcgccuuggaagcgagaugggcugcuauacaaucaaucgagucaaauccuucaagcugugugaaaacucugcuacugguaaaucgugcgagauugauucaaucccuguucguuguagacaaggguacugcuugaagauaacccaggagggaaggggccaugugaaauuaagccggggcagugaaguagugcuggacgcaugugauuccucuugcgaggucaugaucccaaaggggacaggagacauucuaguggauuguagcgguggccagcagcacuuucucaaggacaaucugaucgaucuugggugcccgaacauuccccuguugggaaaaauggccaucuauauaugucgcauguccaaucauccuaagaccacuauggcguuccucuuuugguucucauuuggcuacguuauuacaugcauccugugcaaagcuauuuucuaucugcucaucaucguggguaccuuagggaagagauuuaaacaauacagggaacugaagccacagacguguacuauuugcgagaccacacccgccaacgcaauagacgccgagaugcacgaucuuaauuguaguuauacuaucugcccuuacugugcuagccgguugaccucugacggacuggcacgccaugucacacagugcccaaagcgaaaagaaaagguggaggaaaccgagcuauaccucaaccuggaaaggauucccuggguaguuagaaaacuucugcaaguguccgagucaacgggcgucgccuugaagcggagcaguuggcucaucgugcuguuagugcuguucacugucucucucuccccuguucagagcgcuccaauaggccgucgcccgcuuuuucuggacucgauugugagagggaugaaaaauuugcuaaacucuacaucccuggagaccucacucaguaucgaagcccccuggggagcgaucaauguacagagcacuuauaagccuacaguguccaccgcaaacauugcccugucuuggagcucagucgagcacagggguaauaaaauccuugugaguggccgguccgaaagcauuaugaagcuggaggaacgaacggggguuucuugggauuugggaguggaggacgcuucagagaguaagcuccugaccgucagcgugauggauuuaucccagauguacucuccaguauucgaauaucugucgggcgaccgccagguugaggaauggcccaaagccacauguacuggugauugcccugagagaugugggugcaccacaagcacuugucuacacaaggaauggccacauuccaggaacuggcggugcaaucccaccuggugcuggggcgugggaacaggcuguaccugcugugggcucgacgucaaagaucuguuuacugacuacauguucgugaaguggaaagucgaguauauaaagacggaggcaaucgugugcguugaacuuacaucacaaggacgccaguguaguuugauugaggcugguaccagauuuaaccugggcucugugacuaucacccucagcgaaccgaggaacauccagcacaagcugccucccgagauuauaacacuucauccacguaucgaggaaggguucuucgaucugaugcacguacaaaaagucuuguccgccucaaccgugugcaagcuccagagcuguacucacggaguuccuggcgacuuacagguguaccauauugguaaucugcugaaaggggauaaggucaacggccaccuaauccauaaaauugagccccacuuuaauacaucuuggauguccugggacggaugcgaccucgauuauuacuguaacaugggcgacuggccaaguugcacguacaccggggugacucagcauaaucacgcgagcuucguaaaccugcuuaauaucgaaacagauuauaccaagaacuuucacuuccauucuaagcgggugacagcccacggagacacuccccaauuggaucugaaagcacgaccuaccuacggugcuggcgagauaacgguucucgucgaaguggccgacauggagcugcauaccaagaaaaucgagauuuccggguuaaaguuugcuucacugacauguacuggaugcuaugccugcaguagcggcaucucguguaaagugaggauucacgucgaugaaccagacgagcuuaccguucacgugaaguccgaugacccggaugugguagcagccucuagcucauugauggcuagaaagcucgaguucgguacagacaguacuuuuaaagcguucuccgcaaugcccaagaccucucugugcuuuuacaucgucgaacgcgaauauuguaaaagcugcuccaaggaggauacgcagaaaugugugaauacaaagcuagagcagccucagucaauacugauugaacaucgggggaccaucauuggcaaacaaaacaauacuugcaucgccaaggcuagcuguuggcucgagaguguuaagucuuucuuuuacggacugaaaaacaugcuuuccggcauauucgggaauuuguuucugggaaucuucuuauuccucgccccauuuauucugcuuauccuguucuuuauguucggcuggagaauuuuguuuugcuucaaguguugcaggcgcacacgaggucucuuuaaauaucggcaccugaaggacgacgaagagaccggguaccguagaaucauagaaaggcuaaacaauaaaaagggaaagaacaaacugcucgauggcgagcgccuggcagaccggagaauugccgagcuuuucagcacuaagacccauaucggu

SEQ ID NO: 10651 - RNA, 2916 nt, Artificial Sequence
  derived and/or modified CDS sequence (opt3) from CCHFV(YL16070, Artificial)__KY354081.1__Gn-4aa-Gc
gccgagggcgggagcuccgacugcaucucuagaacccagcuggugaagacagaagucgcugagauucacgaagauucauacggaggucccggcgagaaaauaacuaucuguaacgggaguacgauuguugaccaaaggcucggaagcgaacuuggcugcuauaccaucaaucgggugaaguccuacaaacugugugagaacucugcaucggguaagucaugcgagauugauagcaucccuguaaaauguaagcagggguucugcuugaagauaacacaggaaggacgcggccaugugaaauuaagucgaggcacugagaucguccuggacgugugugauuccucuugcgaacuaaugauuccaaaggggaccggagacauccucguugauuguagcgguggccagcaacacuuucugcagaauaaccuuauugaccuggggugcccgaaugugcccuugcucggaaaaauggccaucuaugucugucguauguccaaccauccuaagacaaccauggcguuccuguuuugguucucauuuggcuacgugauaacuugcauuguaugcagaguucuguucuaucucuuaaucgcuauugguacaguggggaaaaagcugaagcaguacagggagcuuaaaccacagaccuguaucgucugcgagagugugcccgugaaugccaucgaugcagaaaugcacgaguugaacuguagcuauaauauuugcccuuacugugccucucggcuguccacggacggacuaauacgccaugucacucaaugcccaaagagaagggaaaaaguugaggaaaccgagcucuuucugaaccuugagcggauccccuggcuggugcgcaaguugcuccagguaucagaaagcacaggcauggcucugaaacgaaguuguuggaugauuacuuuacugauccuccuucuggugucuauguccccuguccagagcgcaccagugggcagaaagccguuguuccuagauucgauagccaaagggaugaagucucugcucaauuccaccucacuggagacaagucuuagcauugaagcucccuggggagccaucaacguucaguccaccuuuaagccuacggugucugcggcaaauaucgcccugagcuggucaagugucgagcacagggguaacaaaauuuugguguccggccggagcgaaucuaucaugaagcucgaggagcguacugggguaucauggaaucugggaguugaagacgcuagugagagcaaaacauuaaccguguccgucauggaucugucucaaauguacucgccaguguucgaauaucuaagcggcgaccgccaggucgaggaauggcccaaggccacuugcacaggugacuguccugagagaugcggguguaccuccucaacgugccuccacaaagaguggccacauaguaggaacuggcggugcaaccccaccugguguuggggcgugggaacaggcugcacuuguugcgggcuggauguuaaggacuuuuucaccgauuacaugcuugugaaguggaaaguagaauauauuaagacagaggcaauagucuguguggaauugacuucucaggagcgacaaugcagccugaucgaggcuggaacccgcuuuaaucucgguccgguuacaauuacccuguccgaaccuagaaacgugcagcagaggcuucccccagagaucgucacucugcacccuaaaaucgaagagggcuucuucgacuugaugcaugugcagaagauucucucagccagcacgguauguaaacugcaaucuugcacacacggggugcccggagauuuucagguuuaccacgucggcaauuuacugcggggugacaaggugaacgggcauuccauacacaagaucgaaccacauuucaauaccaguuggaugagcugggauggcugugaccuagauuauuuuugcaacaugggagacuggcccucuuguacuuacaccggcgugacacagcacaaucgcgcggccuucauuaacaugcucaauaucgagaccgauuauacuaaaacauuucauuuccacuccaagagagucacggcacacggggacaccccucagcuggaccuuaaagcuaggccagccuacggagcuggugagguuacuguguugguggaaguagccgaucuggagcuccauacaaagaaacuggaagucucaggcuuaaagauugcaagucugaccugcagcgggugcuacgccuguucguccggaaucucuugcaaggugcguauacacguuaacgagccggacgaauuuacagugcauguccggagcucagaucccgacgugguugcugcgggcaguucccuuauggcacgaaaaaucgaguucggugccgauucuacuuuuaaggcuuucagcuccaugccuaaagacucauuguguuuuuauauuguggagaaggauuacugcagcaguuguaccgacgaugacacgcaaaaaugcguaaauaccaagcucgaucacccacagucuauccugauugaacacaaagggacaaucauaggcaagcagaacgacacuuguuccaccaagacaagcugcuggcuaaaaucguucaagggauuuuucuauggccugaaaaauaugcucucagggauuuucggaaacgucuuucugggcauccuuuuguuccuggcccccuuuguguuacucauuuucuuuuucuuuuucgguuggagacugcuguuuugucuuaagugcuguaaaaagacuaagggguugcucaaauacaagcaucugaaagauaaggaggaagcaggauauaaaaagaucauagagaggcuaaauggcaagaaagguaagucucagcuguucgacggcgaacgccucgccaaccggaaaaucgcugagcuguuuaguaccaagauucacaucggg

SEQ ID NO: 10652 - RNA, 2916 nt, Artificial Sequence
  derived and/or modified CDS sequence (opt3) from CCHFV(Oman_812956, Artificial)__KY362518.1__Gn-4aa-Gc
agcgaggaauccggcgaggacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaaaucuuucaaguugugugaaaauuccgcuacugguaaaucuugcgagauugacaacaccccuguuaaguguaaacagggguuuugcuuaaagaucacacaggaaggacgaggccaugugaagcugucgcgugauucagagguagugcuagacgcaugugauagcaguugcgaaauaaugaucccaaaaggcaccggggacauucucgucgauuguuccggaggucagcaacacuuccugaaggacaaucuuaucgaucugggcugcccgaacauucccuugcucgggaaaauggccaucuacauauguagaaugucuaaucauccuaagacuacaauggcguuucuguucugguuuagcuucggauaugugauuaccugcauccugugcaaaguuaucuuuuaccucuuaauuguggucggcacgcuggguaagaaguucaaacaguauagggagcuuaagccacagacuuguaccaucugcgagacaacucccgugaacgcuauugacgccgaaaugcacgauuugaauuguuccuacaacauaugcccuuauugugcaucacggcugaccagugacgggcuagcccgccauguaaugcagugcccaaaaagaaaggagaaaaucgaagagacagaacucuaccugaaucuugagaggauucccuggguugugcggaagcuguugcaagucagcgagucuaccggaguggcucucaaacgcuccucauggcugaucguguuacugguccuccuuacgguuagccugaguccugugcagucugcaccaauaggccgaaagccguuguuuuucgacuccauugccaagggcaugaaaaaccuacugaauagcacuucgcucgaaacaucucuguccaucgaggcucccuggggugccaucaacguacagucaaccuuuaagccuacugugaguacagcgaauauugcacuuagcugguccucugucgaacacagaggaaacaaaauccuggugagcgguaggucagagaguauuaugaaguuggaggagcggaccggcauauccugggaucucgggguugaggacgccagcgaaucuaaacuguuaacggugucagucauggaucugagucagauguacagcccaguguucgaguaucuauccggagaccgucaaguagaagaguggcccaaggcuaccuguacaggcgauugcccugaacgcugugguugcacuucuucgaccugucuccacaaggaguggccacauagcagaaacuggaggugcaaucccacauggugcuggggcguugggacuggauguaccugcuguggccuggacgugaaagaucuuuuuacagacuacauguucgucaaguggaaaguggaguauaucaagaccgaagccauugucugcguggaguugacuucccaggaacggcaguguucacugaucgaggcagggacgcgauucaaccucggaccgguuacaaucacccugagugagccucgcaauauucaacagaaacuucccccagaaauagugacucugcacccuagaaucgaggaaggguuuuucgauuugaugcauguacagaagguccucucugcuagcaccgugugcaagcugcaguccuguacacacggcguucccggggacuuacaaguguaccacauuggaaaccugcuaaaaggcgauaaggucaauggucaucucauccacaaaguggagccacauuuuaacaccucauggaugagcugggacgggugcgaccuggauuauuacuguaauaugggcgacuggcccucuugcacuuauacaggaguaacgcagcacaaccaugccgcguucgugaaucuuuugaacauugaaaccgauuacacuaagaauuuucacuuccacuccaaaaggguuacagcccauggcgacaccccucagcuggaucucaaggcacggccaaacuacggggcuggagagaucacaguccugguggagguggccgacauggaauuacacacuaagaaaauagagaucaguggucugaaguuugcuagccuuaccuguacgggcugcuaugccugcagcuccgggauuucauguaaaguccgcauccauguugaugaaccggacgaguugaccgugcacgugaagagugaagaucccgacauuguagcagccagcucgucccucauggcuagaaaacuggaguucggaacagauucuacuuuuaaggcguucagcgcaaugccuaaaaccucacuaugcuuuuacaucgucgagagggaauauuguaagaguugcuccaaggaggacacacagaaaugugugaaugccaagcuggaacguccacaaucuauacucauugagcacaaaggcacuaucauugguaagcagaacgauaccugcacggcuaaagccagcuguuggcuggaauccguuaagucauucuuuuacgggcuuaagaauauguugagcggcaucuucggaaacguguucauaggcaucuuucuguucuuagcacccuuuauucuccugauccuuuucuuuauguucggguggcggauucuguuuugcuucaaauguugccgaagaacaaggggauuguuuaaguaucgccaucucaaagacgacgaggagaccggcuaccggaagaucauagaaagacugaacaauaaaaaggguaagaacaaacuacuggauggggagaggcucgccgaccgcaagauugcugaacuguucaguacuaaaacacacaucgga

SEQ ID NO: 10653 - RNA, 2916 nt, Artificial Sequence
  derived and/or modified CDS sequence (opt3) from CCHFV(UCCR4405, Artificial)__KY484029.1__Gn-4aa-Gc
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgaggucaugauaccgaaaggcacuggggauauccucguggacuguaguggaggucagcaacacuuccugaaggauaaccuuauugaccugggcugcccccauaucccuuugcucgggaaaauggccauuuacaucuguagaauguccaaucacccaaggacaaccauggcguuucuguucugguuuucuuucggauauguuauaacgugcaucuuuugcaaggcucuguucuacagccucauuauuaucggcacuuuagguaaaaagaucaagcaguaucgggaacugaaaccccagaccuguacaauuugcgagacugccccugugaacgcaauagaugccgagaugcaugaccuuaaguguuccuacaauaucugcccauauugugcuucacgcuugaccagugacgggcuggcaagacacgucacacagugccccaaaaggaaggaaaaaguggaggaaaccgagcuauaccucaaccuggaacggauuccuuggaucguacgcaaacuucugcaaguuagcgagucuacgggaguggccuugaagcgauccucauggcucauaguccuguuagugcugcucacugugagccuuaguccaguccagucugcuccgguuggcagaaagccccuguuuuuggauuccacagugaagggcaugaaaaaucuacugaacagcaccucgcucgagacuucucuguccauugaagccccuuggggagcgaucaauguacagucaacauucaagccaaccgugaguacggcaaacaucgcccuuagcugguccucugucgagcacagggggaauaaaauucuggugaccggucggagcgaaucaaucaugaaguuggaggaacguacaggcguuaguugggaccucgggguggaggaugcuuccgagagcaaacuguuaacugucucuauuauggaccugucacagauguacagucccguguuugaauaucuaagcggagaucgccaaguagaggaauggccuaaggccaccuguacaggcgacugcccagagagaugugguugcacuuccucuaccugucuccauaaggaauggccccacucgaggaacuggcggugcaauccgacauggugcuggggcguugggaccggauguacuugcuguggcguggaugucaaagaccuguucacggaucauauguuugugaaguggaaagucgaguacauaaagacagaggcaaucgugugcguugaacuuaccagccaggagcgacaguguuccuugauugaagcugggacucgcuucaaccugggaccugugaccaucacacucucagagcccagaaacauccaacagaaacugccaccugagauuauaacccuucaccccaagaucgaagaggguuucuuugaccugaugcacguacagaaggucuugagugccucuacugugugcaaacuccagagcuguacacauggcauuccaggggaucugcaaaucuaucacauuggaaauuuacugaagggcgacaggguuaacggucaucuaauccacaaaauagaaccccauuucaauacguccuggaugucaugggacgggugcgaucucgacuacuauuguaacaugggcaauuggccuagcugcaccuacacuggagugacacagcacaaccacgcggccuuugucaaucugcuuaacaucgagaccgauuauacaaagacuuuccauuuucacucuaaacgggugaccgcacauggcgacacgccacaguuggaucugaaggcucgcccgaccuacggggccggagaaauuacaguacucguggagguugcugacauggagcugcacacuaagaaagucgaaaucuccgguuuaaaguucgccagucugguguguaccggcugcuacgcaugcagcucugggauuuccuguaaagugagaauccacgucgaugagcccgacgaacuuacaguucaugugaagucaagugauccugacgugguagccgcuagcacuucguugauggcgaggaaacucgaguuuggaaccgauuccauauucaaggcauuuucugccaugccaaaaacgagccugugcuucuauauugucgaacgugaguacuguaagucaugcagugaggacgauacaaagaaauguguggacaccaagcuagaacagccccaauccauccugauugagcacaaaggcacuaucauagguaagcagaaugacacaugcaccgcuaaagccucuuguuggcucgaaagcguuaaguccuuuuucuaugggcugaagaacaugcuuggcucaguguuuggaaauuucuucgucggcaucuugcuguuuuuagcaccuuucgugcuccugguucuguuuuucauguuuggguggaaaauucuuuucugcuuuaaguguugccggcgaacuagaggauuguucaaauacaggcaucucaaggaugacgaggaaaccggcuaucgccggaucauugagagacugaacagcaaaaaggguaagaauaggcuacuggauggggagcgccucgccgaccgaaaaaucgcugaacuguuuaguacaaagacgcacauagga

SEQ ID NO: 10654 - RNA, 2916 nt, Artificial Sequence
  derived and/or modified CDS sequence (opt3) from CCHFV(UCCR4401, Artificial)__KY484035.1__Gn-4aa-Gc
agcgaggaacccuccgacgauugcaucucuagaacccagcuucucaggacagagacugccgaaauucacggcgacaacuacgggggaccuggugauaagauaacgaucuguaauggcucaaccauuguggaccaacggcuugggagugagcugggaugcuauacaaucaaccgcguccguagcuucaaauugugugaaaauuccgcuacuggcaagaacugcgagauugauucuguuccagugaaaugucgacaggguuacugcuuaagaaucacccaggaggggaggggacauguaaagcugucgcggggcucagaagugguccuagacgcaugugauacaagcugcgagauaaugaucccgaaaggcaccggggacauucucguggauuguaguggaggucagcaacacuuucugaaggacaaucuuaucgaucugggcugccccaagauuccuuugcucgggaaaauggccaucuauauaugucgcauguccaaccauccaaagacuacaauggcguuccuguuuugguucucuuuuggauacguuauuaccugcauccugugcaaagcuauuuucuaucucuuaaucaucgugggcacgcuggguaagagacuuaaacaguacagggaauugaagccccagacuuguaccauuugcgagacaacuccugucaaugccauagacgcagagaugcacgaucugaacuguagcuauaauaucugcccauacugugccucccggcuaaccucagacgggcucgcucgccaugugauucagugccccaagcgaaaagaaaagguagaggaaacagagcuguaccuuaaccuggaaagaaucccuuggguugugaggaaauugcuccaagucagugagagcaccggaguggcacugaagcggucuuccugguuaauagugcugcucguccuuuuuacgguuucacugagcccagugcagagugccccgauuggccguaaacccuuguuccuagacucuacugcuaagggcaugaaaaaucugcucaacuccacaagccuggagaccucgcuuucuaucgaagccccuuggggugcgaucaauguacaguccacuuauaagccaacagugucaaccgcaaacauugcccugaguuggagcuccgucgagcaccgcggaaauaagaucuuggugucugguagaagcgaaucaauuaugaaacucgaggaaaggacgggcauaaguugggaucuggggguugaggacgcuuccgagagcaaguuacugaccgugucugucauggaucuaucacagauguacagucccguguuugaauaucucagcggagaccggcaaguagaggaauggccuaaagccacauguacuggcgauugcccagagcgaugugguugcaccuccucuacaugucugcacaaggaauggccccauucgcgcaacuggagaugcaacccgacuuggugcuggggcguugggaccggauguacaugcuguggccuugacgugaaagauuuguucaccgacuacauguuugucaaguggaagguggaguauaucaaaacugaggcaauugucugcguggaacugacgagccaggagaggcaguguucccucaucgaagcugggacacgguucaaucugggaccuguuaccaucacucuuucagagccccgcaacauucaacagaagcugccaccugagauaaucaccuugcaccccagaauugaagagggguuuuucgaucucaugcaugugcagaaaguacugagugccucuacagucugcaaguuacagagcuguacccacggcgugccaggggaccugcaaguuuaccacaucggaaaucuacucaaaggcgauaaggugaacggucaucugauucacaagaucgaaccccauuucaauacuuccuggaugucaugggacgggugcgaccuugauuauuacuguaacaugggcgacuggccuagcugcacauacacgggagucacccagcacaaucaugcgucuuuugugaacuugcugaauauagagacugauuauaccaaaaacuuccacuuucacuccaagaggguaacagcccauggcgacacaccacagcucgaucugaaagcacguccgacuuacggggcuggagaaaucaccguguuaguugaggucgccgacauggagcugcacacgaagaaaauugaaaucaguggucuuaaguucgcuagcuuggccuguaccggcugcuaugcaugcucuagcgggauuucauguaaggugcggauccauguggaugagcccgacgaacucacaguccacguuaaaagugaugacccugaugugguggccgcuagcucgucccugauggcgcgaaagcuagaguuuggaacugacucuaccuucaaagcauuuagcgccaugccaaagacaucacugugcuucuacauaguagaaagagagcacuguaaaaguugcuccgaggaagauacuaagaaaugugucaauaccaagcucgagcagccccaaucuauucugaucgaacauaagggcacgauuaucgguaaacagaacagcacaugcaccgcuaaggccuccuguuggcuugagucagugaaauccuuuuucuauggguugaagaauaugcugaguggcauauuuggaaacguuuucaugggcaucuuuuuauuccucgcaccuuucauucugcuuauccuguuuuucauguuuggguggaggauuuuguucugcuuuaaauguugccgccggacuagaggacucuucaaguacaggcaccugaaggacgacgaagagacaggcuaucgccgaaucauagagaaacuaaauaacaagaaagguaagaacaaacugcucgauggggaacggcuggccgaccguagaauugcugagcuguuuucuaccaagacucauaucgga

SEQ ID NO: 10655 - RNA, 2916 nt, Artificial Sequence
  derived and/or modified CDS sequence (opt3) from CCHFV(UCCR4448, Artificial)__KY484042.1__Gn-4aa-Gc
agcgaggaaaccuccgacgauugcaucucuagaacacagcugcucaggacugagacggccgaaauucacggcgacaacuacgggggacccggugauaagauaaccaucuguaauggcucaacaauuguggaccaacggcuugggagugagcugggaugcuauacuaucaaccgcgucaaaucauucaaguugugugaaaauuccgcuaccggcaaaucuugcgagauugauucgguuccugugaagugucgacaggguuacugcuuacguaucacacaggaggggagaggacauguaaaacugucaaggggcagcgaagugguccuagacgcaugugauaccaguugcgagauaaugaucccaaagggcacuggggacauucucguggauuguuccggaggucagcaacacuuucugaaggacaaccuuaucgaucugggcugcccgaaaauucccuugcucgggaagauggccaucuauauaugucggaugucuaaucauccuaaaacaaccauggcguuccuguuuugguucagcuuuggauacguuauuacgugcauccugugcaaggcuauuuucuaucucuuaaucaucauuggcacucuggguaaacgcuuuaagcaguacagagaacuuaagccacagaccuguacaauaugcgagacuacccccgugaacgccaucgacgcagagaugcacgauuugaauuguuccuauaacauuugcccuuacugugccucaaggcugacaagugacgggcuagcucggcaugucacccagugcccaaaacgcaaggaaaaaguggaggaaacggagcucuaccugaaucuugaacgaauccccuggguaguuagaaagcuguugcaagugagcgagucuacuggagucgcacucaaaagguccucauggcugauaguguuacuggugcuguucacaauuagccuuaguccuguccagucugccccaaucucccggaagccgcuguuuuuggacagcaucguuaaaggcaugaagaaccuacucaauucgaccucucucgagacuucccugucaauugaagcucccuggggcgccaucaacgugcagaguacauauaagccuaccguaagcacggcgaauauugcacuuuccuggucuagcguggagcaccgugggaacaaaauacuggucucaggacgcagugaauccaucaugaaguuggaggagaaaaccgguauuagcugggaucucggcguggaagacgccucugagucaaagcuguuaacaguuagugugauggaucugagccagauguacuccccagucuucgaauaucuaucuggggacagacaaguggaggaauggcccaaagcuacuuguaccggagauugcccugagagguguggcugcacaucgagcacuugucuccacaaggaauggccacauucccggaauuggcgaugcaaccccaccuggugcugggguguagggacaggcuguaccugcuguggacuggacguuaaggaucuuuuuacugacuacauguucgugaaauggaaggucgaguauaucaaaacggaggccaucgugugcgucgaauugacaucacaggagcgccaguguagucugauugaagcaggcaccagauuuaaccucgggccggugacuauaacccugucugagccuaggaauauccaacagaaacuucccccagagauuaucacacugcacccucggauugaagagggauucuucgauuugaugcauguucagaaagugcucagcgcuuccaccguaugcaagcugcagucauguacucacgguguccccggcgacuuacaaguguaccacaucgggaaccugcuaaagggagauaaaguuaauggccaucucauacacaagaucgaaccacauuuuaacacaagcuggaugucuugggacgguugcgaccuggauuauuacuguaauaugggggacuggcccuccugcacguacaccggcgugacucagcacaaccaugccaguuucgucaaucuuuugaacauugagacagauuauaccaaaaauuuucacuuccacagcaagcgcgugacagcgcauggagacacuccucagcuggaucucaaagccagaccaaccuacggcgcaggggaaaucacgguacugguggagguugcugacauggaguuacacaccaagaagauugaaaucucuggacugaaauuugccucccuuacauguacugguugcuaugcuugcucaaguggcauaagcuguaaggucaggauucauguggaugagccggacgaauugaccgugcacgucaaaucggaugaccccgauguuguggccgcauccucuagccucauggcccguaagcuggaguucgggacagacucaacuuuuaaggcuuucagugcgaugccuaagaccucccuaugcuuuuacaucguggaacgggagcacuguaaaucuugcagcgaggaagauacgaagaaguguguaaacacaaaacuggagcagccacaauccauucucaucgaacauaagggaaccauaaucggcaaacagaauagcacuugcacagcaaaggccagcuguuggcuggagagugucaaaucuuucuuuuauggucuuaagaacauguuguccgggauuuucggcaauguguuuaucggaauuuuccuguucuuagcucccuuuauccuccugauacuuuucuuuauguucggcuggaagauucuguuuugcuucaaauguugccgaagaaccaggggguuguuuaaguaccgccaccucaaagacgacgaagagacuggauaucggagaaucaucgagaggcugaacaauaagaaaggcaagaacaagcuacuggauggugaaauucucgccgaccgccgaaucgcagagcuguucagcaccaaaacacauauuggg

SEQ ID NO: 10656 - RNA, 2916 nt, Artificial Sequence
  derived and/or modified CDS sequence (opt3) from CCHFV(SPU 45/88, Artificial)__KJ682809.1__Gn-4aa-Gc
agcgaggaauccucugacgauugccugucaagaacccagcuccuuaggacagagaacacugaaauccacagugacaauuacggcgggcccggagauaagauuacgauauguaacgguagcaccaucguggaccaacggcugggcuccgaguuggggugcuauacaauuaaucgcgucaaaucuuucaaguuaugugaaaacucggccacuggaaaaucaugcgagaucgauagcaccccuguucgaugucgucagggcuuuugccugaagauuacacaggaggguagagggcaugugaaacuaaguaggggauccgaaguagugcucgacgcuugugauucuagcugcgagaucaugauaccaaagggcaccggcgacauccuggucgauuguuccgggggacagcaacacuuccuuaaggacaaucugguggauuuggguugcccgaacauuccccuccugggcaaaauggcaaucuacauuugucggaugucaaaucauccuaagacuacaaugggguuucuguucugguuuaguuucggauauguuauuaccugcauacucugcaaagugaucuuuuacuuacugaucgucgugggcacgcuugguaagaaauucaagcaguaucgcgaauugaagccacagacuuguaccauuugcgagacaacucccguaaacgccaucgacgcggagaugcacgaucugaauuguagcuacaacaucugcccuuauugugcuucuagacuaaccuccgacgggcucgccaggcauguuaugcagugcccaaaacggaaggagaaaauugaagaaacagagcuguaccuuaaucuggaacgcauacccuggaucgugcgaaaguugcuccaagucucagagagcaccggaguggcacugaaaagaaguucuugguuagugguccugcucguucuucugacgguguccuugagcccuguacagucggccccaauuggcaggaagccgcuauuucuggacucuaucgugaaaggcaagaagaaccuccuuaauuccacuucacuggagacaagucugagcauagaagcucccuggggagcaauuaacguccaguccaccuucaaaccuacugugucugccgcuaauaucgccuugagcuggucaaguguugagcaccgggggaacaagauccucguguccggucguagcgaaucuauuaugaaacuggaggaacgcacaggcaucucaugggauuuaggggucgaggacgcgagugagagcaagcugcuaaccguguccguaauggaucucucucagauguacucgccaguuuuugaauaucugagcggagacagacaaguggaggaauggcccaaagcaacguguaccggcgauugcccugagaggugugguugcacauccucaacuugucuucacaaggaauggccacauagucggaacuggcgaugcaaucccaccuggugcuggggcgucgggacaggauguacuugcuguggcuuggacgugaaggaucuguucaccgacuacauguuugucaaauggaagguggauuauauuaaaacagaggccauaguuugcguggagcucaccucucaggaacgccaguguagccugaucgaggcugggacuagauucaaccuuggaccgguaacgauuacacuguccgaaccuaggaauauccaacagaaguugcccccagagaucgucacccuccacccucggauugaggaagguuucuuugaccugaugcaugugcagaacguuuuaucagccagcacugugugcaaacugcagucuuguacccacggcguccccggggaucuacaaauauaccacaucggaaaucuccugaagggcgacaaggugaacggucaucuuauucacaaaaucgagccacauuucaauacauccuggaugaguugggacgggugcgauuuggacuauuacuguaacaugggcgauuggcccagcugcucuuauaccggaguaacucagcacaaucaugcagcuuuugugaacaugcugaauauugaaacagacuacacgaagaacuuccacuuucacuccaaacgcguuaccgcccauggcgauacuccucagcucgaccugaaggcgagaccaacauacggggccggagagaucaccgucuuaguggaaguggcagauauggagcugcacaccaaaaagauagagaucucaggucuuaaguucgcuaguuugacuuguaccggcugcuaugccugcagcucggggauuuccuguaaagucaggauccauguugacgaaccggaugagcucacggugcacgugaagucugaagaccccgauauuguagcugccagcucaagucugauggcacguaaacuagaguuuggaaccgacuccacauucaaggccuuuucugcuaugccuaaaacuagccugugcuucuacaucgucgaacgggaguauuguaaguccugcucaaaagaggauacccagaagugugugaauacaaagcucgaacaaccacagagcauacugauugagcacaaaggcacuaucauugguaagcagaacgacacaugcacggcgaaagcaaguuguuggcuugaaucuguuaaguccuuuuucuacggguugaaaaauaugcugagcggcaucuuuggaaacguguucauaggcaucuuacucuuccuggcccccuuuauuaugcuuauccuguucuuuauguucggguggcgaauuuuguuuugcuucaaguguugcagaaggacacgcggacucuuuaaguaucggcaucugaaagacgaugaggaaaucggcuacagaaagauaauugagaggcuaaacaauaaaaaggguaaaaacaagcugcucgacggggagcgccuggcugaucgaaagaucgccgaacuuuucucgaccaaaacucacaucgga

SEQ ID NO: 10657 - RNA, 2916 nt, Artificial Sequence
  derived and/or modified CDS sequence (opt3) from CCHFV(3010, Artificial)__DQ019222.1__Gn-4aa-Gc
gccgagggcgugagcaacgacugcgucuccagaacccagcugaucaagacagaaguugcugagauucacgaagauucuuacgggggacccggugagaaaauaacuaucuguaauggcucaacgauuguggaccaaaggcucgggagugaacuuggaugcuauaccaucaaccggguaaagacauacaaacugugugagaauagcgcaacugagaagggcugcgaaauugauuccgugccugucaaauguaagcaggguuucugcuugaaggugacccaggaggggcgcggacauguuaaauuaucucgaggcacagaaaucgugcuggacgucugugauaccucgugcgagcuaaugauaccaaagggcacuggggacauccucguggauuguucaggaggucagcaacacuuucugcaggacaaccuuauugaucugggcugcccgaauguacccuugcucgggaaaauggccaucuauauuugucguaugagcaaccauccuaagacaaccauggcguuccuguuuugguucaguuuuggauacguuaucacgugcauagugugcaaaguccuguucuaucucuuaauugugaucggcacucuguccaagaagcucaaacaguacagagaguugaagccacagaccuguauugugugcgaaucuacacccgucaaugcuaucgacgccgagaugcacgaacugaacuguaauuauaacaucugcccuuacugugcaagcaggcuaacuuccgauggucucguucggcaugugaaucaaugcccaaaacgcaaggagaaaguagaagagaccgagcuguaccuuaaccuggaaaggauucccugguuggugagacggcuccugcaggucucagagaguacagggauggccuuaaagcgcagcuguuggaugaccacgcugcucauacuucuggugguuucuuuguccccugugcagucagcuccagucggacgaagaccgcuauuucuggacagcaucgugaaaggcaugaagaaucuccugaacaguacuucucuugaaacaucccugagcauugaggcacccuggggcgccaucaauguacagucgaccuauaagccuacuguuucuacagcuaacauagccuuguccuggucaaguguggaacacagggggaacaaaguccucgugagcggacgguccgagucuauuaugaagcuggaggaacguaccgguaucagcugggauuuaggcgucgaggacgcgucagaaaguaaacugcuaacgguguccguuauggaccucagccaaauguacucuccaguguucgaguaucugucaggggaucgccagguagaagaguggcccaaggcaaccugcacaggagacuguccugagagaugcggcuguacuagcaguaccugccuucacaaagaauggccacauuccaggaauuggcggugcaaccccacaugguguuggggugucgggacuggcugcaccuguugcggauuggaugugaaggaccuguuuacagauuacauguucguuaaguggaaaguggaguauaucaagaccgaagccauugucuguguggagcucacuucucaggagcgacaaugcucgcugaucgaagcuggcacgcgcuuuaaucuugggagcguaacaauuacccuguccgagccgagaaacauacagcagaaauugccucccgaaaucauuacucuccacccaaagaucgaggaaggauucuuugaccugaugcaugugcagaaaguuuuaucagccaguaccgucuguaagcugcaaucuugcacacacggugugccuggcgaucuacagguguaccacaucgggaaucuccugaagggagacagggucaacggccaucuuauucacaaaauagagcagcauuucaauaccagcuggauguccugggaugguugugacuuggauuauuacugcaacaugggggacuggcccucauguacuuacacaggcguuacgcagcacaaucaugcuagcuucgugaaccugcucaauaucgagaccgacuauacuaagacauuucacuuccacucuaaacgggugaccgcacauggagauacaccacaacuggacuuaaaggcccgccccacuuacggcgcgggggaaguaaccguccugguggagguugccgauauggaacuucacacgaaaaagauugagaucuccggauugaaguuugcaggucuuaccugcacaggcugcuaugcuuguaguagcgggauuucuugcaaagugagaauccaugucgacgaaccugaugagcugacugugcacguuaaguccgacgauccagacgugguagccgcuucaaguagccuaauggccaggaaacuggaguucggaaccgauucgacauuuaaggcauucuccgccaugccgaaaacuucucucuguuuuuacauagucgaacgugaguauugcaagagcuguucaaaagaagacacccagaagugcgugaacacgaagcuggagcagccccagaguauccuuauugaacacaaaggcacaaucauugguaagcaaaauaacaccuguacugcuaaagcguccugcugguuggagucugucaagagcuucuuuuacgggcugaaaaauauguuaggcggaaucuucggcaacguguuuauagggauuuucacauuucucaccccuuucauccugcuuauucuguucuuuauguucggauggcggaucuuguuuuguuucaagugcugucgaagaacuaggggccucuuuaaguaucgccaucugaaagaugacgaggaaaccgguuaccggaagauaaucgagagacuaaacaauaaaaaggggaaaaacaggcugcucgauggagaacgccuggcagaccgaaagauugccgagcuuuucuccacaaagacgcacaucggc

SEQ ID NO: 10658 - RNA, 972 nt, Artificial Sequence
  derived and/or modified CDS sequence (opt3) from CCHFV(10200)__U39455.2__Gn
agcgaggaacccuccgacgauugcgugucuagaacccagcugcucaggacagagacugccgaaauccacggcgacaacuacgggggaccuggugauaagauuacgauauguaauggcucaaccaucgucgaccaacggcuugggagugagcugggaugcuauacaauuaaccgcguucguagcuucaaauugugugaaaauuccgcuacuggcaagaacugcgagaucgauucugugccaguaaaaugucgacaggguuacugcuuaagaauuacccaggaggggaggggacaugugaagcugucgcggggcucagaagucgugcuagacgcaugugauacaagcugcgagaucaugauaccgaaaggcaccggggacauccucguugauuguaguggaggucagcaacacuuucugaaggacaaucuuauugaucugggcugccccaagaucccuuugcucgggaaaauggccauuuauaucugucgcauguccaaccauccaaagacuacaauggcguuccuguuuugguucucuuuuggauacgugauaaccugcauucugugcaaagcuaucuucuaucucuuaauuaucgucggcacgcuggguagaaggcuuaagcaguaccgggaauugaaaccccagacuuguaccaucugcgagacaacuccugugaaugccauugacgcagagaugcacgaucugaacuguagcuauaauauaugcccauacugugccucccgccuaaccucagacgggcucgcucgacauguaauccagugccccaagagaaaggaaaaaguugaggaaacagagcuguaccuuaaccuggaaaggauuccuugggugguccggaaguugcuccaagugagugagagcaccggaguggcacugaaacguucuuccugguuaaucguccugcucguucuuuuuacggugucacugagcccaguacagagugccccgauaggc

SEQ ID NO: 10659 - RNA, 972 nt, Artificial Sequence
  derived and/or modified CDS sequence (opt3) from CCHFV(IbAr10200)__AF467768.2__Gn
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcguccguagcuucaaauugugugaaaauuccgcuacuggcaagaacugcgagauugauucuguuccagugaaaugucgacaggguuacugcuuaagaaucacccaggaggggaggggacauguaaagcugucgcggggcucagaagugguccuagacgcaugugauacaagcugcgagauaaugaucccgaaaggcaccggggacauucucguggauuguaguggaggucagcaacacuuucugaaggacaaucuuaucgaucugggcugccccaagauuccuuugcucgggaaaauggccaucuauauaugucgcauguccaaccauccaaagacuacaauggcguuccuguuuugguucucuuuuggauacguuauuaccugcauccugugcaaagcuauuuucuaucucuuaaucaucgugggcacgcuggguaagagacuuaaacaguacagggaauugaagccccagacuuguaccauuugcgagacaacuccugucaaugccauagacgcagagaugcacgaucugaacuguagcuauaauaucugcccauacugugccucccggcuaaccucagacgggcucgcucgccaugugauucagugccccaagcgaaaagaaaagguagaggaaacagagcuguaccuuaaccuggaaagaaucccuuggguugugaggaaauugcuccaagucagugagagcaccggaguggcacugaagcggucuuccugguuaauagugcugcucguccuuuuuacgguuucacugagcccagugcagagugccccgauuggc

SEQ ID NO: 10660 - RNA, 972 nt, Artificial Sequence
  derived and/or modified CDS sequence (opt3) from CCHFV(Turkey-Kelkit06)__GQ337054.1__Gn
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguuguguaaaaauagcgcuacuggcaagaccugcgaaguugacuccacaccagugaaaugucgacaggguuuuugcuuaaagauuacccaggaggggcguggacauguaaagcugucuagaggcucggaggugguccuagaugcaugugacucaagcugcgaagugaugaucccgaaaggcacuggggauauacucguugacuguaguggaggucagcaacacuuccugaaggauaaccuuaucgaccugggcugcccccauauuccuuugcucgggaggauggccaucuacauuugucggauguccaaucacccacgcacaaccauggcguuucuguucugguuuucuuucggauaugugaucacgugcauauuuugcaaagcucuguucuacagccucauuaucauuggcacuuuagguaagaaaaucaagcaguauagagagcugaagccccagaccuguacaaucugcgaaacugccccugucaacgcaauugaugccgagaugcaugaccuuaauuguuccuacaacauaugcccauauugugcuucaagguugaccagugacgggcuggcacggcacgugacacagugccccaaacgcaaggagaaaguagaagagaccgaacuauaccucaaucuggagcgaaucccuuggauuguuagaaaacuucugcaagugagcgaaucuacgggagucgccuugaagagguccucauggcucaucgugcuguuagugcugcucacugucagccuuaguccaguucagucugcuccggugggc

SEQ ID NO: 10661 - RNA, 972 nt, Artificial Sequence
  derived and/or modified CDS sequence (opt3) from CCHFV(SR3)__AJ538199.1__Gn
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugcguagcuucaaauugugugaaaauuccgcuacugguaagucuugcgagauugauucgaucccuguaaaauguaagcagggguacugcuuaaaaauuacccaggagggacgaggccaugugaagcugucaagaggcagcgaagucgugcuagacguuugugauaguuccugcgaggugaugaucccaaaggggacaggagacauacucgucgauuguucugguggccagcaacacuuucugaaagacaaccuuguggaucuggggugcccgaagauccccuugcucggaaaaauggcaauuuauaucuguaggaugagcaaucauccuaagaccacuauggccuuccuguuuugguucuccuuuggcuacguaauuacaugcauccugugcaaagcgauauucuuucucuuaauuaucuucgguacccuggggaagcgguuuaagcaguaucgcgaacuuaaaccacagacguguacuauuugcgagaccacacccguuaacgcuaucgacgccgagaugcacgauuugaauuguucauacaacaucugcccuuauugugcaaguagacugacuagcgacggacuagccaggcaugugacccagugcccacggcgcaaggaaaaagucgaggaaacagagcucuaccugaaucuugaacgaauacccuggguggugagaaagcuguugcaagucucugaguccaccggcacgguucucaaaaggucaagcuggcugauuguguuacugguacucuucacugugagucuuucuccuguccaguccgcuccaaucggc

SEQ ID NO: 10662 - RNA, 972 nt, Artificial Sequence
  derived and/or modified CDS sequence (opt3) from CCHFV(UCCR4413)__KY484038.1__Gn
agcgaguccucugccucaggcugcaucaguagaacccagaugauuaagagcgaaacagcugagauacacgacgauaucuacgggggacccggugaaaaacugacuauuuguaacggcacgaccguggucgaccaaaggcucggguccgagcuuggaugcuauacaaucaaucggauuaagacuuacaaacugugugaaaacucuguuaaggagaaaaccugcgagaucgauucggugccuguaaagugucgccagggcuugugcuuaaagauaacacaggaaggucgagggcaugugaaacugucacguggaagcgagaucguccuagacauuugugauaguuccugcgaacucaugaucccaaagggcaccggcgacauucugguggauuguucugggggacagcaacacuuccuucaggacaaucugguugauuuggguugcccgaacaucccccuccugggcaaaguggcaauauauauuuguagaaugagcaaucauccuaagacuacaauggccuuucuguucugguuuuccuucggguacgucauuaccugcauccucugcaaaaucuuauuuuaucugcuuaucauuacgggaacuuugggcaagaagcugaaacaguacagggagcuaaagccacagaccuguacaauaugcgagucaacucccgugaacgcgaucgacgcugaaaugcacgaucucaauuguaguuauaacauuugcccuuacugugccagccggcugaccucugacggucuuauccgccauguaaaucugugcccaaaaagaaaggagaaaguugaagagacagaauuguaccucaaccuggagaggauacccugguucgugcggaaguuacugcaagucuccgagucaaccgggguggcacucaaacgcagcaguuggcuucugauuuuggugauccuacugacggucucuauguccccuguucagagcgccccaaucaau

SEQ ID NO: 10663 - RNA, 972 nt, Artificial Sequence
  derived and/or modified CDS sequence (opt3) from CCHFV(66019)__AB069669.1__Gn
agcgaggaauccggcgacgauugcaucucuagaacccagcugcucaggacagagacugccgaagugcacggggacaacuacggaggucccggcgauaagauuacgauauguaaugggucaaccaucgucgaccaacggcuuggaagugagcugggcugcuauacaauuaaccgcguuaagagcuucaaauugugugaaaauuccgguacugggaaaucuugcaagaucgauaacaccccugugaaaugucgacagggauuuugcuuaaagauuacacaggagggccguggccauguaaagcugucgagagggucagaggugguccuagacgcuugugauagcaguugcgaaaucaugauaccaaaaggaaccggugacauccucguggauuguuccggcgggcagcaacacuuccugaaggacaaucuuguugaucugggaugcccgaacauucccuugcucggcaaaauggcaaucuacauuuguaggaugucuaaucauccuaagacuacaauggccuuucuguucugguuuagcuucgguuaugugauaaccugcaucuuuugcaaaauuaucuucuaccugcucauugucguggggacguuaggaaagaaguuuaaacaguaucgggagcugaagccacagacuuguaccaucugcgaaacaacucccaccaacgcgaucgacgcugagaugcacgaucuuaaauguuccuacaauauuugcccuuauugugccucacgcuugacaagugacggccuggcaagacauguaacccagugcccaaagaggaaagagaagguugaagagacggaacuauaccucaaccuggagcggauacccuggaucgugcgcaaacuucugcaagucagcgaaucuacuggcguggccuugaagcgauccucauggcucauugugcuguuaguccugcucacaguuagccuuaguccugugcagucugcuccaaucggg

SEQ ID NO: 10664 - RNA, 972 nt, Artificial Sequence
  derived and/or modified CDS sequence (opt3) from CCHFV(7001)__AB069670.1__Gn
gccgagggcgggagcuccgacugcaucucuagaacccagcuggugaagacagaagucgcugagauucacgaagauucauacggaggucccggcgagaaaauaacuaucuguaacgggaguacgauuguugaccaaaggcucggaagcgaacuuggcugcuauaccaucaaucgggugcgcuccuacaagcugugugagaacucugcaucggguaaaucaugcgagauugauagcaucccuguaaaguguaaacagggguucugcuugaagauaacacaggaaggacgaggccaugugaaguuaagucguggcacugagaucguccuggacgugugugauuccucuugcgaacuaaugauuccaaaagggaccggagacauccucguugauuguagcgguggccagcaacacuuucugcagaauaaccuuauugaccuggggugcccgaaugugcccuugcucggaaagauggccaucuaugucuguagaauguccaaccauccuaaaacaaccauggcguuccuguuuugguucucauuuggcuacgugauaacuugcauugcuugcaggguacuguucuaucucuuaaucgccauugguacaguugggaagaaacugaagcaguaccgggagcuuaagccacagaccuguaucgugugcgagaguguccccgugaaugcaaucgaugccgaaaugcacgaguugaacuguagcuauaauauuugcccuuacugugcuucucgccuguccacggacggacuaauaagacaugugacucaaugcccaaaaaggcgggaaaaggucgaggaaaccgagcucuuucugaaccuugagcgcauccccuggcugguucgaaaauugcuccaggugucagaaagcacaggcauggcacugaagagaaguuguuggaugauuacuuuacugauccuccuucugguaucuauauccccugugcagagcgccccagucggc

SEQ ID NO: 10665 - RNA, 972 nt, Artificial Sequence
  derived and/or modified CDS sequence (opt3) from CCHFV(75024)__AB069671.1__Gn
agcgaggaauccggcgacgauugcaucucuagaacccagcugcucaggacagagacugccgaaauucacggggacaacuacggaggucccggcgauaagauaacgaucuguaaugggucaaccauuguggaccaacggcuuggaagugagaugggcugcuauacaaucaaccgcgucaagagcuucaagcugugugaaaauuccgcuacugguaaaucuugcgagauugauucgaucccuguuaagugucgacagggguacugcuugaaaauaacccaggagggacguggccaugugaaguuaucaagaggcagcgaaguagugcuggacgcaugugauaguuccugcgaggucaugaucccaaaggggacaggagacauucuaguggauuguucugguggccagcaacacuuucucaaagacaaccugaucgaucuugggugcccgagcauuccccuguugggaaagauggccaucuauauauguaggauguccaaucauccuaaaaccacuauggcguuccucuuuugguucucauuuggcuacguuauuacaugcauccugugcaaggcuauuuucuaucugcucaucaucguggguaccuuagggaaacgguuuaagcaguaccgcgaacugaagccacagacguguacuauuugcgagaccacacccgccaacgcaauagacgccgagaugcacgaucuuaauuguaguuauaacaucugcccuuacugugcuagcagauugacuucugacggacuggcaaggcaugucacccagugcccaaaacggaaggaaaaaguggaggaaacagagcuauaccucaaucuggaacgcauucccuggguaguucgaaaacuucugcaaguguccgagucaaccggcgucgccuugaaaagaagcaguuggcucaucgugcuguuagugcuguucgcuauaucucucuccccuguccagagcgccccaauuggc

SEQ ID NO: 10666 - RNA, 972 nt, Artificial Sequence
  derived and/or modified CDS sequence (opt3) from CCHFV(7803)__AB069672.1__Gn
agcgaggaauccggcgacgauugcaucucuagaacccagcugcucaggacagagacugccgaaauucacggggacaacuacggaggucccggcgauaagauaacgaucuguaaugggucaaccauuguggaccaacggcuuggaagugagaugggcugcuauacaaucaaccgcgucaagagcuucaagcugugugaaaauuccgcuacugguaaaucuugcgagauugauucgaucccuguuaagugucgacagggguacugcuugaaaauaacccaggagggacguggccaugugaaguuaucaagaggcagcgaaguaauccuggacgcaugugauaguuccugcgaggugaugauuccaaaggggacaggagacauccuagucgauuguucugguggccagcaacacuuucucaaagacaaccugauugaucuugggugcccgagcaucccccuguugggaaagauggccauauauauuuguaggauguccaaucauccuaaaaccacuauggcguuccucuuuugguucucauuuggcuacgugaucacaugcauucugugcaaggcuaucuucuaucugcucaucauuguugguaccuuagggaaacgguuuaagcaguaccgcgaacugaagccacagacguguacuauaugcgagaccacacccgccaacgcaaucgacgccgagaugcacgaucuuaauuguaguuauaacauuugcccuuacugugcuagcagauugacuucugacggacuggcaaggcaugugacccagugcccaaaacggaaggaaaaagucgaggaaacagagcuauaccucaaucuggaacgcauccccugggugguacgaaaacuucugcaaguuuccgagucaaccggcguggccuugaaaagaagcaguuggcucauaguccuguuagugcuguucgcuauuucucucuccccugugcagagcgccccaaucucg

SEQ ID NO: 10667 - RNA, 972 nt, Artificial Sequence
  derived and/or modified CDS sequence (opt3) from CCHFV(79121)__AB069673.1__Gn
gccgagggcgggagcuccgacugcaucucuagaacccagcuggugaagacagaagucgcugagauucacgaagauucauacggaggucccggcgagaaaauaacuaucuguaacgggaguacgauuguugaccaaggacucggcagcgaacuugguugcuauaccaucaauagggugcgguccuacaagcugugugagaacucugcaucggggaaaucaugcgagauugauagcaucccuguaaaguguaaacagggauucugcuugaagauaacacaggaaggccgcggccaugugaaguuaagucgagggacugagaucguccuggacgugugugauuccucuugcgaacuaaugauuccaaaaggaaccggugacauccucguugauuguagcggcgggcagcaacacuuucugcagaauaaccuuauugaccugggaugcccgaaugugcccuugcucggcaagauggccaucuaugucugucguauguccaaccauccuaaaacaaccauggcguuccuguuuugguucucauuugguuacgugauaacuugcauugcuugcagaguacuguucuaucucuuaaucgccauugggacaguuggaaagaaacugaagcaguacagggagcuuaagccacagaccuguaucgugugcgagaguguccccgugaaugcaaucgaugccgaaaugcacgaguugaacuguagcuauaauauuugcccuuacugugcuucucggcuguccacggacggccuaauacgccaugugacucaaugcccaaaaagaagggaaaaggucgaggaaaccgagcucuuucugaaccuugagcggauccccuggcugguucgcaaauugcuccaggugucagaaagcacaggcauggcacugaagcgaaguuguuggaugauuacuuuacugauccuccuucugguaucuauauccccugugcagagcgccccagucggg

SEQ ID NO: 10668 - RNA, 972 nt, Artificial Sequence
  derived and/or modified CDS sequence (opt3) from CCHFV(8402)__AB069674.1__Gn
agcgaggaauccggcgacgauugcaucucuagaacccagcugcucaggacagagacugccgaaauucacaacgacaauuacgggggacccggugauaagauaacgaucuguaacggcucaaccguggucgaccaacggcuugggagugagcugggaugcuauacaauuaaucgcguuaagagcuucaaauugugugaaaacuccgcuacuggcaaaucuugcgagaucgauucgaccccugugaagugucgacaggguuuuugcuuaaaaauuacacaggaggggcguggacauguaaagcugucaagaggcagcgaagugguccuagacgcaugugauaguuccugcgagaucaugauaccaaagggcaccggggacauccucguggauuguucuggaggucagcaacacuuccugaaagacaaucuuauugaucugggcugcccgaacauccccuugcucgggaagauggccauuuacaucuguaggaugagcaaucauccuaaaacuacaauggcguuucuguucugguuuuccuucggauauguugugaccugcauacugugcaaggucaucuuuuaccucuuaauugugguaggcacgcuggguaaaaaguucaagcaguaucgggaacuuaaaccacagacuuguaccauuugcgagacaacucccguuaacgcuaucgacgccgagaugcacgauuugaauuguucauacaacaucugcccuuauugugcaagucgccugaccagcgacgggcuagccagacaugugaugcagugcccaaagaggaaagaaaagauugaggaaacagagcucuaccugaaucuugaacggauacccugggucgugcgcaaacuguugcaagugucugaguccaccggagucgcucucaagcgaucaagcuggcugguuguguuacugguacuccuuacggugagucugucuccuguccaguccgcaccaaucggc

SEQ ID NO: 10669 - RNA, 972 nt, Artificial Sequence
  derived and/or modified CDS sequence (opt3) from CCHFV(88166)__AB069675.1__Gn
agcgaggaauccggcgacgauugcaucucuagaacccagcugcucaggacagagacugccgaaauucacucagacaacuacgggggacccggugauaagauaacgaucuguaauggcaguaccguggucgaccaacggcuugggagcgagcugggaugcuauacaauuaaccgcguuaaauccuucaaguugugugaaaauucugcuacuggcaaaucgugcgagaucgauucaaccccugugaagugucgacaggguuuuugcuuaaaaauuacacaggaggggcguggacauguaaagcugagcagaggcagugaagugguccuagacgcaugugauuccucuugcgagaucaugauaccaaagggcaccggggacauccucguggauuguagcggaggucagcaacacuuccugaaagacaaccuuauugaucugggcugcccgaauauccccuugcucgggaagauggccauuuacaucuguaggauguccaaccauccuaaaacuacaaugggauuucuguucugguuuucauucggcuauguugugaccugcauacugugcaaggucaucuuuuaccucuuaauugugguagguacgcuggggaaaaaguucaagcaguaucgggaacuuaaaccacagacuuguaccauuugcgagacaacucccguuaaugcgaucgacgcugagaugcacgauuugaacuguaguuacaauaucugcccuuauugugccagccgccugaccucugacggacuagcaagacaugugaugcagugcccaaagaggaaagaaaagauugaggaaacagagcucuaccugaaccuugaacggauacccugggucgugcgcaaacuguugcaaguguccgagucaaccggcgucgcccucaagcgaagcaguuggcugguuguguuacugguacuccuuacggugucucuguccccuguccagagcgcuccaaucggc

SEQ ID NO: 10670 - RNA, 972 nt, Artificial Sequence
  derived and/or modified CDS sequence (opt3) from CCHFV(BA88166)__AF338470.1__Gn
agcgaggaauccggcgacgauugcaucucuagaacccagcugcucaggacagagacugccgaaauucacucagacaacuacgggggacccggugauaagauaacgaucuguaauggcaguaccguggucgaccaacggcuugggagcgagcugggaugcuauacaauuaaccgcguuaaauccuucaaguugugugaaaauucugcuacuggcaaaucgugcgagaucgauucaaccccugugaagugucgacaggguuuuugcuuaaaaauuacacaggaggggcguggacauguaaagcugagcagaggcagugaagugguccuagacgcaugugauuccucuugcgagaucaugauaccaaagggcaccggggacauccucguggauuguagcggaggucagcaacacuuccugaaagacaaccuuauugaucugggcugcccgaauauccccuugcucgggaagauggccauuuacaucuguaggauguccaaccauccuaaaacuacaaugggauuucuguucugguuuucauucggcuauguugugaccugcauacugugcaaggguaucuuuuaccucuuaauugucguggggacgcugggcaaaaaguucaagcaguaucgggaacuuaaaccacagacuuguaccauuugcgagacaacucccguaaaugcgaucgacgcugagaugcacgauuugaacuguaguuacaauaucugcccuuauugugccagccgccugaccucugacggacuagcaagacauguuaugcagugcccaaagaggaaagaaaagauugaggaaacagagcucuaccugaaccuugaacggauacccugggugguccgcaaacuguugcaaguguccgagucaaccggcguggcccucaagcgaagcaguuggcuggucguuuuacuggugcuccuuacgguaucucuguccccugugcagagcgcuccaaucggg

SEQ ID NO: 10671 - RNA, 972 nt, Artificial Sequence
  derived and/or modified CDS sequence (opt3) from CCHFV(BA66019)__AF350448.1__Gn
agcgaggaauccggcgacgauugcaucucuagaacccagcugcucaggacagagacugccgaagugcacggggacaacuacggaggucccggcgauaagauuacgauauguaaugggucaaccaucgucgaccaacggcuuggaagugagcugggcugcuauacaauuaaccgcguuaagagcuucaaguugugugaaaauuccgguacugggaaaucuugcaagaucgauaaacauccugugaagugucgacagggauuuugcuuaaagauuacccaggagggccguggccacguaaaacugucgagagggucagaggugguccuagacgcuugugauagcaguugcgaaaucaugauaccaaagggaacaggugacauccucguggauuguuccggcgggcagcaacauuuccugaaagacaaccuuguugaucugggaugcccgaauauucccuugcucggcaagauggcaaucuacauuuguaggaugucuaaccacccuaaaaccacuauggccuuucuguucugguuuagcuucgguuaugugaucacaugcauauuuugcaagauuaucuucuaccugcucauugucguggggaccuuaggaaagaaauuuaagcaguaucgggagcugaaaccacagacguguacuaucugcgaaaccacacccacuaaugcgaucgacgcugagaugcaugaucuuaaguguuccuacaacauuugcccuuauugugccucacgcuugaccagugacggccuggcaagacacguaacacagugcccaaaaaggaaggagaaaguugaagagaccgaacuauaccucaaucuggagcggauacccuggaucgugcgcaaacuucugcaagucagcgaaucuacgggcguggccuugaagcgauccucauggcucauugugcuguuaguccugcucacuguuagccuuaguccugugcagucugcuccaaucggg

SEQ ID NO: 10672 - RNA, 972 nt, Artificial Sequence
  derived and/or modified CDS sequence (opt3) from CCHFV(BA8402)__AF350449.1__Gn
agcgaggaauccggcgacgauugcaucucuagaacccagcugcucaggacagagacugccgaaauucacaacgacaauuacgggggacccggugauaagauaacgaucuguaacggcucaaccguggucgaccaacggcuugggagugagcugggaugcuauacaauuaaucgcguuaacagcuucaauuugugugaaaacacugcuaccggcaaauccugcgagaucgauucuacaccugugaagugucgacaggguuuuugcuuaaaaauuacccaggaggggcguggacauguaaagcugucgagaggcucagaagugguccuagacgcaugugagagcaguugcgaaaucaugauaccaaaaggcacuggggauauccucguggacuguuccggaggucagcaacacuuccugaaggauaaucuuauugaccugggcugcccgaacauccccuugcucgggaagauggccauuuacaucuguaggaugucuaaucauccuaaaacaaccauggcguuucuguucugguuuagcuucggauauguugugacgugcauacugugcaaggucaucuuuuaccucuuaauugugguaggcacucuggguaaaaaguucaaacaguaucgggagcuuaagccacagaccuguacaauuugcgagacuacccccguuaacgcuaucgaugccgaaaugcacgacuugaauuguuccuacaacaucugcccuuauugugcaucacgcccaacaagugaugggcuggccagacaugugaugcagugccccaagaggaaagagaagauugaagagaccgcucuauaccucaaucuggaacggauaccuugggucgugcgcaaacuucugcaagugagcgagucuacgggagucgcauugaagcgauccucauggcucguugugcuguuaguacugcucacugugagccuuaguccaguccagucugccccgaucggc

SEQ ID NO: 10673 - RNA, 972 nt, Artificial Sequence
  derived and/or modified CDS sequence (opt3) from CCHFV(Matin)__AF467769.2__Gn
agcgaggaauccggcgacgauugcaucucuagaacccagcugcucaggacagagacugccgaaauucacucagacaguuacgggggacccggugauaagauaacgaucuguaacggcagcaccguggucgaccaacggcuuggguccgagcugggaugcuauacaauuaaucgcguuaaaucuuucaaguugugugaaaacucggcuacuggcaaaucaugcgagaucgauagcaccccugugaagugucgacaggguuuuugcuuaaaaauuacacaggaggggcguggacauguaaagcugaguagaggcuccgaagugguccuagacgcaugugauucuagcugcgagaucaugauaccaaagggcaccggggacauccucguggauuguuccggaggucagcaacacuuccugaaagacaaucuuauugaucugggcugcccgaacauccccuugcucgggaagauggccauuuacaucuguaggaugucaaaucauccuaaaacuacaaugguuuuucuguucugguuuaguuucggauaugugauaaccugcauucugugcaaggucaucuuuuaccucuuaauugugguaggcacgcuggguaaaaaguucaagcaguaucgggaacuuaaaccacagacuuguaccaucugcgagacaacucccguuaacgcgaucgacgcugagaugcacgauuugaauuguagcuacaacauuugcccuuauugugccucucgccugaccuccgacgggcuagcaagacaugugaugcagugcccaaagaggaaagaaaagauagaggaaacagagcucuaccugaaucuugaacggauccccugggucgugcgcaaacuguugcaagugucagagagcaccggagucgcccucaagcgaaguucuuggcugguuguguuacugguacuccuuacggugucccugagcccuguccagucggcuccaauuggc

SEQ ID NO: 10674 - RNA, 972 nt, Artificial Sequence
  derived and/or modified CDS sequence (opt3) from CCHFV(Baghdad 12)__AJ538197.2__Gn
agcgaggaauccggcgacgauugcaucucuagaaccaggcugcuccggacagagacugccgaaauucacggggacucauacggaggucccggcgauaagauaacgaucuguaacgggaguaccauuguggaccagcgccuuggaagcgagaugggcugcuauacaaucaaucgagucaaauccuucaagcugugugaaaacucugcuacugguaaaucgugcaagauugauucaaucccuguuaaaugucgucaaggguacugcuugaagauaacccaggagggaagaggccaugugaaguuaagcaggggcagugagguagugcuggacgcaugugauuccucuugcgaagucaugaucccaaaagggacaggagacauucuaguggauuguagcgguggccagcagcacuuucucaaggacaaucugaucgaucuugggugcccgaacauuccccuguugggaaaaauggccaucuauauaugucggauguccaaucauccuaagaccacuauggcguuccucuuuugguucucauuuggcuacguuauuacaugcauccugugcaaagcuauuuucuaucugcucaucaucguggguaccuuagggaagcgcuuuaagcaauacagagagcugaaaccacagacguguacuauuugcgaaaccacacccgucaacgccauagacgcagagaugcacgaucuuaauuguaguuauaacaucugcccuuacugugccagcagguugacuucugacggacuggcucggcaugugacccagugcccaaagcgcaaagagaagguagaagagacagaacuauaccucaaucuggagcgaauccccuggguugugagaaaacuucugcaggucuccgaaucaaccggcguggcauugaagaggagcaguuggcucauugugcuguuaguccugcucgccguuucuuccagcccugugcaaucggcuccaauaggc

SEQ ID NO: 10675 - RNA, 972 nt, Artificial Sequence
  derived and/or modified CDS sequence (opt3) from CCHFV(VLG/TI29414)__AY179961.1__Gn
agcgaggaacccggcgacgauugcaucuccagaacccagcugcucagggccgagccugcugaaauucacgacgauaacuacgggggaccaggugacaagauaacaaucuguaauggcucuacuauuguggaucaacggcuugggucagagcugggaugcuauacgaucaaccgcgucaaaaguuucaaguugugugaaaauagcgcaaccggcaaaacaugcgagauugacuccacuccgguuaagugucgacaggguuuuugcuuaaaaaucacccaggaggggcguggacaugugaagcugucuagaggcucggaaguagugcuagaugccugugacucaagcugcgaggucaugauacccaagggcacaggggauauccucguggacuguaguggaggucagcaacacuuccugaaagauaaccuuauugaccugggcugcccucauaucccauugcucgggaagauggcgauuuacaucuguaggauguccaaucacccccggaccacuauggcuuuucuguucugguuuucuuucggauauguuauaacaugcaucuuuugcaaagcccuguucuacagccucauuauuaucggcaccuuagguaagaaaaucaagcaguaucgcgaacugaagccucagacguguacuauuugcgagaccgcaccagugaacgccauagaugcugagaugcaugaccuuaauuguuccuacaacaucugccccuauugugcaucaagauugacaagugacgggcuggccaggcacgucccucagugcccaaaacggaaggaaaaaguggaggaaacugagcuauaccucaaucuggaacgcauuccguggaacguacgaaaacuucugcaaguuagcgagucuaccggaguggcuuugaagagauccucauggcucaucguccuguuagugcugcucacagugagccuuagucccguccagucugccccuguuggc

SEQ ID NO: 10676 - RNA, 972 nt, Artificial Sequence
  derived and/or modified CDS sequence (opt3) from CCHFV(TADJ/HU8966)__AY179962.1__Gn
agcgaggaauccggcgacgauugcaucucuagaacccagcugcucaggacagagacugccgaaauucacggggacgauuacggaggucccggcgacaagauaacgaucuguaacgggucaaccauuguggaucaacggcuuggaagugagcugggcugcuauacaaucaaucgcgucaagagcuucaaguugugugaaaacuccgcuacugguaaaaauugcgagauugacucuguuccugugaagugucgacagggguacugcuuaaaaaucacccaggagggacguggccauguaaagcugucgagaggcucagaagugguccuagaugcaugugacagcaguugcgaggugaugauaccaaaggggacaggagauaucuccguugacuguucugguggccagcaacacuuucucaaagauaaccugauugaccuugggugcccgaagaucccccuguugggaaaaauggccauuuauaucuguaggaugagcaaucauccuaagaccacuauggcguuccucuuuugguucuccuuuggcuacgugauaacacggauucugugcaaagcuaucuucuaucugcucauuaucgucgguaccuuagggaagcgcuuuaagcaguacagagaacugaaaccacagacgugcacuaucugugagaccacacccgccaacgcaauugaugccgagaugcacgaccuuaauugcucauauaacauauguccuuacugcgcuaguagguugacuagcgacggacuggcacggcaugugacccaguguccaaagcgcaaagaacgaguagaggaaacagagcuauaccucaaucuggaaagaauccccuggauuguuaggaaacuucugcaagugucugaguccaccggcgucgccuugaaacggucaagcuggcucaucgugcuguuagugcuguucacggucagucucucuccuguucaguccgcuccaauaggc

SEQ ID NO: 10677 - RNA, 972 nt, Artificial Sequence
  derived and/or modified CDS sequence (opt3) from CCHFV(Hodzha)__AY223476.1__Gn
agcgaggaauccggcgacgauugcaucucuagaacccagcugcucaggacagagacugccgaaauucacggggacgauuacggaggucccggcgacaagauaacgaucuguaacgggucaaccauuguggaucaacggcuuggaagugagcugggcugcuauacaaucaaucgcgucaagagcuucaaauuguguaaaaacuccgcuacugguaagucuugcgaaauugacucgaccccuguuaaaugucgacagggguacugcuuaaagaucacacaggagggacguggccaugugaagcugucaagaggcagcgagguagugcuagaugcaugugacaguuccugcgaagucaugauaccaaaagggaccggagauauccucguggacuguucugguggccagcaacacuuucugaaggauaaucuuauugaccuggggugcccgaggauccccuugcucggaaaaauggccauuuauaucugucggaugagcaaccauccuaagacuacaauggcguuccuguuuugguucuccuuuggcuacguuauaaccugcauucugugcaaagcuaucuucuaucucuuaauuaucguggguacgcuggggaagcgcuuuaagcaguacagagagcuuaaaccacagacuuguaccaucugcgaaacaacucccgccaaugcaauugaugccgagaugcacgacuugaacuguucauauaauauaugcccuuacugugcuaguaggcugaccagcgacggacuagcacggcaugucacacagugcccaaagcgcaaagagaagguggaagagaccgaacucuaccugaaccuugagcgaauccccuggauuguaagaaaacuguugcaaguuucugaauccacgggcguggcccucaagaggucaagcuggcugaucgucuuacugguccucuucgcugugagucuuucuccugugcaguccgccccaauaggc

SEQ ID NO: 10678 - RNA, 972 nt, Artificial Sequence
  derived and/or modified CDS sequence (opt3) from CCHFV(Kosovo/9553/2001)__AY675511.1__Gn
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucgcgaggauguccaaucacccaaaaacaaccauggcuuuucuguucugguuuucucugggauauguuauaacguguauucucugcaaggccuuauucuacagccugaucauuaucggcacucuugguaaaaagaucaagcaguaucgggaauugaaaccccagaccugcacaauuugugagacugcaccugugaacgccauagaugcugagaugcaugaccugaauugcuccuacaacaucuguccauauugcgcaucacgccuaaccagugacgggcucgccagacacgucaagcagugucccaaaaggaaggaaaaaguggaggaaacagagcuguaccuuaaucuggaacggauuccuuggguaguucgcaaguugcuccaagugagcgagucuaccggagucgcucugaaacgauccucaugguuaaucgugcugcucgugcuucugacggucagcuugaguccaguucagucugccccggugggc

SEQ ID NO: 10679 - RNA, 972 nt, Artificial Sequence
  derived and/or modified CDS sequence (opt3) from CCHFV(SPU41/84)__AY900142.1__Gn
agcgaggaauccucugacgauugcaucucaagaacccagcugcucaggacagagacugccgaaauucacggcgacaacuacgggggacccggugauaagauaacgaucuguaauggcaguaccguggucgaccaacggcuugggagcgagcugggaugcuauacaauuaaccgcguuaaaacuuucaaguugugugaaaauuccgcuaccggcaaaucuugcgagaucgauucggugccuguaaagugucgacaggguuacugcuuaaaaauuacacaggaggggcguggacaugugaagcugucaagaggcagcgaagucgugcuagacgcaugugauaccaguugcgagguuaugaucccaaagggcacuggggacauacucguggauuguuccggaggucagcaacacuuucugaaagacaaccuuaucgaucugggcugcccgaagauucccuugcucgggaaaauggccaucuauauuuguaggaugucuaaucauccuaagacaaccauggcguuccuguuuugguucagcuuuggauacgucaucacgugcauaauuugcaaagugaucuucuaucugcucauuaucguaggcacuuuagguaagcgguuuaagcaguaccgcgaacugaaaccacagaccuguacaaucugcgagacuacccccguuaacgcuauugacgccgagaugcacgaucuuaauuguuccuauaacauaugcccuuacugugcaucaagauugacaagugacgggcuggccaggcaugugacccagugcccaaagcggaaagaaaaggucgaggaaacggagcuauaccucaaucuggaacgcauccccuggguggugcgaaaacuucugcaagucagcgagucuacuggaguugcuuugaagagauccucauggcucgugguacuguuagugcugcucacagucagccuuaguccugugcagucugcaccaauuucc

SEQ ID NO: 10680 - RNA, 972 nt, Artificial Sequence
  derived and/or modified CDS sequence (opt3) from CCHFV(UG3010)__AY900143.1__Gn
gccgagggcgugagcaacgacugcgucuccagaacccagcugaucaagacagaaguugcugagauucacgaagauucuuacgggggacccggugagaaaauaacuaucuguaauggcucaacgauuguggaccaaaggcucgggagugaacuuggaugcuauaccaucaaccggguaaagacauacaaacugugugagaauagcgcaacugagaagggcugcgaaauugauuccgugccugucaaauguaagcaggguuucugcuugaaggugacccaggaggggcgcggacauguuaaauuaucucgaggcacagaaaucgugcuggacgucugugauaccucgugcgagcuaaugauaccaaagggcacuggggacauccucguggauuguucaggaggucagcaacacuuucugcaggacaaccuuauugaucugggcugcccgaauguacccuugcucgggaaaauggccaucuauauuugucguaugagcaaccauccuaagacaaccauggcguuccuguuuugguucaguuuuggauacguuaucacgugcauagugugcaaaguccuguucuaucucuuaauugugaucggcacucuguccaagaaacuuaagcaguacagagaguugaagccacagaccuguauugugugcgaaucuacacccgucaaugcuaucgacgccgagaugcacgaacugaacuguaauuauaacaucugcccuuacugugcaagcaggcuaacuuccgauggucucguucggcaugugaaucaaugcccaaaacgcaaggagaaaguagaagagaccgagcuguaccuuaaccuggaaaggauucccugguuggugagacggcuccugcaggucucagagaguacagggauggccuuaaagcgcagcuguuggaugaccacgcugcucauacuucuggugguuucuuuguccccugugcagucagcuccagucgga

SEQ ID NO: 10681 - RNA, 972 nt, Artificial Sequence
  derived and/or modified CDS sequence (opt3) from CCHFV(Hy13)__AY900145.1__Gn
agcgaggaauccggcgacgauugcaucucuagaacccagcugucaaggacagagacugccgaaauucacagugacaacuacgggggacccggugauaagauaacgaucuguaauggcagcaccauuguggaccaacggcucggguccgagcuuggaugcuauacaaucaaccgcgucaaaucuuucaagcugugugaaaauucggcuacuggcaaaucaugcgagauugauagcaccccuaucaagugucgacaggguuuuugcuugaaaauaacacaggaggggcguggacauguuaaguuaaguagaggcuccgaagugguacuggacgcaugugauucuagcugcgagaucaugauuccaaagggcaccggggacauccuaguggauuguuccggaggucagcaacacuuccucaaagacaaccugauugaucuuggcugcccgaauaucccccuguuggggaagauggccauauacauuuguaggaugucaaaccauccuaaaacuacaauggcguuucucuucugguuuaguuucggauaugucauuaccugcauccugugcaaggugaucuuuuaccugcucaucguugugggcacguuagguaaaaaguucaagcaguaucgggaacugaaaccacagacuuguaccauuugcgagacaacucccgucaaugcuauagacgccgagaugcacgaucuuaacuguagcuacaauaucugcccuuauugugcaucucgcuugaccuccgacgggcuggccagacaugugaugcagugcccaaagaggaaagaaaagguagaggaaacagagcuauaccucaaccuggaacggauucccuggguugugcgcaaacuucugcaagucucagagagcaccggaguggcuuugaagcgaaguucuuggcucgugguccuguuaguucugcucacggugucccuuagcccuguacagucggcaccaaucggc

SEQ ID NO: 10682 - RNA, 972 nt, Artificial Sequence
  derived and/or modified CDS sequence (opt3) from CCHFV(Semunya)__DQ094832.1__Gn
gccgagggcgugagcaacgacugcgucuccagaacccagcugaucaagacagaaguugcugagauucacgaagauucuuacgggggacccggugagaaaauaacuaucuguaauggcucaacgauuguggaccaaaggcucgggagugaacuuggaugcuauaccaucaaccggguaaagacauacaaacugugugagaauagcgcaacugagaagggcugcgaaauugauuccgugccugucaaauguaagcaggguuucugcuugaaggugacccaggaggggcgcggacauguuaaauuaucucgaggcacagaaaucgugcuggacgucugugauaccucgugcgagcuaaugauaccaaagggcacuggggacauccucguggauuguucaggaggucagcaacacuuucugcaggacaaccuuauugaucugggcugcccgaauguacccuugcucgggaaaauggccaucuauauuugucguaugagcaaccauccuaagacaaccauggcguuccuguuuugguucaguuuuggauacguuaucacgugcguggucugcaaagugcuguucuaucucuuaauagugauuggcacucuggguaagaagcugaaacaguacagagaguugaagccacagaccuguaucgucugcgaauccauucccguuaaugcuaucgacgccgagaugcacgaacugaacuguaauuauaacaucugcccuuacugugcaucuaggcuaacaagcgaugggcucgugcggcauguaacucaaugcccaaaacgcaaggagaaaguggaagagaccgagcuguaccuuaaucuggaaaggauucccugguuggucagacggcuccuucagguguccgagucaacaggaauggccuuaaagcgcaguuguuggaugaccacgcugcucauacuucugguugugagcuugucuccuguccaguccgcuccagugggc

SEQ ID NO: 10683 - RNA, 972 nt, Artificial Sequence
  derived and/or modified CDS sequence (opt3) from CCHFV(SPU128/81/7)__DQ157174.1__Gn
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaagagcuucaaauugugugaaaauuccgcuacuggcaaaucuugcgagauugagucgguuccagugaagugucgacaggguuacugcuuacguaucacccaggaagggagaggacauguaaaacugucaaggggcagcgaggugguccuagaugcaugugacacaaguugcgaaauaaugaucccgaagggcaccggggauauucucguggacuguuccggaggucagcaacacuuucugaaggauaaccuuaucgaccugggcugccccaaaauuccuuugcucgggaagauggccaucuauauaugucggaugucuaaucauccaaaaacuacaauggcguuccuguuuugguucagcuuuggauacguuauuaccugcauccugugcaaggcuauuuucuaucucuuaaucaucauuggcacgcuggguaaacgcuuuaagcaguacagagagcuuaagccccagacuuguaccauaugcgagacaacuccugugaacgccaucgaugcagaaaugcacgacuugaauuguuccuauaacauuugcccauacugugccucaaggcugaccagugaugggcuagcucggcaugucacacagugccccaaacgcaaggagaaaguggaagagaccgaacucuaccugaaucuugagcgaaucccuuggguaguuagaaagcuguugcaagugagcgagucuacgggagucgcacucaaaagguccucauggcugauaguguuacugguccucuucacugugagccuuaguccaguucagucugccccgauuggc

SEQ ID NO: 10684 - RNA, 972 nt, Artificial Sequence
  derived and/or modified CDS sequence (opt3) from CCHFV(ROS/HUVLV-100)__DQ206448.1__Gn
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaagagauccucauggcucauaguccuguuagugcugcucacggugagccuuaguccgguccagucugcucccguuggc

SEQ ID NO: 10685 - RNA, 972 nt, Artificial Sequence
  derived and/or modified CDS sequence (opt3) from CCHFV(AP92)__DQ211625.1__Gn
agcgagggcggggacggagguugcaucuccagaacccagcugauuaagacagaaacugccgaggugcacggcgaugacuacgggggacccggcgagaaaauaacgaucuguaacgguucuaccauugucgaucaaaggcucgggucagaacuuggaugcuauacaaucaaucggauuaagaguuucaaacugugugaaaacagcgcucagggcaagaauugcgagaucgacuccgcaccuguucagugucgccagggcuacugcuugaaaauaucucaagaggggcgaggacaugugaaguuaucgcgugguucagaaaucguacuggaugugugugacacuagcugcgagauuaugaucccaaagggcaccggggauauucuagucgacuguaguggaggccagcagcacuuucuccaguccaaccugguggaucuugguugcccgaauaucccccuguuggggaaaauggccauauauauuuguagaaugucuaaccauccuaagacaaccauggcguuccucuuuugguucagcuuuggauacguuaucacuugcauucugugcaaaacacuguucuauauccucaucauuauaggcaccuuaggcaagaaacugaagcaauacagggaacuuaagccacagacguguacuaucugcgaguccgugcccgucaaugcuauugacgccgagaugcacgauuugaacuguucauauaauaucugcccuuacugugcaagucggcugaccagcgaagggcuaacacgccaugugaaccagugcccaaaaagaaaggagaaaguagaagagacugaacucuaccugaaucuugagaggauacccuggauuguucggaagcugcuccaggugucugaguccaccggagucgccuugaaacgcucaagcuggaugaucgugcuguuaauccugcucauugugaguaugucuccuguccaauccgcuccaaucagc

SEQ ID NO: 10686 - RNA, 972 nt, Artificial Sequence
  derived and/or modified CDS sequence (opt3) from CCHFV(ArD8194)__DQ211626.1__Gn
gccgagggcgggagcaacgacugcguguccagaacccagcuggucaagacagaaguugcugagauccacgaagauucuuacggaggucccggcgagaaaauuacuauauguaaugggucaacgaucguggaccaaaggcucggaagugaacuuggcugcuauaccauuaaccggguacgcacauacaagcugugugagaauagcgcaacugagaaauccugcgaaaucgauucugugccugucaaguguaaacaggguuucugcuugaagauuacccaggaggggcgaggacaugugaaguuaucgcguggcacagaaaucguucuggacgugugugauaccucaugcgagcuaaugauaccaaaaggcacuggggacauccucgucgauuguagcggaggucagcaacacuuucugcaggacaaccuuauugaucugggcugcccgaauauccccuugcucgggagaacagccauuuauguguguaggaugaguaaccauccuaagaccacgauggcguuccuguuuugguucuccuuuggauacguaaucacuugcguugugugcaaaguccuguucuaucucuuaauagugauuggcacccuggguaagcggcuuaaacaguaccgcgaguugaagccacagacauguaucgugugcgaaucuauucccgucaaugcuaucgacgccgagaugcacgaucugaacuguaauuauaacaucugcccuuacugugcaagcagacuaacuuccgacgggcucguuaggcaugugacccaaugcccaaagcggaaagaaaagguagaggaaacagagcuguaccuuaaucuggagcgcauucccugguuggugcgaaaacuccugcaggucucagaaaguaccggaguggccuuaaagagaagcuguuggaugauaacgcugcucauccuucugacuguuucuauguccccugugcagucagcuccagucggc

SEQ ID NO: 10687 - RNA, 972 nt, Artificial Sequence
  derived and/or modified CDS sequence (opt3) from CCHFV(ArD15786)__DQ211627.1__Gn
gccgagggcgggagcaacgacugcguguccagaacccagcuggucaagacagaaguuacugagauccacgaagauucuuacggaggucccggcgagaaaauuacgauauguaaugggucaaccaucguggaccaaaggcucggaagugaacuuggcugcuauacaauuaaccggguacgcacuuacaagcugugugagaauagcgcuaccgagaaauccugcgaaaucgauucugugccugucaaguguaaacaggguuucugcuugaagauuacacaggaggggcgaggacaugugaaguuaucgcguggcaccgaaaucguucuggacgugugugauacuucaugcgagcuaaugauaccaaaaggcacaggggacauccucgucgauuguagcggaggucagcaacacuuucugcaggacaaccuuauugaucugggcugcccgaauauccccuugcucgggcagaccgcaauuuauguguguagaaugaguaaccauccuaagacgacuauggccuuccuguuuugguucuccuuuggauacguaauaaccugcguugugugcaaaguccuguucuaucucuuaaucgugauuggcacacuggguaagaggcuuaaacaguaccgggaguugaagccacaaacuuguaucgugugcgaaucuauucccgucaaugcgaucgacgcugagaugcacgaucugaacuguaauuauaacaucugcccuuacugugccagccgccuaaccuccgacgggcucguuagacaugugacacagugcccaaagaggaaagaaaagguagaggaaaccgagcuguaccuuaaucuggagcggauucccugguuggugcgcaaacuccugcaggucucagaaaguacgggaguggcauuaaagcgaagcuguuggauaaucacucugcucauucuucugacaguuucuauguccccugugcagucagccccagucggc

SEQ ID NO: 10688 - RNA, 972 nt, Artificial Sequence
  derived and/or modified CDS sequence (opt3) from CCHFV(ArD39554)__DQ211628.1__Gn
agcgaguccaacaauaacgacugcgugucuagaacccagcugaucaagacagaaaaugccgagauucacggcgaugacuacgggggacccggugagaaaauaacuaucuguaacggcucaacgauugucgaacaaaggcucgggagugaacuuggaugcuauaccaucaaucggauuaagagcuucaaacugugugagaacuccgcuucuggcaaggguugcgagaucgauucgacaccuguuaaauguaagcagggguuuugcuugaagauaacucaggaaggacgcggccaugugaaauuaucacgaggcagcgagaucauucuggacguaugugauaguuccugcgaaaugaugaucccaaaggggucuggagacauucuaguggauuguagcgguggccagcaacacuuccuccaggacaaucuggucgaucuugggugcccgaacgugccccuguugggaaaaauggcaaucuacauaugucguauguccaaucauccuaagaccacaauggccuuucucuucugguuuucauucggcuauguuauuaccugcaucuuuugcaaagugauuuucuacguccugaucaucauugguacucuggggaagagaauaaagcaguauagggagcucaaaccacagacauguaccaucugcgaggcgacgcccgugaacgcuauugacgccgaaaugcacgauuuaaauuguaguuacaacaucugcccuuauugugcaagccggcugacuucugagggacuuguacgccauguuacccaaugcccaaagagaaaagaaaagauagaggaaacagaguuguaccugaaucuagagaggauucccugguuugugcggaaacuccugcaggucuccgaaucaacuggcguggcccuuaagcgcagcaguuggcuggugaccuugcucguccuguuaacaguuucucuguccccugugcagagcgcuccaaucggc

SEQ ID NO: 10689 - RNA, 972 nt, Artificial Sequence
  derived and/or modified CDS sequence (opt3) from CCHFV(Drosdov)__DQ211630.1__Gn
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgaggucaugauaccgaaaggcacuggggauauccucguggacuguaguggaggucagcaacacuuccugaaggauaaccuuauugaccugggcugcccccauaucccuuugcucgggaaaauggccauuuacaucuguagaauguccaaucacccaaggacaaccauggcguuucuguucugguuuucuuucggauauguuauaacgugcaucuuuugcaaggcucuguucuacagccucauuauuaucggcacuuuagguaaaaagaucaagcaguaucgggaacugaaaccccagaccuguacaauuugcgagacugccccugugaacgcaauagaugccgagaugcaugaccuuaaguguuccuacaauaucugcccauauugugcuucacgcuugaccagugacgggcuggcaagacacgucacacagugccccaaaaggaaggaaaaaguggaggaaaccgagcuauaccucaaccuggaacggauuccuuggaucguacgcaaacuucugcaaguuagcgagucuacgggaguggccuugaagcgauccucauggcucauaguccuguuagugcugcucacugugagccuuaguccaguccagucugcuccgguuggc

SEQ ID NO: 10690 - RNA, 972 nt, Artificial Sequence
  derived and/or modified CDS sequence (opt3) from CCHFV(Oman)__DQ211632.1__Gn
agcgaggaauccggcgaggacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaaauccuucaaguugugugagaauagcgcuacugguaaaucuugcgagauugacaacaccccuguuaaguguaaacagggguuuugcuuaaagaucacacaggaaggacgaggccaugugaagcugucgcgugauucagagguagugcuagacgcaugugauagcaguugcgaaauaaugaucccaaaaggcaccggggacauucucgucgauuguuccggaggucagcaacacuuccugaaggacaaucuuaucgaucugggcugcccgaacauucccuugcucgggaaaauggccaucuacauauguagaaugucuaaucauccuaagacuacaauggcguuucuguucugguuuagcuucggauaugugauuaccugcauccugugcaaaguuaucuuuuaccucuuaauuguggucggcacgcuggguaagaaguucaaacaguauagggagcuuaagccacagacuuguaccaucugcgagacaacucccgugaacgcuauugacgccgaaaugcacgauuugaauuguuccuacaacauaugcccuuauugugcaucacggcugaccagugacgggcuagcccgccauguaaugcagugcccaaaaagaaaggagaaaaucgaagagacagaacucuaccugaaucuugagaggauucccuggguugugcggaagcuguugcaagucagcgagucuaccggaguggcucucaaacgcuccucauggcugaucguguuacugguccuccuuacgguuagccugaguccugugcagucugcaccaauaggc

SEQ ID NO: 10691 - RNA, 972 nt, Artificial Sequence
  derived and/or modified CDS sequence (opt3) from CCHFV(SPU97/85)__DQ211633.1__Gn
agcgaggaauccgacggcgauugcaucucuagaacccagcugcucaggacagagacugccgaaauucacucagacaacuacgggggacccggugauaagauaacgaucuguaauggcaguaccauuguggaccaacggcuugggagcgagcugggaugcuauacaaucaaccgcgucaaauccuucaaguugugugaaaauucugcuacuggcaaaucgugcgagauugauucaaccccuguuaagugucgacaggguuuuugcuuaaaaaucacacaggaggggcguggacaugugaagcugagcagaggcagugaaauaguacuagacgcaugugauuccucuugcgagaucaugauuccaaagggcaccggggacauccucguggauuguagcggaggucagcaacacuuccugaaagacaaccuuauugaucugggcugcccgaauauccccuugcucgggaggauggccauauacauuugucggauguccaaccauccuaagacuacaauggcguuucuguucugguuuucauucggauaugucauuaccugcauccugugcaaagugaucuuuuaccucuuaaucguugcuggcacgguggguaagaaauucaagcaguaucgcgaacugagaccacagacuuguaccauuugcgagacaacucccgucaaugccauagacgcagagaugcacgaucuuaacuguaguuacaauaucugcccuuauugugccagcagguugaccucugacgggcuggcucggcaugugaugcagugcccaaagcgcaaagaaaagauugaggaaacagagcuauaccucaaccuggaacgaauccccuggguaguuagaaaacuucugcaaguguccgagucaaccggagucgcauugaagaggagcaguuggcucacggugcuguuagugcugcucauagucucucuuuccccuguucagagcgccccaauuggc

SEQ ID NO: 10692 - RNA, 972 nt, Artificial Sequence
  derived and/or modified CDS sequence (opt3) from CCHFV(SPU103/87)__DQ211634.1__Gn
agcgaggaauccucugacgauugcaucucaagaacccagcugcucaggacagagacugccgaaauucacggcgacaacuacgggggacccggugauaagauaacgaucuguaauggcaguaccauuguggaccaacggcuugggagcgagcugggaugcuauacaaucaaccgcgucaaaacuuucaaguugugugaaaauuccgcuaccggcaaaucuugcgagauugauucgguuccugugaagugucgacaggguuacugcuuaaaaaucacacaggaggggcguggacauguaaagcugucaagaggcagcgaagugguccuagacgcaugugauaccaguugcgaggugaugauaccaaagggcacuggggacauccucguugauuguuccggaggucagcaacacuuucugaaagacaaccuuauugaucugggcugcccgaagauccccuugcucgggaaaauggccauuuauaucuguaggaugucuaaucauccuaagacaaccauggcguuccuguuuugguucagcuuuggauacgugauaacgugcguccugugcaaagcuauuuucuaucucuuaaucauugugggcacucuggguaagcggcuuaagcaguaccgcgaauugaaaccacagaccuguacaaucugcgagacuacccccguaaacgccaucgacgcagagaugcacgaucugaauuguuccuauaacauuugcccuuacugugccucaagacuaacaagugacgggcucgcuaggcauguuacccagugcccaaagcggaaagaaaagguggaggaaacggagcuguaccuuaaucuggaacgcauacccugggucgugcgaagauugcuccaagugagcgagucuacuggagucgcacugaaaagguccucaugguuaaucguucugcucgugcuuuuuacaguaagccugaguccugugcagucugccccaauuucc

SEQ ID NO: 10693 - RNA, 972 nt, Artificial Sequence
  derived and/or modified CDS sequence (opt3) from CCHFV(SPU415/85)__DQ211635.1__Gn
agcgaggaauccgacggcgauugcaucucuagaacccagcugcucaggacagagacuacggaaauucacucagacaacuacgggggacccggugauaagauaaccaucuguaauggcaguacaauuguggaccaacggcuugggagcgagcugggaugcuauacuaucaaccgcgucaaauccuucaaguugugugaaaauucugccaccggcaaaucgugcgagauugauucaacaccuguuaagugucgacaggguuuuugcuuaaaaaucacccaggaggggcguggacaugugaagcugagcagaggcagugaaauaguacuagacgcuugugauuccaacugcgagaucaugauuccaaagggcacuggggacauccucguggauuguucuggaggucagcaacacuuccugaaagacaaucuuauugaucugggcugcccgaacauccccuugcucgggaagauggcaauauacauuuguaggaugagcaaucauccuaaaacaaccauggccuuucuguucugguuuuccuucggauaugucaucacgugcauucugugcaaggugaucuuuuaccucuuaaucguugcgggcacuguggguaaaaaguucaagcaguaucgggaacugcgcccacagaccuguacaauuugcgagacuauacccgucaacgcuaucgacgccgagaugcacgaucuuaauuguucauacaacauuugcccuuauugugcaaguagauugaccagcgacgggcuggccaggcaugugaugcagugcccaaaacggaaggaaaaaguagaggaaacagagcuauaccucaaucuggaacgcauccccuggguugugcgaaaacuucugcaagucucugaguccaccggaguggcuuugaagagaucaagcuggcucacggugcuguuaguccugcucauaguuagucuuucuccugugcaguccgcaccaauuggc

SEQ ID NO: 10694 - RNA, 972 nt, Artificial Sequence
  derived and/or modified CDS sequence (opt3) from CCHFV(Turkey200310849)__DQ211636.1__Gn
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagguugacuccacaccagugaagugucgacaggguuuuugcuuaaaaauuacccaggaggggcguggacauguaaagcugucuagaggcucggaagugguccuagaugcaugugacucaagcugcgaggugaugaucccgaagggcacuggggauauacucguugacuguaguggaggucagcaacacuuccugaaagauaaccuuaucgaccugggcugcccccauauuccuuugcucgggaagauggccaucuacauuuguaggauguccaaucacccacggacaaccauggcguuucuguucugguuuucuuucggauaugugaucacgugcauaagcugcaaagcucuguuuuacucccucauuaucauuggcacuuuagguaagaaaaucaagcaguaucgcgaacugaagccccagaccuguacaaucugcgagacugccccugucaacgcaauugaugccgagaugcaugaccuuaauuguucauacaacauaugcccauauugugcuaguagauugaccagcgacgggcuggcaaggcacgugacacagugccccaaacggaaggaaaaaguagaggaaaccgagcuauaccucaaucuggaacgcaucccuuggauuguucgaaaacuucugcaagugucugaguccacgggagucgccuugaagagaucaagcuggcucaucgugcuguuagugcugcucacugucagucuuucuccaguucaguccgcuccggugggc

SEQ ID NO: 10695 - RNA, 972 nt, Artificial Sequence
  derived and/or modified CDS sequence (opt3) from CCHFV(Kosova Hoti)__EU037902.1__Gn
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccagaaggggcguggacaugugaagcugucuagaggcucggagguagugcuagaugcaugugacucaaacugcgaagucaugauaccgaaaggcacuggggauauccucguggacuguagcggaggucagcaacacuuccugaaggauaaucuuauugaccugggcugcccccauaucccuuugcucgggaaaauggccauuuacaucuguaggaugaguaaccacccaaagacaaccauggcguuucuguucugguuuuccuucggauauguuauaacgugcaucuuuugcaaagcucuguucuacucucucauuauuaucggcacuuuagguaagaagaucaaacaguaucgggagcugaagccccagaccuguacaauuugcgaaacugccccugugaaugcaauagaugccgagaugcaugaccuuaacuguagcuacaauaucugcccauauugugcuucccgcuugaccucagacgggcuggcaagacacgucaaacagugccccaagaggaaagagaagguggaagagacagaacuauaccucaaccuggagcggauuccuuggguaguucgcaaacuucugcaagugagugaaagcaccggagucgccuugaagcgaucuuccuggcucaucgugcuguuagugcugcucacggucucacuuagcccaguucagagugcuccggugggc

SEQ ID NO: 10696 - RNA, 972 nt, Artificial Sequence
  derived and/or modified CDS sequence (opt3) from CCHFV(YL04057)__FJ562094.1__Gn
gccgagggcgggagcuccgacugcaucucuagaacccagcuggugaagacagaagucgcugagauucacgaagauucauacggaggucccggcgagaaaauaacuaucuguaacgggaguacgauuguugaccaaaggcucggacgggaacuuggcugcuauaccaucaaucgcgugcgaagcuacaagcugugugagaacuccgcaucugguaaaucgugcgagauugauucaaucccuguaaaguguaaacagggguucugcuugaagauaacacaggaaggacguggccaugugaaguuaagcagaggcacugagaucguccuggacgugugugauaguuccugcgaacuaaugauuccaaaagggaccggagacauccucguugauuguucugguggccagcaacacuuucugcagaauaaccuuauugaccuggggugcccgaaugugcccuugcucggaaagauggccaucuaugucuguaggaugagcaaccauccuaaaacaaccauggcguuccuguuuugguucuccuuuggcuacgugauaacuugcauugcuugccggguacuguucuaucucuuaaucgccauugguacaguugggaagaaacugaagcaguaccgcgagcuuaagccacagaccuguaucgugugcgagucaguccccgugaaugcaaucgaugccgaaaugcacgaguugaacuguaguuauaauauuugcccuuacugugcuagcagacugucuacggacggacuaauaaggcaugugacucaaugcccaaaacggcgcgaaaaggucgaggaaaccgagcucuuucugaaccuugagcgaauccccuggcugguuagaaaauugcuccagguguccgaaucaacaggcauggcacugaagaggagcuguuggaugauuacuuuacugauccuccuucugguaaguauaucuccugugcaguccgccccagucggc

SEQ ID NO: 10697 - RNA, 972 nt, Artificial Sequence
  derived and/or modified CDS sequence (opt3) from CCHFV(V42/81)__GU477490.1__Gn
agcaaggagcccggcgacgauugcaucuccagaacccagcugaugaggacagaaacugccgagauucacgacgauaacuacgggggaccuggugacaaaauaacgaucuguaauggcucuaccauuguggaucaacggcucgggucagaacuuggaugcuauacaaucaaccgcgucaagaguuucaaacugugugagaauagcgcuacuggcaaggcaugcgaaguugacuccaccccagugaaaugucgacaggguuuuugcuugaagauuacacaggaggggcguggacauguaaaguuaucuagaggcucggaggugguccuggaugccugugacucaagcugcgaagugaugaucccgaaaggcaccggggauauccuaguugacuguaguggaggucagcaacacuuccucaaggauaaccugaucgaccuugagugcccccauauuccucuguugggcaaacucgcgaucuacauuuguaggauguccaaucacccacggacuacaauggcuuuucuguucugguuuggguucggauaugugauaaccugcauacugugcaaggcccucuuuuacucuuuaauuaucauuggcacgcuggguaaaaagaucaagcaguaucgcgaacuuaaaccccagacuuguaccaucugcgagacagcaccugucaacgccauugaugcugagaugcaugacuugaauuguagcuacaacauaugcccauauugugcauccagacugacuucagacgggcuagccaggcacgugacccagugccccaagcggaaagaaaagguagaggaaacagagcucuaccugaaucuugaacgcaucccuuggauuguucgaaaacuguugcaagugagugagagcaccggagucgugcucaagagaucuuccuggcugaucguguuacugguccuccuuacgguuucacugagcccagugcagagugcuccgguaggc

SEQ ID NO: 10698 - RNA, 972 nt, Artificial Sequence
  derived and/or modified CDS sequence (opt3) from CCHFV(Afg09-2990)__HM452306.1__Gn
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugcguagcuucaaauugugugaaaauuccgcuacugguaagucuugcgagauugauucgaucccuguaaaauguaagcagggguacugcuuaaaaauuacccaggagggacgaggccaugugaagcugucaagaggcagcgaagucgugcuagacguuugugauaguuccugcgaggugaugaucccaaaggggacaggagacauacucgucgauuguucugguggccagcaacacuaucugaaagacaaccuuguggaucuggggugcccgaagauccccuugcucggaaaaauggcaauuuacaucuguaggaugagcaaucauccuaagaccacuauggccuuucuguucugguuuuccuucggcuauguaauuacaugcauccugugcaaagcgauauuuuuccucuuaauuaucuuugguacccuggggaagcgguucaagcaguaccgcgaacuuaaaccacagacguguacuauuugcgagaccacacccguuaacgcuaucgacgccgagaugcacgauuugaauuguucauauaacaucugcccuuacugugcaaguagacugacuagcgacggacuagccaggcaugugacccagugcccacggcgcaaggaaaaagucgaggaaacagagcucuaccugaaucuugaacgaauacccuggguggugagaaagcuguugcaagucucugaguccaccggcacgguucucaaaaggucaagcuggcugauuguguuacugguacucuuuacugugagucuuucuccuguccaguccgcuccaaucggc

SEQ ID NO: 10699 - RNA, 972 nt, Artificial Sequence
  derived and/or modified CDS sequence (opt3) from CCHFV(Sudan Al-Fulah 3-2008)__HQ378184.1__Gn
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaagagcuucaaauugugugaaaauuccgcuacuggcaaaucuugcguuauugauucggugccaguaaagugucgacaggguuacugcuuacguaucacccaggaggggagaggacaugugaaacugucaaggggcagcgaggucgugcuagacgcaugugauacaaguugcgaaauaaugaucccgaagggcaccggggacauucucguugauuguuccggaggucagcaacacuuucugaaggacaaccuuguggaucugggcugccccaaaaucccuuugcucgggaagauggccauuuauaucugucggaugucuaaucauccaaaaacuacaauggcguuccuguuuugguucagcuuuggauacgucauaaccugcauucugugcaaggcuaucuucuaucucuuaauuaucaucggcacgcuggguaaacgcuuuagacaguacagggagcuuaagccccagacuuguaccauuugcgaaacaacuccugugaacgccauagacgcagagaugcacgauuugaauuguuccuauaacaucugcccauacugugccucacggcugaccagugacgggcuagcucgccauguaacacagugccccaagcgaaaagagaagguugaagagaccgaacucuaccugaaucuugagaggauuccuuggguggucagaaaacuguugcaagugagcgaaucuacgggaguggcacucaagcgguccucauggcugaucgucuuacugguucucuucacugugagccuuaguccaguacagucugccccgauaggc

SEQ ID NO: 10700 - RNA, 972 nt, Artificial Sequence
  derived and/or modified CDS sequence (opt3) from CCHFV(Sudan AB1-2009)__HQ378187.1__Gn
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaagagcuucaaauugugugaaaauuccgcuacuggcaaaaacugcgagauugauucuguuccagugaagugucgacaggguuacugcuuacguaucacccaggaggggagaggacauguaaaacugucgaggggcucagaagugguccuagacgcaugugauacaagcugcgagauaaugaucccgaagggcaccggggacauucucguggauuguaguggaggucagcaacacuuucugaaggacaaucuuaucgaucugggcugccccaaaauuccuuugcucgggaagauggccaucuauauaugucggauguccaaccauccaaaaacuacaauggcguuccuguuuugguucucuuuuggauaccugauuaccugcauccucugcaaggcuauuuucuauuuacugaucaucauuggcacgcuugguaaacgcuugaagcaguacagagaacugaagccccagacuuguaccauaugcgagacaacuccuguuaaugccaucgacgcagagaugcacgaucuaaacuguagcuauaauauuugcccauacugugccuccaggcucaccucagacgggcuggcucggcaugugauccagugccccaaacgcaaggaaaaagucgaggaaacagagcuuuaccugaacuuggaacgaauaccuugggugguaagaaagcuccugcaaguuagugagagcaccggaguggcauuaaaaaggucuuccuggcugauuguccuccuugugcuguuuacggugucauugagcccaguccagagugccccgaucggc

SEQ ID NO: 10701 - RNA, 972 nt, Artificial Sequence
  derived and/or modified CDS sequence (opt3) from CCHFV(NIVA 118595)__JN572083.1__Gn
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugaaauccuucaaguugugugaaaauagcgcuacugguaaaucuugcgagauugauucgaucccuguaaagugucgacagggguacugcuuaaaaauuacccaggagggacguggccaugugaagcugucaagaggcagcgaagucgugcuagacgcaugugauaguuccugcgagguuaugaucccaaaggggacaggagacauacucguggauuguucugguggccagcaacacuuucugaaagacaaccuuaucgaucuggggugcccgaagauucccuugcucggaaaaauggccaucuauauuuguaggaugagcaaucauccuaagaccacuauggcguuccuguuuugguucuccuuuggcuacgucaucacaugcauacugugcaaagugauuuucuaucucuuaaucauuuuugguacccuggggaagcgguucaagcaguaccgcgaacuuaaaccacagacguguacuaucugcgagaccacacccguaaacgcuaucgacgccgagaugcacgauuugaauuguucauauaacauuugcccuuacugugcaaguagacugacuagcgacggacuagccaggcauguuacccagugcccaaagcggaaagaaaagguggaggaaacagagcucuaccugaaucuugaacgcauacccugggucgugcgaaaacuguugcaagugucugaguccaccggcaucgcucucaagagaucaagcuggcugauugucuuacugguucucuuuacggugaguaucacuccuguacagucugcaccaauaggc

SEQ ID NO: 10702 - RNA, 972 nt, Artificial Sequence
  derived and/or modified CDS sequence (opt3) from CCHFV(SCT ex Afghanistan)__KC344856.1__Gn
agcgaggaauccggcgacgauugcaucucuagaacccagcugcucaggacagagacugccgaagugcacaacgacaauuacgggggacccggugauaagauuacgauauguaacggcucaaccaucgucgaccaacggcuugggagugagcugggaugcuauacaauuaaucgcguuaagagcuucaaguugugugaaaacuccgcuacuggcaaaucuugcaagaucgauucgaccccugugaaaugucgacaggguuuuugcuuaaagauuacacaggaggggcguggacauguaaagcugucaagaggcagcgaggugguccuagacgcaugugauaguuccugcgaaaucaugauaccaaaaggcaccggggacauccucguggauuguucuggaggucagcaacacuuccugaaggacaaucuuauugaucugggcugcccgaacauccccuugcucgggaaaauggccauuuacaucuguaggaugagcaaucauccuaagacuacaauggcguuucuguucugguuuuccuucggauauguuauaaccugcaucuuuugcaaagugauuuucuaccugcucauugucgugggcacguuagguaagaaguuuaaacaguaucgggagcugaagccacagacuuguaccaucugcgaaacaacucccaccaacgcuaucgacgccgagaugcacgaucuuaauuguucauacaacauuugcccuuauugugcaagucgcuugacaagcgacgggcuggccagacauguaacccagugcccaaaaaggaaggagaaaguugaagagacggaacuauaccucaaucuggagcggauacccuggaucgugcgcaaacuucugcaagucucugaauccacuggaguggcuuugaaacgaucaagcuggcucauugugcuguuaguccugcucacaguuagucuuucuccugugcaguccgcaccaaucggc

SEQ ID NO: 10703 - RNA, 972 nt, Artificial Sequence
  derived and/or modified CDS sequence (opt3) from CCHFV(Zahedan 2007)__KC867273.1__Gn
agcgaggaauccggcgacgauugcaucucuagaacccagcugcucaggacagagacugccgaagugcacggggacaacuacggaggucccggcgauaagauuacgauauguaaugggucaaccgucguugaccaacggcuuggaagugagcugggcugcuauacaaucaaccgcgugcguagcuucaaauugugugaaaauuccgcuacugguaagucuugcgagauugauucgaucccuguaaaauguaagcagggguuuugcuuaaaaauuacccaggagggacgaggccaugugaagcugucaagaggcagcgaagucgugcuagacguuugugauaguuccugcgaggugaugaucccaaaggggacaggagacauacucgucgauuguucugguggccagcaacacuuccugaaagacaaccuuguggaucuggggugcccgaagauccccuugcucggaaaaauggcaauuuacaucuguaggaugagcaaucauccuaagaccacuauggccuuucuguucugguuuuccuucggcuauguaauuacaugcauccugugcaaagcgauauuuuuccucuuaauuaucuuugguacccuggggaagcgguucaagcaguaccgcgaacuuaaaccacagacguguacuauuugcgagaccacacccguuaacgcuaucgacgccgagaugcacgauuugaauuguucauauaacaucugcccuuacugugcaaguagacugacuagcgacggacuagccaggcaugugacccagugcccacggcgcaaggaaaaagucgaggaaacagagcucuaucugaaucuugaacgaauacccuggguggugagaaagcuguugcaagucucugaguccaccggcacgguucucaaaaggucaagcuggcugauuguguuacugguacucuuuacugugagucuuucuccuguccaguccgcuccaaucggc

SEQ ID NO: 10704 - RNA, 972 nt, Artificial Sequence
  derived and/or modified CDS sequence (opt3) from CCHFV(SPU 44/08)__KJ682805.1__Gn
agcgaggaauccaacgacgauugccugucuagaacccagcuccuuaggacagagaaugccgaaauccacucagacaacuacggcgggcccggagauaagauuacuauauguaaugguaguacgaucguggaccaacggcugggcagcgaguuggggugcuauaccauuaaccgcgucaaauccuucaaguuaugugaaaauucugcuacaggaaaaucgugcgagaucgauucaacuccuguucgaugucgucagggcuuuugccugaagauuacccaggaggguagagggcaugugaaacuaagcaggggaagugaaguagugcucgacgcaugugauuccucuugcgagaucaugauaccaaagggcacaggcgacauccuggucgauuguagcgggggacagcaacacuuccuuaaggacaaccugguggauuuggguugcccgaauauuccccuccugggcaaaauggccaucuacauuugucggauguccaaccauccuaagaccacuauggcguuucuguucugguuuucauucggguauguuaucacaugcauacucugcaaagcuaucuuuuacuuacugauuguggucggaacccuuggcaagaaauucaagcaguaucgcgaauugaagccacagacguguacuauuugcgagaccaaucccgugaacgccaucgacgcagagaugcacgaucugaauuguaguuacaacaucugcccuuauugugccagcagacuaacaucugacggucucgcuaggcauguaaugcagugcccaaaacggaaggagaaaauugaagaaacugagcuguaccuuaaucuggaacgcauacccuggguugugcgaaaguugcuccaagucuccgagucaaccgggguggcacugaaaagaagcaguugguuagugauccugcucguccuucugacaguuucuuuguccccugugcagagcgccccaauuucg

SEQ ID NO: 10705 - RNA, 972 nt, Artificial Sequence
  derived and/or modified CDS sequence (opt3) from CCHFV(SPU 383/87)__KJ682806.1__Gn
agcgaggaauccaacgacgauugccugucuagaacccagcuccuuaggacagagaaugccgaaauccacucagacaacuacggcgggcccggagauaagauuacuauauguaaugguaguacgaucguggaccaacggcugggcagcgaguuggggugcuauaccauuaaccgcgucaaauccuucaaguuaugugaaaauucugcuacaggaaaaucgugcgagaucgauucaacuccuguucgaugucgucagggcuuuugccugaagauuacccaggaggguagagggcaugugaaacuaagcaggggaagugaaguagugcucgacgcaugugauuccucuugcgagaucaugauaccaaagggcacaggcgacauccuggucgauuguagcgggggacagcaacacuuccuuaaggacaaccugguggauuuggguugcccgaauauuccccuccugggcaaaauggccaucuacauuugucggauguccaaccauccuaagaccacuauggcguuucuguucugguuuucauucggguauguuaucacaugcauacucugcaaagugaucuuuuacuuacuggucgugguaggaacccuuggcaagaaauucaagcaguaucgcgaauugaagccacagacguguacuauuugcgagaccaaucccguuaacgcuauugacgccgagaugcacgaucugaauuguaguuacaacaucugcccuuauugugcaagcagacuaacaucugacggucucgccaggcaugugauccagugcccaaaacggaaggagaaaauugaagaaacugagcuguaccuuaaucuggaacgcauacccugggucgugcgaaaguugcuccaaguguccgagucaaccggggucgcucugaaaagaagcaguugguuaguuauccugcucgugcuucugacaguaucuuuguccccugugcagagcgcaccaauuucg

SEQ ID NO: 10706 - RNA, 972 nt, Artificial Sequence
  derived and/or modified CDS sequence (opt3) from CCHFV(SPU 130/89)__KJ682807.1__Gn
agcgaggaacccaacuacgacugccuguccagaacccagcuccuuaggacagagaaugccgaaauccacucugauaacuauggcgggccuggagacaagauuacuauauguaaugguucaacgaucguggaucaacggcugggcagugaguuggggugcuacaccauuaaccgcgucaagagcuucaaauuaugugaaaauuccgcuacaggaaaaucuugcgagaucgacucgacuccaguucgaugucgucagggcuuuugccugaagauuacccaggaggguagagggcaugugaaacuaucaaggggaagcgaaguagugcucgaugcaugugacaguuccugcgagaucaugauaccgaagggcacaggcgauauccuggucgacuguucugggggacagcaacacuuccuuaaggauaaccugguggacuuggguugccccaauauuccucuccugggcaaaauggccaucuauauuugucggaugagcaaccauccaaagaccacuauggcguuucuguucugguuuuccuucggguacguuaucacaugcauacucugcaaagugaucuuuuauuuacugauugucgugggaacccuuggcaagaaauucaagcaguaccgcgaauugaagccccagacguguacuauuugcgagaccaauccuguaaacgcuaucgaugccgagaugcacgaccugaauuguucauauaacaucugcccauacugugcaaguagacuaacaagcgauggucucgccaggcauguuaugcagugccccaaacggaaggagaaaauugaagaaacugagcuguaccuuaaucuggaacgcauaccuugggugguccgaaaguugcuccaagugucugaguccaccgggguggcucugaaaagaucaagcugguuagucguucugcucgugcuucugacaguaaguuugucuccagugcaguccgcaccgaucagc

SEQ ID NO: 10707 - RNA, 972 nt, Artificial Sequence
  derived and/or modified CDS sequence (opt3) from CCHFV(SPU 497/88)__KJ682808.1__Gn
agcgaggaauccaacgacgauugccugucuagaacccagcuccuuaggacagagaaugccgaaauccacucagacaacuacggcgggcccggagauaagauuacuauauguaaugguaguacgaucguggaccaacggcugggcagcgaguuggggugcuauaccauuaaccgcgucaaauccuucaaguuaugugaaaauucugcuacaggaaaaucgugcgagaucgauucaacuccuguucgaugucgucagggcuuuugccugaagauuacccaggaggguaaagggcaugugaagcuaagcagaggaagugaaguagugcucgacgcaugugauuccucuugcgagaucaugauaccaaagggcacaggcgacauccuggucgauuguagcgggggacagcaacacuuccuuaaagacaaccugguggauuuggguugcccgaauauuccccuccugggcaagauggccaucuacauuuguaggauguccaaccauccuaaaaccacuaugguuuuucuguucugguuuucauucggguaugugaucacaugcauacucugcaaggucaucuuuuacuuacugauugugguaggaacccuuggcaaaaaguucaagcaguaucgggaauugaaaccacagacguguacuauuugcgagaccaaucccguuaacgcgaucgacgcugagaugcacgaucugaauuguaguuacaacaucugcccuuauugugccagccgccuaacaucugacggucucgcaagacaugugaugcagugcccaaagaggaaagaaaagauugaggaaacugagcuguaccuuaaucuggaacggauacccugggucgugcgcaaauugcuccaaguguccgagucaaccggggucgcccugaagcgaagcaguugguuaguuauccugcucgugcuucugacaguaucuuuguccccugugcagagcgcuccaauuucg

SEQ ID NO: 10708 - RNA, 972 nt, Artificial Sequence
  derived and/or modified CDS sequence (opt3) from CCHFV(SPU 18/88)__KJ682810.1__Gn
agcgaggaauccaacgacgauugccugucuagaacccagcuccuuaggacagagaaugccgaaauccacucagacaacuacggcgggcccggagauaagauuacuauauguaaugguaguacgaucguggaccaacggcugggcagcgaguuggggugcuauaccauuaaccgcgucaaauccuucaaguuaugugaaaauucugcuacaggaaaaucgugcgagaucgauucaacuccuguucgaugucgucagggcuuuugccugaagauuacccaggaggguagagggcaugugaaacuaagcaggggaagugaaguagugcucgacgcaugugauuccucuugcgagaucaugauaccaaagggcacaggcgacauccuggucgauuguagcgggggacagcaacacuuccuuaaggacaaccugguggauuuggguugcccgaauauuccccuccugggcaaaauggccaucuacauuugucggauguccaaccauccuaagaccacuaugggguuucuguucugguuuucauucggauauguuaucacaugcauacucugcaaagugaucuuuuacuuacugauugucgugggcacccuugguaagaaauucaagcaguaucgcgaauugaagccacagacguguacuauuugcgagaccaaucccguaaacgcgaucgacgcugagaugcacgaucugaauuguaguuacaacaucugcccuuauugugccagcagacuaacaucugacgggcucgcaaggcauguuaugcagugcccaaaacggaaggagaaaauugaagaaacugagcuguaccuuaaucuggaacgcauacccugggugguccgaaaguugcuccaaguguccgagucaaccggaguggcccugaaaagaagcaguugguuagucauccugcucguucuucugacagugucuuuguccccuguacagagcgcuccaauuucg

SEQ ID NO: 10709 - RNA, 972 nt, Artificial Sequence
  derived and/or modified CDS sequence (opt3) from CCHFV(SPU 48/90)__KJ682813.1__Gn
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaagagcuucaaauugugugaaaauuccgcuacuggcaaaucuugcguuauugauucggugccaguaaagugucgacaggguuacugcuuacguaucacccaggaggggagaggacaugugaaacugucaaggggcagcgaggucgugcuagacgcaugugauacaaguugcgaaauaaugaucccgaagggcaccggggacauucucguugauuguuccggaggucagcaacacuuucugaaggacaaccuuaucgaucugggcugccccaaaauuccuuugcucgggaagauggccaucuauauaugucggaugucuaaucauccaacuacaaccauggcguuccuguuuugguucagcuuuggauacgugauuacgugcauccugugcaaagcuauuuucuaucucuuaaucaucauuggcacucuggguaagcgcuuuagacaguacagggagcuuaaaccccagaccuguacaauaugcgaaacuaccccugucaacgccaucgacgcagagaugcacgauuugaauuguuccuauaacauuugcccauacugugccucacggcugacaagugacgggcuagcucgccaugugacccagugccccaagcgaaaggagaaaguagaagagacggaacucuaccugaaucuugagagaaucccuuggguugugaggaagcuguugcaagucagcgaaucuacuggaguggcacucaaacgguccucauggcugauaguguuacugguccucuucacaguuagccuuaguccagugcagucugccccgauuggc

SEQ ID NO: 10710 - RNA, 972 nt, Artificial Sequence
  derived and/or modified CDS sequence (opt3) from CCHFV(SPU 187/90)__KJ682814.1__Gn
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaagagcuucaaauugugugaaaauuccgcuacuggcaaaucuugcgagauugauucgguuccagugaagugucgacaggguuacugcuuacguaucacccaggaggggagaggacauguaaaacugucaaggggcagcgaagugguccuagacgcaugugauacaaguugcgagauaaugaucccgaagggcaccggggacauucucguggauuguuccggaggucagcaacacuuucugaaggacaaccuuaucgaucugggcugccccaaaauuccuuugcucgggaagauggccaucuauauaugucggaugucuaaucauccaaaaacuacaauggcguuccuguuuugguucagcuuuggauacguuauuaccugcauccugugcaaggcuauuuucuaucucuuaaucaucauuggcacgcuggguaaacgcuuuaagcaguacagagaacuuaagccccagacuuguaccauaugcgagacaacuccugugaacgccaucgacgcagagaugcacgauuugaauuguuccuauaacauuugcccauacugugccucaaggcugaccagugacgggcuagcucggcaugucacacagugccccaaacgcaaggaaaaaguggaggaaaccgagcucuaccugaaucuugaacgaaucccuuggguaguuagaaagcuguugcaagugagcgagucuacgggagucgcacucaaaagguccucauggcugauaguguuacugguccucuucacugugagccuuaguccaguucagucugccccgauuggc

SEQ ID NO: 10711 - RNA, 972 nt, Artificial Sequence
  derived and/or modified CDS sequence (opt3) from CCHFV(Haskovo-V46/13)__KR092379.1__Gn
agcgaggaacugggcgacgauugcaucuccagaacccagcuccuuaggacagagacugccgaaauucacgacgauaacuacgggggacccggugacaagauaacgaucuguaauggcucuaccauuguggaucaacggcuggggucagaguugggaugcuauacaaucaaccgcggcaaaaguuucaaguuaugugaaaauagcgcuacugguaaaaccugcgagauugacuccacaccugucaagugucgacagggguuuugccugaaaaucacccaggagggacguggccauguuaagcuaucuagaggcucggaagugguacucgaugcaugugacucaagcugcgaggugaugauaccaaaggggacuggagauauccuggucgacuguagugguggccagcaacacuuccuuaaagauaaccugauugacuuggggugcccgcauaucccccuccugggaaagauggccauuuacaucuguaggauguccaaucacccucggacaaccauggcguuucuguucugguuuucuuucggcuaugugauaacgugcaucuuuugcaaagcucucuucuacagcuuaauuauuaucgguacucuggggaagaaaaucaagcaguaucgcgaacuuaagccacagaccuguacaauuugcgagacuacccccguuaacgccauagaugcagagaugcaugacuugaauuguuccuacaacaucugcccuuauugugccucaagacugacaagugacggacuagcuaggcacgugacccagugcccaaaacggaaggaaaaagucgaggaaacggagcucuaccugaaucuugaacgcauucccuggaucgugcgaaagcuguugcaaguaagcgagucuacuggcguugcacucaaaagauccucauggcugauaguguuacugguccuccuuccugugagccugaguccagugcagucugccccggucggc

SEQ ID NO: 10712 - RNA, 972 nt, Artificial Sequence
  derived and/or modified CDS sequence (opt3) from CCHFV(24-R-2012)__KR814856.1__Gn
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacacuucaugcgaggucaugauaccgaagggcacaggggauauccucguggacuguagcggaggucagcaacacuuccugaaagauaaccuuauugaccugggcugcccccauaucccuuugcucgggaagauggccauuuacaucuguaggaugaguaaucacccacggaccacgauggcguuucuguucugguuuuccuucggauauguuauaacuugcaucuuuugcaaagcucuguucuacucucucauuauuaucggcaccuuagguaagaaaaucaagcaguaucgcgaacugaagccccagacauguacuauuugcgagaccgccccugugaacgcaauagaugccgagaugcaugaccuuaauuguagcuacaacaucugcccauauugugcuuccagauugacaucagacgggcuggcaaggcacgucccccagugcccuaaacggaaggaaaaaguggaggaaaccgagcuauaccucaaucuggaacgcauuccauggaucguacgaaaacuucugcaaguuagugagagcacgggaguggccuugaagagaucuuccuggcucauaguccuguuagugcugcucacugugucacuuagcccgguccagagugcucccguuggc

SEQ ID NO: 10713 - RNA, 972 nt, Artificial Sequence
  derived and/or modified CDS sequence (opt3) from CCHFV(36-ST-2014)__KR814857.1__Gn
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuacagccucauuaucaucggcacuuuagguaaaaagauuaagcaguaucgggaacugaaaccccagaccuguacaauaugcgagacugccccuguuaacgcaaucgaugccgagaugcaugaccuuaauuguuccuacaacauuugcccauauugugcuucacgcuugaccagugacgggcuggcaagacacgugacacagugccccaagaggaaagaaaaggucgaggaaaccgagcuauaccucaaucuggaacggaucccuuggauagugcgcaaacuucugcaaguaagcgagucuacgggaguugccuugaagcgauccucauggcucauugugcuguuaguccugcucacugugagccuuaguccagugcagucugcuccggucggc

SEQ ID NO: 10714 - RNA, 972 nt, Artificial Sequence
  derived and/or modified CDS sequence (opt3) from CCHFV(44-ST-2010)__KR814859.1__Gn
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucugcugugguucucuuuuggauaugugauuacgugcaucuucugcaaggcucucuuuuacagcuuaauuaucaucggcacucuggguaaaaagauuaagcaguaucgggaacuuaaaccccagaccuguacaauaugcgagacugccccuguuaacgcaaucgaugccgagaugcaugacuugaauuguuccuacaacauuugcccauauugugcuucacgccugaccagugacgggcuagcaagacacgugacacagugccccaagaggaaagaaaaggucgaggaaaccgagcucuaccugaaucuugaacggaucccuuggauagugcgcaaacuguugcaaguaagcgagucuacgggaguugcccucaagcgauccucauggcugauuguguuacugguccuccuuacugugagccugaguccagugcagucugcuccggucggc

SEQ ID NO: 10715 - RNA, 972 nt, Artificial Sequence
  derived and/or modified CDS sequence (opt3) from CCHFV(47-ST-2013)__KR814861.1__Gn
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauuguguaagaauagcgcuacuggcaaaaccugcgaaauugacuccacaccaguuaagugucgccaggguuuuugcuuaaagaucacccaggaggggcgaggacaugugaaacugucucguggcucggagguagugcuagaugcaugugacucaagcugcgaaauaaugaucccgaagggcacuggggauauucucgucgacuguaguggaggucagcaacacuuccugaaagauaaccuuaucgaccugggcugcccccauauuccuuugcucgggaagauggccaucuacauauguagaauguccaaucacccaaggacaaccauggcguuucuguucugguuuucuuucggauaugugauuacgugcaucuuuugcaaagcucuguucuacagccucauuaucaucggcacuuuagguaagaagauuaaacaguaucgggagcugaagccccagaccuguacaauaugcgaaacugccccuguuaacgcaaucgaugccgagaugcaugaccuuaauuguuccuacaacauuugcccauauugugcuucacgcuugaccagugacgggcuggcaagacacgugacacagugccccaaaaggaaggagaaagucgaagagaccgaacuauaccucaaucuggagcggaucccuuggauagugcgcaaacuucugcaaguaagcgaaucuacgggaguugccuugaagcgauccucauggcucauugugcuguuaguccugcucacugugagccuuaguccagugcagucugcuccggucggc

SEQ ID NO: 10716 - RNA, 972 nt, Artificial Sequence
  derived and/or modified CDS sequence (opt3) from CCHFV(52-R-2014)__KR814862.1__Gn
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacacuucaugcgaggucaugauaccgaagggcacaggggauauccucguggacuguagcggaggucagcaacacuuccugaaagauaaccuuauugaccugggcugcccccauguuccuuugcucgggaagauggccaucuacauuuguaggaugaguaaucacccacggaccacgauggcguuucuguucugguuuuccuucggauaugugaucacuugcauauuuugcaaagcucuguucuacucucucauuaucauuggcaccuuagguaagaaaaucaagcaguaucgcgaacugaagccccagacauguacuaucugcgagaccgccccugucaacgcaauugaugccgagaugcaugaccuuaauuguagcuacaacauaugcccauauugugcuuccagauugacaucagacgggcuggcaaggcacgugccccagugcccuaaacggaaggaaaaaguagaggaaaccgagcuauaccucaaucuggaacgcaucccauggauuguucgaaaacuucugcaagugagugagagcacgggagucgccuugaagagaucuuccuggcucaucgugcuguuagugcugcucacugucucacuuagcccgguucagagugcucccgugggc

SEQ ID NO: 10717 - RNA, 972 nt, Artificial Sequence
  derived and/or modified CDS sequence (opt3) from CCHFV(75-R-2012)__KR814863.1__Gn
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccgcaccaguuaagugucgacaggguuuuugcuuaaaaaucacacaggaggggcguggacaugugaagcugucuagaggcucggaaguagugcuagaugccugugacucaagcugcgaggucaugauaccgaagggcaccggggauauccucguggacuguaguggaggucagcaacacuuccugaaagauaaccuuauugaccugggcugcccccauaucccuuugcucgggaagauggcgauuuacaucuguaggauguccaaucacccacggacuacaauggcuuuucuguucugguuuucuuucggauauguuauaaccugcaucuuuugcaaagcccuguucuacagccucauuauuaucggcacguuagguaagaaaaucaagcaguaucgcgaacugaagccccagacuuguaccauuugcgagacagcaccugugaacgccauagaugcugagaugcaugaccuuaauuguuccuacaacaucugcccauauugugcaucaagauugaccagugacgggcuggccaggcacgucccccagugcccuaaacggaaggaaaaaguggaggaaacugagcuauaccucaaucuggaacgcauuccauggaucguacgaaaacuucugcaaguuagcgagucuacaggaguggcuuugaagagauccucauggcucauaguccuguuagugcugcucaccgugagccuuaguccgguccagucugcccccguuggc

SEQ ID NO: 10718 - RNA, 972 nt, Artificial Sequence
  derived and/or modified CDS sequence (opt3) from CCHFV(75-ST-2010)__KR814864.1__Gn
agcgaggaauccggcgacgauugcaucucuagaacccagcugcucaggacagagacugccgaaauucacgacgauaacuacgggggacccggugacaagauaacgaucuguaauggcucaaccauuguggaucaacggcuugggagugagcugggaugcuauacaaucaaccgcgucaagagcuucaaauugugugaaaauuccgcuacuggcaaaaccugcgagauugacucuacaccuguuaagugucgacaggguuuuugcuuaaaaaucacccaggaggggcguggacaugugaagcugucgagaggcucagaaguagugcuagaugcaugugacagcaguugcgaggucaugauaccaaagggcacuggggauauccucguggacuguuccggaggucagcaacacuuccugaaagauaaccuuauugaccugggcugcccgcauauccccuugcucgggaagauggccauuuacaucuguaggaugucuaaucacccucggacaaccauggcguuucuguucugguuuagcuucggauauguuauaacgugccuguuuugcaaagcucucuucuacuccuuaauuaucauuggcacucuggguaagaaaaucaagcaguaucgcgaacuuagaccacagaccuguacaaucugcgagacugcccccgugaacgcaauugaugccgagaugcaugacuugaauuguucauacaacauaugcccuuauugugcuaguaggcugaccagcgacgggcuagcacggcacgucccacagugccccaagcgcaaagaaaagguggaggaaacagagcucuaccugaaucuugaacgaaucccuuggauuguaagaaaacuguugcaaguuucugaguccaccggaguggcccucaagaggucaagcuggcugaucgucuuacuggugcuccuuacggugagucugucuccaguccaguccgcuccgguuggc

SEQ ID NO: 10719 - RNA, 972 nt, Artificial Sequence
  derived and/or modified CDS sequence (opt3) from CCHFV(3820-ST-2007)__KR814868.1__Gn
agcgaggaacccggcgacgauugcaucuccagaacccagcugcucaagacagagacugccgaaauucacgacgauaacuacgggucuccuggagacaaaauaacgaucuguaaugguucaaccauuguggaucaaaggcuuggcagugagcuggggugcuauacaaucaaccgggucaagagcuucaaauugugugaaaauuccgcuacuggaaagaccugcgagauugacucuacaccaguuaaaugucgccagggcuuuugcuuaaagaucacccaggagggucgagggcaugugaagcugucgcguggaucagaaguagugcuagaugcaugugacagcaguugcgagauaaugaucccgaaaggcacuggcgauauucucgucgacuguuccgggggacagcaacacuuccugaaggauaaccuuaucgaccuggguugcccccauauuccuuugcucggcaaaauggccaucuacauauguagaaugucuaaucacccaaggacaaccauggcguuucuguucugguuuagcuucggguaugugauuacgugcaucuuuugcaaggcucuguucuacucccucauuaucaucggaacuuuaggcaaaaagauuaagcaguaucgggaacugaaaccccagaccuguacaauaugcgagacugccccuguuaacgcaaucgaugccgagaugcaugaccuuaauuguucauacaacauuugcccauauugugcuagucgcuugaccagcgacggucuggcaagacacgugacacagugccccaagaggaaagaaaaggucgaggaaaccgagcuauaccucaaucuggaacggaucccuuggauagugcgcaaacuucugcaaguaucugaguccacggggguugccuugaagcgaucaagcuggcucauugugcuguuaguccugcucgcugugagucuuucuccagugcaguccgccccggucgga

SEQ ID NO: 10720 - RNA, 972 nt, Artificial Sequence
  derived and/or modified CDS sequence (opt3) from CCHFV(4701-ST-2009)__KR814872.1__Gn
agcgaggaacccggcgacgauugcaucuccagaacccagcugcucaagacagagacugccgaaauucacgacgauaacuacgggggaccuggugacaaaauaacgaucuguaauggcucuaccguggucgaucaaaggcuugggucagagcugggaugcuauacaauuaaccggguuaagaguuucaaauugugugaaaauagcgcuacuggcaagaccugcgagaucgacuccacaccagugaaaugucgccaggguuuuugcuuaaagauuacccaggaggggcgaggacauguaaagcugucucguggcucggaagugguccuagaugcaugugacucaagcugcgagaucaugauaccgaaaggcacuggggauauccucguggacuguaguggaggucagcaacacuuccugaaggauaaccuuauugaccugggcugcccccauaucccuuugcucgggaaaauggccauuuacaucuguagaauguccaaucacccaaggacaaccauggcguuucuguucugguuuucuuucggauauguuauaacgugcaucuuuugcaaggcucuguucuacagccucauuauuaucggcacuuuagguaaaaagaucaagcaguaucgggaacugaaaccccagaccuguacaauuugcgagacugccccugugaacgcaauagaugccgagaugcaugaccuuaauuguuccuacaacaucugcccauauugugcuucacgcuugaccagugacgggcuggcaagacacgucacacagugccccaagaggaaagaaaagguggaggaaaccgagcuauaccucaaucuggaacggauuccuuggaucguacgcaaacuucugcaaguuagcgagucuacgggaguggccuugaagcgauccucauggcucauaguccuguuagugcugcucacugugagccuuaguccaguccagucugcuccgguuggc

SEQ ID NO: 10721 - RNA, 972 nt, Artificial Sequence
  derived and/or modified CDS sequence (opt3) from CCHFV(5170-R-2011)__KR814873.1__Gn
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugucugugacucaagcugcgagauaaugaucccgaaaggcacuggggauauucucguggacuguaguggaggucagcaacacuuccugaaggauaaccuuaucgaccugggcugcccccauauuccuuugcucgggaaaauggcaaucuacauauguagaauguccaaucacccaaggacaaccauggccuuucuguucugguuuucuuucggauauguuauuacgugcaucuuuugcaaggcgcuguucuacagccucauuaucaucggcacuuuagguaaaaagauuaagcaguaucgggaacugaaaccccagaccuguacaauaugcgagacugcuccugugaacgccaucgaugcagagaugcaugaccuuaauuguuccuacaacauuugcccauauugugccucacgcuugaccagugaagggcuggcuagacacgucacacagugccccaagaggaaagagaagguggaagagaccgaacuauaccucaaucuggagcggaucccuuggauaguacgcaaacuucugcaaguuagcgagucuacgggaguggcauugaagcgauccucauggcucauuguccuguuagugcugcucacugugagccuuaguccaguccagucugccccgguuggc

SEQ ID NO: 10722 - RNA, 972 nt, Artificial Sequence
  derived and/or modified CDS sequence (opt3) from CCHFV(200406546-Turkey)__KR864902.1__Gn
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugucugugacucaagcugcgaggugaugauaccgaagggcacuggggauauccucguugacuguaguggaggucagcaacacuuccugaaagauaaccuuauugaccugggcugcccccaugugccuuugcucgggaggauggcaaucuacauuugucggauguccaaucacccacgcacaaccauggccuuucuguucugguuuucuuucggauaugucaucacgugcauauuuugcaaggcgcuguucuacagccucauuaucauuggcacuuuagguaaaaaguuuaaacaguauagagaacugaagccccagaccuguacaaucugcgagacugcuccugugaacgccaucgaugcagagaugcaugaccuuaauuguuccuacaacauuugcccauauugugccucaagguugaccagugacgggcuggcucggcacguaccccagugcccuaagcgcaaagaaaagguugaggaaacagagcuauaccucaaucuggaacgaauaccauggaucgugagaaaacuucugcaagucagcgagucuaccggaguggcauugaagagguccucauggcucauugugcuguuaguccugcucacgguuagccuuaguccggugcagucugcccccguaggc

SEQ ID NO: 10723 - RNA, 972 nt, Artificial Sequence
  derived and/or modified CDS sequence (opt3) from CCHFV(1-CR/HU-2015)__KU161584.1__Gn
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuuccugaaagauaaccuuauugaccugggcugcccccauaucccuuugcucgggaagauggccauuuacaucuguaggauguccaaucacccacggacaaccauggcguuucuguucugguuuucuuucggauauguuauaacgugcaucuuuugcaaagcucuguucuacagccucauuauuaucggcacuuuagguaagaaaaucaagcaguaucgcgaacugaagccccagaccuguacaauuugcgagacugccccugugaacgcaauagaugccgagaugcaugaccuuaauuguuccuacaacaucugcccauauugugcuucaagauugaccagugacgggcuggcaaggcacgucacacagugccccaaacggaaggaaaaaguggaggaaaccgagcuauaccucaaucuggaacgcauuccuuggaucguacgaaaacuucugcaaguuagcgagucuacgggaguggccuugaagagauccucauggcucauaguccuguuagugcugcucacugugagccuuaguccaguccagucugcuccgguuggc

SEQ ID NO: 10724 - RNA, 972 nt, Artificial Sequence
  derived and/or modified CDS sequence (opt3) from CCHFV(Gaib)__KX013445.1__Gn
agcgaggaauccucugacgauugcaucucaagaacccagcugcucaggacagagacugccgaaauucacaacgacaauuacggcgggcccggagauaagauaacgaucuguaacgguaguaccauuguggaccaacggcuuggcagcgagcuggggugcuauacaaucaaucgcgucaaauccuucaaguugugugaaaacucugcuacuggaaaaucgugcgagauugauucaaucccuguuaagugucgacagggcuuuugcuuaaaaauaacccaggagggucgugggcaugugaagcugagcagaggaagugaaguagugcuagacgcaugugauuccucuugcgagaucaugauuccaaagggcacaggcgacauccucgucgauuguagcgggggacagcaacacuuccugaaagacaaucuuauugaucuggguugcccgaacauccccuugcucggcaagauggccauauacauuuguaggauguccaaucauccuaaaaccacuauggcguuucuguucugguuuucauucggguaugugaucacaugcaucuuuugcaaggcuauuuucuaccugcucaucauuguuggaaccuuaggcaaaaaguuuaagcaguaucgggaacugaaaccacagacguguacuauaugcgagaccacacccgugaacgccaucgacgcagagaugcacgaucuuaauuguaguuacaacauuugcccuuauugugccagccgcuugacuucugacggucuggcuagacaugucgugcacugcccaaagaggaaagaaaagaucgaggaaaccgagcuauaccucaaucuggaacggguacccuggguugugcgcaaacuucugcaggucuccgagucaacagggguggcauugaagcgaagcaguuggcucauagugcuguuaguccugcucaccguuucucuuuccccugugcaaagcgccccaauugga

SEQ ID NO: 10725 - RNA, 972 nt, Artificial Sequence
  derived and/or modified CDS sequence (opt3) from CCHFV(Hodzha)__KX013448.1__Gn
agcgaggaauccggcgacgauugcaucucuagaacccagcugcucaggacagagacugccgaaauucacggggacgauuacggaggucccggcgacaagauaacgaucuguaacgggucaaccauuguggaucaacggcuuggaagugagcugggcugcuauacaaucaaucgcgucaagagcuucaaauugugugaaaacuccgcuacugguaaaucuugcgagauugacucgaccccuguuaagugucgacagggguacugcuuaaaaaucacacaggagggacguggccaugugaagcugucaagaggcagcgaaguagugcuagaugcaugugacaguuccugcgaggucaugauaccaaaggggaccggagauauccucguggacuguucugguggccagcaacacuuucugaaagauaaucuuauugaccuggggugcccgaggauccccuugcucggaaagauggccauuuauaucugucggaugagcaaccauccugaaacuacaauggcguuccuguuuugguucuccuuuggcuacguuauaaccugcauucugugcaaagcuaucuucuaucucuuaauuaucguggguacgcuggggaagcgcuuuaaacaguacagagagcuuaagccacagacuuguaccaucugcgagacaacucccgccaaugcaauugaugccgaaaugcacgacuugaacuguucauauaauauaugcccuuacugugcuaguaggcugaccagcgacggacuagcacggcaugucacacagugcccaaagcgcaaagagaagguggaagagaccgaacucuaccugaaccuugagcgaauccccuggauuguaagaaaacuguugcaaguuucugaguccacgggcguggcccucaagaggucaagcuggcugaucgucuuacugguccucuucgcugugagucuuucuccugugcaguccgccccaauaggc

SEQ ID NO: 10726 - RNA, 972 nt, Artificial Sequence
  derived and/or modified CDS sequence (opt3) from CCHFV(IbAn7620)__KX013451.1__Gn
agcgaggaacccuccgacgauugcaucucuagaacccagcugcucaggacagagacugccgaaauucacggcgacaacuacgggggaccuggugauaagauaacgaucuguaauggcucaaccauuguggaccaacggcuugggagugagcugggaugcuauacaaucaaccgcgucaagagcuucaaauugugugaaaauuccgcuacuggcaaaaacugcgagauugauucuguuccagugaagugucgacaggguuacugcuuacguaucacccaggaggggagaggacauguaaaacugucgaggggcucagaaauagugcuagacgcaugugauacaagcugcgagaucaugauuccgaagggcaccggggacauccucgucgauuguaguggaggucagcaacacuuucugaaggacaaucuuauugaucugggcugccccaaaaucccuuugcucgggaagauggccauauauauuugucggauguccaaccauccaaaaacuacaauggcguuccuguuuugguucucuuuuggauacgugauuaccugcauucugugcaaggcuaucuucuaucucuuaaucauuauaggcacgcuggguaaacgccuuaagcaguacagagaauugaagccccagacuuguaccaucugcgagacaacuccuguuaaugccauugacgcagagaugcacgaucugaacuguagcuauaauaucugcccauacugugccuccaggcuaaccucagacgggcucgcucggcaugugauacagugccccaaacgcaaggaaaaagucgaggaaacagagcuguaccuuaaccuggaacgaaucccuugggugguaagaaaguugcuccaaguuagugagagcaccggaguggcacugaaaaggucuuccugguuaaucguccugcucgugcuuuuuacggugucacugagcccaguccagagugccccgaucggc

SEQ ID NO: 10727 - RNA, 972 nt, Artificial Sequence
  derived and/or modified CDS sequence (opt3) from CCHFV(K128_76)__KX013454.1__Gn
agcgacgaguccggcgaugacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaaauccuucaaguugugugagaauagcgcuacugguaaaucuugcgaaauugacucgaucccuguuaagugucgacagggguacugcuuaaaaauaacccaggagggacguggccaugugaagcugucaagaggcagcgagguagugcuagaugcaugugacaguuccugcgaagucaugaucccaaaggggacaggagauauucucguggacuguucugguggccagcaacacuuucugaaagauaaccuuaucgaccuggggugcccgaagauucccuugcucggaaaaauggccaucuauauauguaggaugagcaaucauccuaagaccacuauggcguuccuguuuugguucuccuuuggcuacguuauuacaugcaucgugugcaaagcuauuuucuaucugcucaucaucgucgguaccuuagggaagcgguuuaagcaguaccgcgagcugaaaccacagacguguacuauuugcgaaaccacacccacuaacgccauagaugcagagaugcacgaccuuaauuguucauauaacaucugcccuuacugugccaguagauugaccagcgacggacuggcuaggcaugugacacacugcccaaagcggaaagagaagguagaagagaccgaacuauaccucaaucuggagcgcauucccuggguugugcgaaaacuucugcaggucucugaauccacgggcguggcauugaagagaucaagcuggcucaucgugcuguuaguccuguucgccguuagucucucuccugugcaauccgcuccaauaagc

SEQ ID NO: 10728 - RNA, 972 nt, Artificial Sequence
  derived and/or modified CDS sequence (opt3) from CCHFV(K168_40)__KX013457.1__Gn
agcgacgaguccggcgaugacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaaauccuucaaguugugugagaauagcgcuacugguaaaucuugcgaaguugacucgauuccugugaagugucgacagggguacugcuuaaaaaucacccaggagggacguggccauguaaagcugucaagaggcagcgaggugguccuagaugcaugugacaguuccugcgaagugaugauaccaaaggggacaggagauauccucguugacuguucugguggccagcaacacuuucugaaagauaaccuuauugaccuggggugcccgaagauccccuugcucggaaaaauggccauuuauaucuguaggaugagcaaucauccuaagaccacuauggcguuccuguuuugguucuccuuuggcuacgugauaacaugcauugucugcaaagcuaucuucuaucugcucauuaucguggguaccuuagggaagcgguuuaagcaguaccgcgagcugaaaccacagacguguacuaucugcgaaaccacacccacuaacgccauugaugcagagaugcacgaccuuaauuguucauauaacauaugcccuuacugugccaguagauugaccagcgacggacuggcuaggcauguaacacacugcccaaagcggaaagagaagguugaagagaccgaacuauaccucaaucuggagcgcauccccugggugguccgaaaacuucugcaagugucugaauccacgggcguggcauugaagagaucaagcuggcucauuguccuguuaguucuguucgccgugagucucucuccuguacaguccgcuccaaucggc

SEQ ID NO: 10729 - RNA, 972 nt, Artificial Sequence
  derived and/or modified CDS sequence (opt3) from CCHFV(K168_125)__KX013460.1__Gn
agcgacgaguccggcgaugacugcaucucuagaacccagcugcucaggacagaaacugccgagauucacggggauaacuacggaggucccggcgacaagauaacgaucuguaaugggucaaccauuguggaucaacggcuuggaagugaacugggcugcuauacaaucaaccgcgucaaauccuucaaguugugugagaauagcgcuacugguaaaucuugcgaaguugacucgauuccugugaagugucgacagggguacugcuuaaaaaucacccaggagggacguggccauguaaagcugucaagaggcagcgaggugguccuagaugcaugugacaguuccugcgaagugaugauaccaaaggggacaggagauauccucguugacuguucugguggccagcaacacuuucugaaagauaaccuuauugaccuggggugcccgaaggugcccuugcucggaaaaauggccaucuauauuuguaggaugagcaaucauccuaagaccacuauggcguuccuguuuugguucuccuuuggcuacgucaucacaugcauagugugcaaagcuauuuucuaucugcucaucauuguagguaccuuagggaagcgguuuaagcaguaccgcgagcugaaaccacagacguguacuaucugcgaaaccacacccacuaacgccaucgaugcagagaugcacgaccuuaauuguucauauaacauuugcccuuacugugccaguagauugaccagcgacggacuggcuaggcauguuacacacugcccaaagcggaaagagaagguggaagagaccgaacuauaccucaaucuggagcgcauacccugggucgugcgaaaacuucugcaagugucugaauccacgggcgucgcauugaagagaucaagcuggcucaucguucuguuagugcuguucgccguaagucucucuccugugcaguccgcuccaauuggc

SEQ ID NO: 10730 - RNA, 972 nt, Artificial Sequence
  derived and/or modified CDS sequence (opt3) from CCHFV(K229_194)__KX013463.1__Gn
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaagggcaaccuuaucgaucuggggugcccccauauuccuuugcucggaaaaauggccaucuacauauguagaauguccaaucacccaaggacaaccauggcguuucuguucugguuuucuuucggcuaugugauuacgugcaucuuuugcaaggcucuguucuacagccucauuaucaucgguacuuuagggaaaaagauuaagcaguaucgggaacugaaaccccagaccuguacaauaugcgagacugccccuguuaacgcaaucgacgccgagaugcaugaucuuaauuguuccuacaacauuugcccauauugugcuucacgcuugaccagugacggacuggcaagacacgugacacagugccccaagaggaaagaaaaggucgaggaaaccgagcuauaccucaaucuggaacggaucccuuggauagugcgcaaacuucugcaaguaagcgagucuacgggcguugccuugaagcgauccucauggcucauugugcuguuaguccugcucacugugagccuuaguccagugcagucugcuccggucggc

SEQ ID NO: 10731 - RNA, 972 nt, Artificial Sequence
  derived and/or modified CDS sequence (opt3) from CCHFV(K315_14)__KX013469.1__Gn
agcgaggaacccggcgacgauugcaucuccagaacccagcugcucaagacagagacugccgaaauucacgacgauaacuacgggggaccuggugacaaaauaacgaucuguaauggcucuaccguggucgaucaaaggcuugggucagagcugggaugcuauacaauuaaccggguuaagaguuucaaauuguguaagaauagcgcuacuggcaaaaccugcgaaaucgacuccacaccagugaagugucgccaggguuuuugcuuaaagauuacccaggaggggcgaggacauguaaaacugucucguggcucggaggugguccuagaugugugugacucaagcugcgaaaucaugauaccgaagggcacuggggauauccucguugacuguaguggaggucagcaacacuuccugaaagauaaccuuauugaccugggcugcccccauaucccuuugcucgggaagauggcaauuuacaucuguagaauguccaaucacccaaggacaaccauggccuuucuguucugguuuucuuucggauaugugauaacgugcaucuuuugcaaagcgcuguucuacagccucauuauuaucggcacuuuagguaagaagaucaaacaguaucgggagcugaagccccagaccuguacaauuugcgaaacugcuccugucaacgccauagaugcagagaugcaugaccuuaauuguuccuacaacaucugcccauauugugccucacgcuugaccagugaggggcuggcuagacacgugacacagugccccaaaaggaaggaaaaaguagaggaaaccgagcuauaccucaaucuggaacggauuccuuggaucguucgcaaacuucugcaagugagcgagucuacgggagucgcauugaagcgauccucauggcucauagugcuguuagugcugcucacugucagccuuaguccaguucagucugccccggugggc

SEQ ID NO: 10732 - RNA, 972 nt, Artificial Sequence
  derived and/or modified CDS sequence (opt3) from CCHFV(K323_27)__KX013472.1__Gn
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuaccucuuaauuaucaucggcacucuggguaaaaagauuaagcaguaucgggaacuuaaaccccagaccuguacaauaugcgagacugccccuguuaacgcaaucgaugccgagaugcaugacuugaauuguagcuacaacauuugcccauauugugcuucccgccugaccucagacgggcuagcaagacacgugacacagugccccaagaggaaagaaaaggucgaggaaaccgagcucuaccugaaucuugaacggaucccuuggauagugcgcaaacuguugcaaguaagugagagcacgggaguugcccucaagcgaucuuccuggcugacuguguuacugguccuccuuacagugucacugagcccagugcagagugcuccggucggc

SEQ ID NO: 10733 - RNA, 972 nt, Artificial Sequence
  derived and/or modified CDS sequence (opt3) from CCHFV(K340_6)__KX013475.1__Gn
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcacuaccggcaagacaugcgagauugacuccaccccaguuaaaugucgccaggguuuuugcuuaaagaucacucaggaggggcgaggacaugugaagcugucucguggcucggaaguagugcuagaugcuugugacucaagcugcgagauaaugaucccgaaaggcacaggggauauucucgucgacuguaguggaggucagcaacacuuccugaaggauaaccuuaucgaccugggcugcccccauauuccuccauuggggaaaauggcaaucuacauauguagaauguccaaucaccccaggaccacgauggccuuucucuucugguuuucuuucggauaugugauuacuugcaucuuuugcaaggcgcuguucuacagccugauuaucaucggcacccucgguaaaaagauuaagcaguaucgggaauuaaaaccucagacauguacuauaugcgagaccgcuccaguuaacgccaucgaugcagagaugcaugaccugaauuguuccuacaacauuugccccuauugugccucacgccuuacaagugacggguuggcuagacacgugacccagugcccuaagaggaaagaaaaggucgaggaaacggagcuguaccuaaaucucgaacggaucccauggauagugcgcaaacugcuucaaguaagcgagucuacuggaguugcacugaagcgauccucaugguugauugugcuccuggucuuacugacagugagccucaguccggugcagucugcccccgucggc

SEQ ID NO: 10734 - RNA, 972 nt, Artificial Sequence
  derived and/or modified CDS sequence (opt3) from CCHFV(Mamon)__KX013478.1__Gn
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugucagaugcaugugacagcaguugcgaggucaugauaccgaagggcacuggggauauccuaguggacuguuccggaggucagcaacacuuccucaaagauaaccugauugaccuuggcugcccccauaucccucuguuggggaagauggccauuuacaucuguaggaugucuaaucacccacggacaaccguugcguuucucuucugguuuagcuucggauaugugauaacgugcaucuuuugcaaagcucuguucuacucccugauuauuaucggcacucucgguaagaaaaucaagcaguaucgcgaauuaaagccccagaccuguacaauuugcgagacugccccugucaacgcaauagaugccgagaugcaugaccugaauuguucauacaacaucugcccauauugugcuaguagacuuaccagcgacggguuggcaaggcacgugccccagugcccuaaacggaaggaaaaaguagaggaaacagagcuguaccuaaaucucgaacgcauuccauggaucguucgaaagcugcuucaagugucugaguccaccggagucgcccugaaaagaucaagcugguugauagugcuccugguguuacugacggucagucucucuccgguucaguccgcucccgugggc

SEQ ID NO: 10735 - RNA, 972 nt, Artificial Sequence
  derived and/or modified CDS sequence (opt3) from CCHFV(Nakiwogo)__KX013484.1__Gn
gccgagggcgugagcaacgacugcgucuccagaacccagcugaucaagacagaaguugcugagauucacgaagauucuuacgggggacccggugagaaaauaacuaucuguaauggcucaacgauuguggaccaaaggcucgggagugaacuuggaugcuauaccaucaaccggguaaagacauacaaacugugugagaauagcgcaacugagaagggcugcgaaauugauuccgugccugucaaauguaagcaggguuucugcuugaaggugacccaggaggggcgcggacauguuaaauuaucucgaggcacagaaaucgugcuggacgucugugauaccucgugcgagcuaaugauaccaaagggcacuggggacauccucguggauuguucaggaggucagcaacacuuucugcaggacaaccuuauugaucugggcugcccgaauguacccuugcucgggaaaauggccaucuauauuugucguaugagcaaccauccuaagacaaccauggcguuccuguuuugguucaguuuuggauacguuaucacgugcguggucugcaaagugcuguucuaucucuuaauagugauuggcacucuggguaagaaacuuaagcaguacagagaguugaagccacagaccuguaucgucugcgaauccauucccguuaaugugaucgacgcugagaugcacgaacugaacuguaauuauaacaucugcccuuacugugccucuaggcuaacaagcgaugggcucguacggcaugugacucaaugcccaaaacgcaaggagaaagucgaagagaccgagcuguaccuuaaucuggaaaggauucccugguuggugagacggcuccugcagguuuccgagucaacaggaauggcauuaaagcgcaguuguuggaugaccacgcugcucauacuucugguggucagcuugucuccugugcaguccgccccaguaggc

SEQ ID NO: 10736 - RNA, 972 nt, Artificial Sequence
  derived and/or modified CDS sequence (opt3) from CCHFV(Saf)__KX013487.1__Gn
agcgaggaacccggcgacgauugcaucuccagaacccagcugcucaggacagagacugccgaaauucacgacgauaacuacgggggaccuggugacaagauaacgaucuguaauggcucuaccauuguggaucaacggcuugggucagagcugggaugcuauacaaucaaccgcgucaaaaguuucaaguugugugaaaauagcgcuacuggcaaaaccugcgagauugacuccacaccaguuaagugucgacaggguuuuugcuuaaaaaucacccaggaggggcguggacaugugaagcugucuagaggcucggaaguagugcuagaugcaugugacucaagcugcgaggucaugauaccgaagggcacuggggauauccucguggacuguaguggaggucagcaacacuaccugaaagauaaccuuauugaccugggcugcccccauaucccuuugcucgggaagauggccauuuauaucuguaggauguccaaucacccacggacaaccauggcguuccuguuuugguucucuuuuggauacguuauaacgugcauuuucugcaaagcucuguuuuauagccucaucauuaucggcacuuuagguaagaaaaucaagcaguaccgcgaacugaagccccagaccuguacaauuugcgagacugccccugugaacgcaauagaugccgagaugcaugaccuuaauuguuccuauaacaucugcccauacugugcuucaagauugaccagugacgggcuggcaaggcacgucccccagugcccuaaacggaaggaaaaaguggaggaaacagagcuauaccucaaucuggaacgcauuccauggaucguacgaaaacuucugcaaguuagcgagucuaccggaguggccuugaagagauccucauggcucauaguccuguuagugcugcucacggugagccuuaguccgguccagucugcucccguuggc

SEQ ID NO: 10737 - RNA, 972 nt, Artificial Sequence
  derived and/or modified CDS sequence (opt3) from CCHFV(Ast199)__KX056051.1__Gn
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccaucuacauauguagaauguccaaucacccaaggacaaccauggcguuucuguucugguuuucuuucggauaugugauuacgugcaucuuuugcaaggcucuguucuacagccucauuaucaucggcacuuuagguaaaaagauuaagcaguaucgggaacugaaaccccagaccuguacaauaugcgagacugccccuguuaacgcaaucgaugccgagaugcaugaccuuaauuguuccuacaacauuugcccauauugugcuucacgcuugaccagugacgggcuggcaagacacgugacacagugccccaagaggaaagaaaaggucgaggaaaccgagcuauaccucaaucuggaacggaucccuuggauagugcgcaaacuucugcaaguaagcgagucuacgggaguugccuugaagcgauguuccuggcucauugugcuguuaguccugcucacugugucacuuagcccagugcagagugcuccggucggc

SEQ ID NO: 10738 - RNA, 972 nt, Artificial Sequence
  derived and/or modified CDS sequence (opt3) from CCHFV(Ast137)__KX056057.1__Gn
agcgaggaacccggcgacgauugcaucuccagaacccagcugcucaagacagagacugccgaaauucacgacgauaacuacgggggaccuggugacaaaauaacgaucuguaauggcucuaccauuguggaucaaaggcuugggucagagcugggaugcuauacaaucaaccgggucaagaguuucaaauugugugaaaauagcgcuacuggcaagaccugcgagauugacuccacaccaguuaaaugucgccaggguuuuugcuuaaagaucacccaggaggggcgaggacaugugaagcugucucguggcucggaaguagugcuagaugcaugugacucaagcugcgagauaaugaucccgaaaggcacuggggauauucucgucgacuguaguggaggucagcaacacuuccugaaggauaaccuuaucgaccugggcugcccccauauuccuuugcucgggaaaauggccauccacauauguagaauguccaaucauccaaggacaaccauggcguuucuguucugguuuucuuucggauacgugauuacgugcaucuuuugcaaggcucuguucuauagccucauuaucaucggcacuuuagguaaaaagauuaagcaguaccgggaacugaaaccccagaccuguacaauaugcgagacugccccuguuaacgcaaucgaugccgagaugcacgaccuuaauuguuccuauaacauuugcccauacugugcuucacgcuugaccagugacgggcuggcaagacacgugacacagugccccaagaggaaagaaaaggucgaggaaaccgagcuauaucucaaucuggaacggaucccuuggauagugcgcaaacuucugcaaguaagcgagucuacgggaguugccuugaagcgauccucauggcucauugugcuguuaguccugcucacugugagccuuaguccagugcagucugcuccggucggc

SEQ ID NO: 10739 - RNA, 972 nt, Artificial Sequence
  derived and/or modified CDS sequence (opt3) from CCHFV(Ast133)__KX056060.1__Gn
agcgaggaacccgacgaugacugcaucuccagaacccagcugcucaagacagagacugccgaaauucacgaugacaacuacggcgggccuggagauaaaauaacgaucuguaaugguucuaccauuguggaccaaaggcuuggcucagagcuggggugcuauacaaucaaccgggucaagaguuucaaauugugugaaaauagcgcuacuggaaagaccugcgagauugauuccacaccaguuaaaugucgccagggcuuuugcuuaaagaucacccaggagggucgagggcaugugaagcugucucguggaucggaaguagugcuagacgcaugugauucaagcugcgagauaaugaucccgaaaggcacuggcgacauucucgucgauuguagugggggacagcaacacuuccugaaggacaaccuuaucgaucuggguugcccccauauuccuuugcucggcaaaauggccaucuacauauguagaauguccaaucacccaaggacaaccauggcguuucuguucugguuuucuuucggguaugugauuacgugcaucuuuugcaaggcucuguucuaccucuuaauuaucaucggaacucugggcaaaaagauuaagcaguaucgggaacuuaaaccccagaccuguacaauaugcgagacugccccuguuaacgcaaucgacgccgagaugcaugacuugaauuguagcuacaacauuugcccauauugugcuucccgccugaccucagauggucuagcaagacacgugacacagugccccaagaggaaagaaaaggucgaggaaaccgagcucuaccugaaucuugaacggaucccuuggauagugcgcaaacuguugcaaguaagugagagcacggggguugcccucaagcgaucuuccuggcugauuguguuacugguccuccuuacugugucacugagcccagugcagagugcuccggucgga

SEQ ID NO: 10740 - RNA, 972 nt, Artificial Sequence
  derived and/or modified CDS sequence (opt3) from CCHFV(SK/2015/human)__KX458183.1__Gn
agcgaggaauccggcgacgauugcaucucuagaaccaggcugcuccggacagagacugccgaaauucacggggacucauacggaggucccggcgauaagauaacgaucuguaacgggaguaccauuguggaccagcgccuuggaagcgagaugggcugcuauacaaucaaucgagucaaauccuucaagcugugugaaaacucugcuacugguaaaucgugcgagauugauucaaucccuguucguuguagacaaggguacugcuugaagauaacccaggagggaaggggccaugugaaauuaagccggggcagugaaguagugcuggacgcaugugauuccucuugcgaggucaugaucccaaaggggacaggagacauucuaguggauuguagcgguggccagcagcacuuucucaaggacaaucugaucgaucuugggugcccgaacauuccccuguugggaaaaauggccaucuauauaugucgcauguccaaucauccuaagaccacuauggcguuccucuuuugguucucauuuggcuacguuauuacaugcauccugugcaaagcuauuuucuaucugcucaucaucguggguaccuuagggaagagauuuaaacaauacagggaacugaagccacagacguguacuauuugcgagaccacacccgccaacgcaauagacgccgagaugcacgaucuuaauuguaguuauacuaucugcccuuacugugcuagccgguugaccucugacggacuggcacgccaugucacacagugcccaaagcgaaaagaaaagguggaggaaaccgagcuauaccucaaccuggaaaggauucccuggguaguuagaaaacuucugcaaguguccgagucaacgggcgucgccuugaagcggagcaguuggcucaucgugcuguuagugcuguucacugucucucucuccccuguucagagcgcuccaauaggc

SEQ ID NO: 10741 - RNA, 972 nt, Artificial Sequence
  derived and/or modified CDS sequence (opt3) from CCHFV(YL16070)__KY354081.1__Gn
gccgagggcgggagcuccgacugcaucucuagaacccagcuggugaagacagaagucgcugagauucacgaagauucauacggaggucccggcgagaaaauaacuaucuguaacgggaguacgauuguugaccaaaggcucggaagcgaacuuggcugcuauaccaucaaucgggugaaguccuacaaacugugugagaacucugcaucggguaagucaugcgagauugauagcaucccuguaaaauguaagcagggguucugcuugaagauaacacaggaaggacgcggccaugugaaauuaagucgaggcacugagaucguccuggacgugugugauuccucuugcgaacuaaugauuccaaaggggaccggagacauccucguugauuguagcgguggccagcaacacuuucugcagaauaaccuuauugaccuggggugcccgaaugugcccuugcucggaaaaauggccaucuaugucugucguauguccaaccauccuaagacaaccauggcguuccuguuuugguucucauuuggcuacgugauaacuugcauuguaugcagaguucuguucuaucucuuaaucgcuauugguacaguggggaaaaagcugaagcaguacagggagcuuaaaccacagaccuguaucgucugcgagagugugcccgugaaugccaucgaugcagaaaugcacgaguugaacuguagcuauaauauuugcccuuacugugccucucggcuguccacggacggacuaauacgccaugucacucaaugcccaaagagaagggaaaaaguugaggaaaccgagcucuuucugaaccuugagcggauccccuggcuggugcgcaaguugcuccagguaucagaaagcacaggcauggcucugaaacgaaguuguuggaugauuacuuuacugauccuccuucuggugucuauguccccuguccagagcgcaccagugggc

SEQ ID NO: 10742 - RNA, 972 nt, Artificial Sequence
  derived and/or modified CDS sequence (opt3) from CCHFV(UCCR4448)__KY484042.1__Gn
agcgaggaaaccuccgacgauugcaucucuagaacacagcugcucaggacugagacggccgaaauucacggcgacaacuacgggggacccggugauaagauaaccaucuguaauggcucaacaauuguggaccaacggcuugggagugagcugggaugcuauacuaucaaccgcgucaagagcuucaaauugugugaaaauuccgcuaccggcaaaucuugcgagauugauucgguuccugugaagugucgacaggguuacugcuuacguaucacacaggaggggagaggacauguaaaacugucaaggggcagcgaagugguccuagacgcaugugauaccaguugcgagauaaugaucccaaagggcacuggggacauucucguggauuguuccggaggucagcaacacuuucugaaggacaaccuuaucgaucugggcugcccgaaaauucccuugcucgggaagauggccaucuauauaugucggaugucuaaucauccuaaaacaaccauggcguuccuguuuugguucagcuuuggauacguuauuacgugcauccugugcaaggcuauuuucuaucucuuaaucaucauuggcacucuggguaaacgcuuuaagcaguacagagaacuuaagccacagaccuguacaauaugcgagacuacccccgugaacgccaucgacgcagagaugcacgauuugaauuguuccuauaacauuugcccuuacugugccucaaggcugacaagugacgggcuagcucggcaugucacccagugcccaaaacgcaaggaaaaaguggaggaaacggagcucuaccugaaucuugaacgaauccccuggguaguuagaaagcuguugcaagugagcgagucuacuggagucgcacucaaaagguccucauggcugauaguguuacugguccucuucacaauuagccuuaguccugugcagucugccccaaucucc

SEQ ID NO: 10743 - RNA, 972 nt, Artificial Sequence
  derived and/or modified CDS sequence (opt3) from CCHFV(SPU 45/88)__KJ682809.1__Gn
agcgaggaauccucugacgauugccugucaagaacccagcuccuuaggacagagaacacugaaauccacagugacaauuacggcgggcccggagauaagauuacgauauguaacgguagcaccaucguggaccaacggcugggcuccgaguuggggugcuauacaauuaaucgcgucaaaucuuucaaguuaugugaaaacucggccacuggaaaaucaugcgagaucgauagcaccccuguucgaugucgucagggcuuuugccugaagauuacacaggaggguagagggcaugugaaacuaaguaggggauccgaaguagugcucgacgcuugugauucuagcugcgagaucaugauaccaaagggcaccggcgacauccuggucgauuguuccgggggacagcaacacuuccuuaaggacaaucugguggauuuggguugcccgaacauuccccuccugggcaaaauggcaaucuacauuugucggaugucaaaucauccuaagacuacaaugggguuucuguucugguuuaguuucggauauguuauuaccugcauacucugcaaagugaucuuuuacuuacugaucgucgugggcacgcuugguaagaaauucaagcaguaucgcgaauugaagccacagacuuguaccauuugcgagacaacucccguaaacgccaucgacgcggagaugcacgaucugaauuguagcuacaacaucugcccuuauugugcuucuagacuaaccuccgacgggcucgccaggcauguuaugcagugcccaaaacggaaggagaaaauugaagaaacagagcuguaccuuaaucuggaacgcauacccuggaucgugcgaaaguugcuccaagucucagagagcaccggaguggcacugaaaagaaguucuugguuagugguccugcucguucuucugacgguguccuugagcccuguacagucggccccaauuggc

SEQ ID NO: 10744 - RNA, 1932 nt, Artificial Sequence
  derived and/or modified CDS sequence (opt3) from CCHFV(10200)__U39455.2__Gc
uuccuggacagcaccgccaagggcaugaaaaaccuccuuaauuccacaucucuggagacuucauugaguaucgaagcucccuggggugcaauuaacgugcagagcacguacaagccuaccgucuccacagccaauauagcguuaucuuggucgucaguugagcacagaggaaacaaaauccuggugagcgguaggagugaauccauuaugaagcuagaggaacggacuggcaucucuugggaucucgggguagaggacgcuagcgaguccaaacugcuuaccgugucagucauggaucugagucaaauguauagcccaguguuugaauacuugucuggagaccgccagguugaggaauggccgaaggccacaugcaccggcgauugucccgagcgaugcgguuguacuuccucaacaugccuccauaaggaguggccucacagccguaauuggagauguaacccaaccuggugcuggggaguggggacgggcuguacuugcuguggccuggacgucaaagaucuguucaccgacuauauguuugugaaguggaaaguagaauacauuaagacagaggcaaucguuugcguggaacucacuagccaggagaggcaguguucuuuaauagaagccgggacccgguucaaucugggacccgucacaaucacccuuuccgagccucgcaacauucaacagaaauugccacccgagaucauuacgcugcauccuagaaucgaagagggguuuuucgaucuaaugcacgugcagaaggugcucagcgcuucgacugucugcaagcugcagucuugcacacauggcguuccaggggaccuucaaguguaucacauaggaaaucuguugaaaggcgauaagguaaacggucaccucauucauaaaaucgaaccgcacuuuaauaccuccuggaugucaugggacgggugugaucuggacuacuauugcaacaugggagacuggcccaguuguacuuacacaggcgugacccagcauaaucacgcaaguuucgucaacuuacugaauauugagacggauuacaccaagaacuuucacuuccauuccaaaagggugacagcccacggcgacacuccucagcucgaucuuaaggcucggccaaccuauggggccggagaaaucacaguucugguggaggucgcggacauggaguugcauacuaaaaagaucgaaauuucuggucuaaaguuugcaagccuggccugcaccggcuguuacgcuugcucaaguuccauaagcuguaaagugcgcauccacguagaugagcccgacgaacucacaguucaugugaagucugaugacccugaugucguggccgcaucaaguagccugauggcucgaaaacuugaguucgggaccgacuccacuuuuaaggccuucucugcgaugccaaaaacgucgcugugcuucuauauugucgaaagagagcacuguaagagcugcuccgaggaagauacaaagaaaugugugaacaccaaguuggagcagccccaaucaauccucauagaacacaaaggaacuauuaucggcaagcagaauaguaccugcacagccaaagcaucuugcuggcuggagagcguuaaguccuuuuucuacgguuuaaagaacaugcugucagggaucuuuggcaauguguucaugggaauuuuucuauuccucgcuccguuuauccugcuuauuuuguucuuuauguucggcuggaggauacuguuuuguuucaaaugcugucggcguacccgcgggcucuuuaaguauagacaucugaaagacgacgaggaaacuggauacaggcggaucauugagaaacuuaacaauaagaaggguaagaacaaacuguuggauggcgaacgacucgccgacgggcgcaucgcugagcuguucagcacaaagacgcacaucgga

SEQ ID NO: 10745 - RNA, 1932 nt, Artificial Sequence
  derived and/or modified CDS sequence (opt3) from CCHFV(IbAr10200)__AF467768.2__Gc
uuccuggacagcaccgccaagggcaugaaaaaccuccuuaauuccacaucucuggagacuucauugaguaucgaagcucccuggggagcaauuaacgugcagagcacguacaagccuaccgucuccacagccaauauagcguuaucuuggucgucaguugagcacagagggaacaaaauccuggugagcgguaggagugaauccauuaugaagcuagaggaacggacuggcaucucuugggaucucgggguagaggacgcuagcgaguccaaacugcuuaccgugucagucauggaucugagucagauguauagcccaguguuugaauacuugucuggagaccgccagguuggcgaguggccgaaggccacaugcaccggugauugucccgaacgaugcggguguacuuccucaacaugccuccauaaggaguggccucacagccguaauuggagauguaacccaaccuggugcuggggagugggcacgggcuguacuugcugugggcuggacgucaaagaucuguucaccgacuauauguuugugaaguggaaaguagaguacauuaagacagaagcaaucguuugcguggagcucacuagccaggaaaggcaguguucuuuaauagaggccggaacccgguucaaucugggucccgucacaaucacccuuuccgaaccucgcaacauucaacagaaauugccacccgagaucauuacgcugcauccuagaaucgaggaaggcuuuuucgaucuaaugcacgugcagaaggugcucagcgcuucgacugucugcaagcugcagucuugcacacaugggguuccaggagaccuucaaguguaucacauaggcaaucuguugaaaggugauaagguaaacgggcaccucauucauaaaaucgagccgcacuuuaauaccuccuggaugucaugggacggaugugaucuggacuacuauugcaacaugggcgacuggcccaguuguacuuacacaggcgugacccagcauaaucacgcaaguuucgucaacuuacugaauauugaaacggauuacaccaagaacuuucacuuccauuccaaaagggugacagcccacggggacacuccucagcucgaucuuaaggcucggccaaccuauggagccggugagaucacaguucugguggaagucgcggacauggaguugcauacuaaaaagaucgagauuucuggccuaaaguuugcaagccuggccugcaccggguguuacgcuugcucaaguggaauauccuguaaagugcgcauccacguagaugaacccgacgagcucacaguucaugucaagagcgaugacccugaugugguggccgcaucuucaagucugauggcucgaaaacuugaguucggcaccgacagcacuuuuaaggccuucuccgcgaugccaaaaacgucucugugcuucuauauugucgaaagagaacacuguaagucgugcagcgaggaggauacaaagaaaugugugaacaccaaguuggaacagccccaauccauccucauagagcacaaagguacuauuaucgggaagcaaaauucaaccugcacagccaaagcaaguugcuggcuggaaucuguuaagagcuuuuucuacggcuuaaagaacaugcuguccggaaucuuuggcaauguguucauggggauuuuucuauuccucgcuccguuuauccugcuuauuuuguucuuuauguucggauggaggauacuguuuuguuucaaaugcugucggcguacccgcggucucuuuaaguauagacaucugaaagacgacgaggagacuggcuacaggcggaucauugaaaaacuuaacaauaagaaggggaagaacaaacuguuggauggagagcgacucgccgaccgcagaaucgcugaacuguucucaacaaagacgcacaucggc

SEQ ID NO: 10746 - RNA, 1932 nt, Artificial Sequence
  derived and/or modified CDS sequence (opt3) from CCHFV(Turkey-Kelkit06)__GQ337054.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucagugguacacagagggaacaaaauucuggugacagguaggagcgagaguaucaugaagcuagaggaacggacuggcgucuccugggaucucgggguggaagacgcgucugagagcaaacugcuuaccguuuccauuauggaucugucacaaauguacaguccaguguucgaguauuugagcggagaccgccaggucgaagaguggccgaaggcuacaugcaccggcgauugucccgaacgaugcgguuguacuucuuccacaugccuccauaaggaguggucacacagccguaauuggagauguaacccuaccuggugcuggggaguggggacgggcuguacuugcuguggcguagacguuaaagaucuguuuaccgaccauauguucgugaaguggaaagucgaguacaucaagacagaagccauagugugcguggcacugacuucacaggagaggcaguguucucucaucgaagccgggacccgguuuaauuuaggaccagucacaauuacccuguccgagccccgcaacauccaacagaaacuuccuccagaaauuaucacguugcaccccaagauagaggaggguuucuuugaucugaugcauguucagaaggugcuaagcgcuucgacuguaugcaaacuccagucuugcacacacggcauuccuggggaccugcaaguguaucacaucggaaaucuucugaagggcgauagagucaacggucauuugauucacaaaaucgaaucccauuucaauaccucauggaugaguugggacgggugugaucucgacuacuauugcaacaugggagacuggccaagcuguacuuacacaggcgugacccagcacaaucacgcagccuuuguuaaccuguuaaauaucgagacggauuauaccaagacauuccauuuucacuccaaaagggugacugcucauggcgacaccccgcagcuggaucucaaggcccggcccacauacggggcgggagguauuacuguccuuguggaaguagcagacauggagcugcacaccaaaaagguugaaauaucuggcuugaaguucgccagccuagcuugcacaggguguuacgccugcucaaguggaaucuccuguaaagugcgcauucaugucgaugagccugacgagcugaccgugcacgucaagagcucugauccagacgugguugcagcuucaaccagucucauggcccgaaaacuggaauuuggcacggauagcacauucaaggcguucuccgccaugcccaaaaccucucuuugcuuuuauaucguggagagagaauacuguaagucgugcagcgaggacgauacucagaaguguguagacaccaggcuggaacaaccucaguccauauugauugagcacaaagguacaaucaucgggaagcagaacgacacuugcacugcaaaagcuaguugcuggcucgagagugucaagucuuucuuuuauggccugaaaaacauguuaggaagcguguucggcaaucuguuuauugggauccuacucuuccuggccccauuuguucuuuuggugcuguucuuuauguucggauggaagauucucuuuuguuucaagugcugucggcguacacgcggucuguuuaaauacagacaucuuaaggaugacgaagagacgggcuauaggcggauaaucgaacgacugaacuccaaaaaggggaaaaaucgcuugcucgauggagacagacuggcugauaggaagauugccgaguuauucucaaccaagacucacaucggc

SEQ ID NO: 10747 - RNA, 1935 nt, Artificial Sequence
  derived and/or modified CDS sequence (opt3) from CCHFV(SR3)__AJ538199.1__Gc
cuguuccucgacagcaucgugaagggcaugaaaaaccuucucaauuccaccucuuuggagacaucauuaaguauugaagcccccuggggugcuauaaacguccagagcacuuacaagccuacgguuuccaccgcaaauaucgcccugucuuggucgucaguggagcacagaggaaacaaagugcuagugagcgguaggagugaauccauuaugaagcucgaggaacggacaggcaucucuugggaucugggggucgaggacgcgagcgaguccaaacuucugacugugucaguuauggauuugagucaaauguauagcccaguguuugaauaccucucuggagaccgccaggucgaggaauggccgaaggcuaccugcacaggcgauugucccgagcgaugcgguuguaccuccucaacuugccugcauaaggaguggccucacagccguaauuggagauguaacccaacauggugcuggggaguggggaccggcuguacgugcuguggccuggacguaaaagaucucuucacugacuauauguuuguuaaguggaaaguggaauacauuaagaccgaggccaucgucugcguggaauuaacaagucaggagaggcaguguucucugauagaagcagggacucgguucaaucuuggauccgugaccaucacauugagcgagccccgcaacauucaacagaaacugccuccagagaucauuacccuacaucccaagaucgaagagggguuuuucgaucucaugcacguccagaagguucugucggccucuacggugugcaaacuucaguccugcacucauggcguaccuggggaccugcaaguguaucacauaggaaauuugcucaagggcgauagagucaacggucaccugauucauaaaaucgaacagcacuuuaauacaucauggaugaguugggacgggugugauuuagacuacuauugcaacaugggagacuggccaagcuguaccuacacuggcgugacacagcauaaucacgcuuccuucguuaaccugcucaauauugagaccgauuacacgaagaccuuucacuuccauucuaaaagggugacagcacacggcgacacuccgcagcuugaucugaaggcccggcccaccuauggggcuggagaaaucacagucuugguggagguagccgacauggagcuacauacuaaaaagaucgaaauuagcggucugaaguuugcgggccugaccugcacaggguguuacgcaugcucaaguggaauauccuguaaaguucgcauccacguggaugagccugacgaacugaccguccauguaaagagcgaugacccagaugucguggccgcuucuucaagucuuauggcccgaaaacuggaguucggcacugacagcacguuuaaggcauucuccgcuaugcccaaaacaucuuugugcuucuauauuguugaaagagaguacuguaagucgugcaacaaggaggauacccaaaaaugugugaacacuaagcucgaacagccucagagcauccugauagagcacaaagguaccauuaucgggaagcaaaauaacacaugcaccgccaaagcguccugcugguuagaaucaguaaagaguuucuuuuauggccugaagaauaugcuaggaggcaucuuugggaacgucuucauuggaaucuuuacuuuccucacaccauuuauucugcuuauauuguucuuuauguucgguuggaggauccuguuuuguuucaaaugcugucggcguacgcgcggccucuuuaaguacagacaccugaaagacgacgaggagaccggguauaggaagauuaucgaacggcuuaauaacaaaaagggaaagaaucgacuguuggauggcgagcgccucgccgacagaaaaaucgcagaacuguucucuacuaagacacauauuggu

SEQ ID NO: 10748 - RNA, 1935 nt, Artificial Sequence
  derived and/or modified CDS sequence (opt3) from CCHFV(UCCR4413)__KY484038.1__Gc
uuccugagcuccaucgugaagggcaaaaagaaccuccuuaauucugccucacuggagaccaguuugagcauugaagcucccuggggagcaauaaacgcccaguccacauuuaaaccuacuaucucuacggcgaauauugcuuuaucguggucaagcgucgagcacagagggaacaagguucuggugagugguagguccgaaucuaucaugaaacuagaggaacggaccggcauuagcuggaaucucgggguagaggacgccuccgagucacgcaugcugacagugagugucauggaucuuagccaaauguaccugccaguguucgaauauuugucuggagaccgacagguugaggaauggccgaaggcaacuugcaccggcgauugucccgagcguugcgguuguacauccucaaccugccuccauaaggaguggccucacagcagaaacuggagguguaauccaacuuggugcuggggaguggggacaggcuguaccugcuguggccuggacgucaaagaucuguuuacggacuacauguucgugaaguggaaaguagaauauaucaagacugaggccauaguuugcguggaacucaccagucaggagcggcaguguucuuuaaucgaagcugggacacgcuuuaaccugggacccgucacuauuacccuuuccgagccuagaaauauccaacagaaauugccaagcgagauugugacacugcaucccaagaucgaagaggguuucuuugaucuaaugcacgugcagaagguccucucggcaucuaccguuugcaaacugcaguccugcacgcauggcguggccggggaccuucaaguauaccacgugggaaaccuguugaagggcgauaaaauaaauggucacucaauucauaagaucgaaccucaccucaacacaaguuggaugagcugggacgggugugaucuggacuauuacugcaauaugggagauuggccauccuguacuuauaccggcgucacucagcauaaccacgcugccuucgugaauuuacugaacauugagacagacuacaccaaaucuuuucacuuccauagcaagaggguuacggcgcacggcgacaccccgcagcucgaucuuaaagcacggcccauguacggggccggagaaaucacagugcuggucgagguggcugacauggaguugcauucaaagaacaucgaaauuaguggucuaaaguuugccucccugacuugcagcggcuguuaugcauguucuucagggauaaguugcaaaguacgcauccacguugaugagccugacgaacucgcugugcaugucaagagcgaugaccuggauguggucgccgcguccucuucgcuuauggcccgaaaaauugaguucggaaccgacagcacauuuaaggcauucuccucaaugccaaaagaaagucugugcuucuacaucguggagagagauuuuuguaagucuugcgcugccgaggacacucagaaguguguuaaagcuaaguuggaacaaccccagagcauacucauugagcacaaaggcaccaucaucgguaagcagaaugauacaugcuccaccaaaacuucaugcuggcuggaaucuuucaagagcuuuuucuauggguuaaagaacaugcuguccggcguguuuggaagugccauuaugggcauccuacucuuccuggcaccuuuuauucuuuugauacuguucuuuuucuuuggguggaggauccucuucugucugcggugcugucgucgcacgagaggacuuuuuaaauacaagcacauuaaagacgacgaggaggccgguuauaagaaaaucaucgaaaagcugaauaacaagaaaggcgggacaagcaaguugcucgauggagagaggcuggcugaccggaaaauugcggaauuauucucuaccaaggcacauauaggc

SEQ ID NO: 10749 - RNA, 1932 nt, Artificial Sequence
  derived and/or modified CDS sequence (opt3) from CCHFV(66019)__AB069669.1__Gc
uucagcgacuccaucgugaagggcaugaaaaaccugcucaauucuaccucacuugagacaagucugagcauugaagcccccuggggagcuauaaacguccaguccacuuuuaagccuacgguuucuaccgcaaauaucgccuugucguggucaagcguggagcacagagggaacaaaauuuuaguaagugguagguccgaaucuaucaugaagcuggaggaacggacaggcauuagcugggaucuagggguggaggacgcguccgagucaaaacuccugacugucagugugauggaucuuagccaaauguacucuccaguuuucgaauaucuguccggagaccgccagguggaggaauggccgaaggcuaccugcacaggcaauugucccgaucgaugcgguuguaccucaagcacuugcuugcauaaggaguggccucacagucguaacuggagauguaauccaacauggugcuggggagucgggaccggcuguacgugcuguggccucgacgugaaagaucuguuuacugacuacauguucguaaaguggaaaguugaguauaucaagaccgaagccauagugugcgucgagcugaacucucaggaaaggcaguguucccucaucgaggcagggacacgguuuaauuuaggacccgugacuauuacccugagcgaaccucgcaacauccaacagaaacuuccaucggagauuaucacauugcaucccagaauagaggaagguuucuuugaucugaugcacgugcagaagguccuaucugccuccaccguuugcaagcuccagucaugcacgcauggcgugccuggggaccugcaaauuuaccacaucggaaaucuucugaaaggcgauaggguaaacggucacuugauucauaagaucgagccacacuucaauaccaguuggaugagcugggacgggugugaucucgacuauuacugcaacaugggagacuggccguccuguacauauaccggcgugacucagcauaaucacgcugcauuugucaaccuguuaaacaucgaaacagauuacaccaaaaauuuccacuuucauucuaagcgggugacggcccacggcgacacuccccagcuggaucucaaagcucgcccuacauacggggccggagagauuacuguucuuguggaagucgcggacauggagcugcauaccaagaaaauagcaaucagcgguuugaaguucgccucacuaacaugcacuggcuguuaugcuugcaguuccgggauuagcuguaaggugcgaauccacguagaugagccagacgaacugaccguucaugugaaaucugaggaucccgacauagucgccgcaucaaguagccucauggcuagaaagcuggaauuuggaacagauuccaccuucaaagccuucucugcgaugccuaagacuucgcuuugcuuuuacauuguggagagggaauauugugagagcugcuccaaagaggacacgcagaagugugucaacacaaagcuggaacaaccacagucaaucuugaucgagcacaaaggcaccauuaucgguaagcagaaugauacuugcaccgccaaagcaaguugcuggcucgaaucuguuaagagcuucuuuuacgggcugaaaaacauguuauccggcauuuucggaaauguguuuauaggcaucuuccuguuucuagcucccuucauucuccugaucuuguuuuucauguuuggguggcggauccuuuucuguuuuaagugcugucgucgcacaagaggacuguucaaguauagguaccucaaagacgacgaggagucagguuaucggcgaauuauagaacgccugaacaauaagaaaggcaagaacaaacuucuggauggggagagauuggccgacaggcggaucgcugaacucuucagcaccaagacucacauugga

SEQ ID NO: 10750 - RNA, 1932 nt, Artificial Sequence
  derived and/or modified CDS sequence (opt3) from CCHFV(7001)__AB069670.1__Gc
uuccuggacaacaucgccaagggcaugaaaagccuccuuaauuccaccucucuggagacaucauugaguauugaagcucccuggggagcaauaaacgugcagagcacuuuuaagccuacggucuccgccgcgaauaucgcuuuaucuuggucgucaguugagcacagagggaacaaaauucuggugagcgguaggagugaauccaucaugaagcuagaggaacggaccggcguaucuuggaaucucgggguggaggaugccagcgaguccaaaacacugacugucucagugauggaccuuagucaaauguacagcccaguuuucgaauaucugucuggagaucgccagguggaggaauggccgaaggcaaccugcacaggcgacugucccgagcgaugcgguuguaccuccucaacuugcuugcauaaggaguggccucacagccguaacuggagauguaauccaacauggugcuggggagucgggaccggcuguacgugcuguggccucgaugugaaagacuuuuucacugauuacaugcugguaaaguggaaaguugaauauauuaagaccgaggccaucgugugcgucgaacugacaagucaggagaggcaguguucucucauagaagcugggacucgguuuaacuuaggacccgugaccaucacacuguccgagccucgcaaugugcaacagagacuuccacccgagauugucaccuugcauccuaaaaucgaagaggguuucuuugaccugaugcacguucagaagauucuaagcgcaucgacggugugcaagcuccagucuugcacucauggcguaccaggggauuuccaaguguaccacgucggaaaccugcuuaggggcgacaaagugaauggucacuccauccauaagauagaaccgcacuuuaacacaucauggaugaguugggaugggugugaccuggauuauuucugcaauaugggagacuggcccagcuguaccuacacuggcguuacacagcauaaccgggccgcuuuuauuaauauguugaacaucgagaccgacuauacgaaaaccuuccacuuucacuccaagcgcgugacagcccauggcgauacuccucagcucgaccugaaagcgcgaccagcauacggggccggagaagucaccguguuaguagagguugcugaucuggagcuccacacaaagaaacuugaagugucuggucugaagauugccagcuugacuugcucaggcuguuacgcaugcaguuccgggaucagcuguaaggucagaauccaugugaacgagcccgacgaauuuaccguccacgugaggucuucagauccugacguuguggcugccggaaguagccuaauggcgcggaaaauugaguucggcgccgauuccacauucaaggcauucucuucgaugccaaaagacagccugugcuuuuauauaguagaaaaggauuacuguuccucaugcaccgacgaugacacucagaaaugugucaauacgaagcucgaccauccccaaaguauccugauugagcacaaggguacaaucauagggaaacagaacgauaccugcucuacuaagaccagcugcuggcuugaguccgugaaaggcuucuuuuauggacugaagaauauguugucaggcauuuucgggaacguuuuucucggaaucuuccuguuuuuagcuccguucgugcugcuaaucuuuuucuuuuucuucgguuggcgucuccuguuuugucuuaaaugcugucgcagaacaaggggcuugcugaaguacaagcaccucaaagacgaagaggaagccggguauaagaaaauuaucgagcggcugaauggaaagaaaggcaagagccagcuuuucgauggugagcgacuggcugaccgcaagauugccgaauuguuuucuaccaaaauacauaucggg

SEQ ID NO: 10751 - RNA, 1932 nt, Artificial Sequence
  derived and/or modified CDS sequence (opt3) from CCHFV(75024)__AB069671.1__Gc
uuccuggacagcaucgugagaggcaugaagaaccagcucaauuccaccucucuugagacaucacugaguauugaagcccccuggggagcuauaaacguccaaagcacuuacaaaccuacgguuuccaccgcaaauaucgccuugucuuggucgucaguggagcacagggggaacaagauuuuaguaagcggucggagugaauccaucaugaaacuggaggaacgcacaggcauuucuugggaucuagggguggaggacgcgagcgaguccaagcuccugacugucucagugauggaucuuagucagauguauagcccaguuuuugaauaccugucuggagaccgacagguggaggaauggccgaaagcuaccugcacaggcgauugucccgagcguugcgguuguaccacuuccacaugcuugcauaaggaguggccucacucaagaaauuggagguguaacccaaccuggugcuggggagucgggacgggcuguacuugcuguggccucgacgugaaggaucuguucaccgacuauaugaucguaaaauggaagguugaauacauaaaaacagaggccaucgugugcgucgaacugacuagccaggagcggcaauguagucucauugaagcagggacccgcuuuaauuuaggaucugugacaaucacccuguccgagcccagaaacauucagcagaaacuuccuccagagaucauaacguugcaucccaggauugaagaggguuucuuugaucugaugcacgugcagaaaguccuaagcgccucgacuguuugcaagcuccaaucuugcacacauggcgugccuggggaccugcagguauaucacgugggaaaucuucugaagggcgauaaagucaacggucacuugauccauaagauugaaccacaccucaauaccuccuggaugucaugggacgggugugaucuggacuacuauugcaacaugggagacuggccgaguuguacuuacacaggcgugacccagcauaaucacgcuagcuucguuaacuuacugaauaucgagacggauuacaccaaauccuuucacuuccauucuaagcgggugacagcacacggcgacacuccccagcucgaucuuaaagcccgcccuaccuauggggcuggagaaaucacaguccugguggagguagccgacauggaguuuacuccaaagaaaauugaaauaagcgguuugaaguucgcgucacuaaccugcacaggcuguuacgcaugcaguuccgggaucagcuguaagguucgaauccauguggaugagcccgacgaacugaccguccacgugaaaucugaugacccugaugucguggccgcuucaaguagccucauggccagaaagcuggaguuuggaacugacuccacguucaaagcauuuucugcuaugccaaagacaucgcuuugcuucuauauuguugaaagggaguacuguaaaagcugcuccaaggaggauacccaaaagugugugaacacuaaacuggaacagccccagucaauauugauugagcauaagggcaccaucaucgguaaacaaaacaauacaugcaccgccaaggcgaguugcuggcucgaaucuguaaagagcuucuuuuaugggcugaagaacauguuauccggcauuuucggaaaucuguuuaugggcaucuuccuauuucucgccccguucauucugcuuauauuguuuuucauguuuggguggcggauccuguucuguuuuaagugcugucgucgcacuagaggacucuucaaauacaggcaccugaaggacgacgaggagacagguuaucggcgaauuaucgaacgccuuaacaauaaaaagggcaaaaacaagcuguuggauggggagagacucgcagacaggcggaucgcugaacuguuuucaacgaagacccacauugga

SEQ ID NO: 10752 - RNA, 1932 nt, Artificial Sequence
  derived and/or modified CDS sequence (opt3) from CCHFV(7803)__AB069672.1__Gc
uuccuggacagcaucgugagaggcaugaagaacccccucaauuccaccucucuugagacaucacugaguauugaagccccuuggggagcuauaaacguccagagcacuuacaaaccaacgguuuccaccgcaaauaucgccuugucuuggucgucaguggagcacagggggaacaagauuuuaguaagcggucggagugaauccaucaugaaacuggaggaacgcacaggcauuucuugggaucuagggguggaggacgcgagcgaguccaagcuccugacugucucagugauggaucuuagucaaauguauagcccgguuuuugaauaccugucuggagaccgacagguggaggaauggcccaaagcuaccugcacaggcgauuguccugagcguugcgguuguaccacuuccacaugcuugcauaaggaguggccacacucaagaaauuggagguguaaccccaccuggugcuggggagucgggacgggcuguacuugcuguggccucgacgugaaggaucuguucaccgacuauaugaucguaaaauggaagguugaauacauaaaaacacgggggaucgugugcgucgagcugacuagccaggaacgccaguguagucucauugaggccggaaccagauuuaauuuagguucugugacaaucacccuguccgaaccuaggaacauucaacagaagcucccacccgagaucauaacguugcauccucggauugaggaaggcuucuuugaucugaugcacgugcagaaaguccuaagcgcaucgacuguuugcaagcuccagucuugcacacauggggugccaggagaccugcaaguauaucacgugggcaaucuucugaagggugauaaagucaacgggcacuugauccauaagauugagccgcaccucaauaccuccuggaugucaugggacggaugugaucuggacuacuauugcaacaugggcgacuggcccaguuguacuuacacaggcgugacccagcauaaucacgccagcuucguuaacuuacugaauaucgaaacggauuacaccaaauccuuucacuuccauucuaagcgcgugacagcucacggggacacuccucagcucgaucuuaaagcacgaccaaccuauggagccggugagaucacaguccugguggaaguagcugacauggaguuuacucccaagaaaauugagauaagcggcuugaaguucgccucacuaaccugcacaggguguuacgcgugcaguuccggaaucagcuguaagguuaggauucauguggaugaaccugacgagcugaccguccacgugaaaucugaugacccagaugucguggcagccucaaguagccucauggcuagaaagcuggaauuuggcacugacuccacguucaaagccuuuucugcaaugcccaagacaucgcuuugcuucuauaucguugagcgggaauacuguaaaagcugcuccaaggaggauacccagaagugugugaacacuaaacuggagcaaccgcagucaauauugauugaacauaaggguaccaucaucgggaaacagaacaauacaugcaccgcuaaggccaguugcuggcucgagucuguaaagagcuucuuuuauggccugaagaacauguuauccggaauuuucggcaacuuuuucauggggaucuuucuguuccuagcgccuuuuauucuccugauacuuuucuuuauguucggauggcguaucuuguuuuguuucaagugcugucgcagaacuaggggucuguuuaaauaccggcaccucaaggacgacgaagagacaggcuaucgacgcauuaucgagagacugaauaauaaaaaggggaaaaacaaacuucuggauggagaaagguuggccgaccggcgcaucgcagagcuuuucucaacgaagacccacauuggc

SEQ ID NO: 10753 - RNA, 1932 nt, Artificial Sequence
  derived and/or modified CDS sequence (opt3) from CCHFV(79121)__AB069673.1__Gc
uuccuggacagcaccgccaagggcaugaaaucccuccuuaacucuacaucacuggagacgaguuugagcaucgaagcucccuggggagcaauuaaugugcaguccacuuuuaagccuaccgucucugccgcgaacauagcuuuaucguggucaagcguugagcacagaggaaauaaaauccuggugagugguagguccgaaucuauuaugaagcuagaggaacggacaggcguaagcuggaaccucgggguggaggaugccuccgagucaaaaacucugaccgucagugugauggaccuuagccaaauguacucuccaguuuucgaauaucuguccggagaucgccagguggaggaauggccgaaggcaacaugcaccggcgacugucccgagcgaugcgguuguacuucaagcacaugcuugcauaaggaguggccucacagucguaauuggagauguaacccaaccuggugcuggggagucgggacgggcuguacuugcuguggccucgaugugaaagacuuuuucaccgauuacaugcugguaaaguggaaaguugaauauaucaagacagaggccauugugugcgucgaacugacuucucaggagaggcaguguucccucaucgaagcugggacccgguuuaauuuaggacccgugacaauaacccugagcgagccucgcaacgugcaacagagacuuccacccgagaucgucacguugcauccuaaaauugaagaggguuucuuugaccugaugcacguucagaagauccuaucggcaucuacugugugcaagcuccaguccugcacacauggcguaccaggggauuuccaaauuuaccacgugggaaaucugcuuaggggcgacaaagucaacggucacucaauccauaagauagaaccgcacuuuaauaccaguuggaugagcugggaugggugugaccuggauuauuucugcaacaugggagacuggcccuccuguacuuacacaggcgugacccagcauaaucgggccgcuuuuauuaacauguugaauaucgagacggacuauaccaaaacauuccacuuucacucuaagcgcguuacugcccauggcgauaccccucagcucgaccugaaagcgcgaccagcauacggggccggagaagugacagucuuaguggagguagcugaucuggagcuccacacuaagaaccuugaaguuagcggucugaaaauugccucauugaccugcaguggcuguuacgcaugcuccagcgggaucucuuguaaggugagaauccaugucaacgagcccgacgaauuuacagugcacgucaggucaagugauccugacgugguugcugccggaagcucccuaauggcgcggaagauugaguucggcgccgauucuaccuucaaagcauucucgagcaugccaaaggacucccugugcuuuuauauaguggaaaaagauuacuguucaaguugcacugacgaugacacgcagaaguguguaaauacaaaacucgaccauccccaaucuauccugauugagcacaaggguaccaucauagggaagcagaacgauacuugcagcaccaaaacauccugcuggcuugagucagucaagggcuucuuuuauggacugaaaaauauguugagcggcauuuucgggaacguguuucucggaaucuuccuguuuuuagcuccguucguucugcuaaucuuuuucuuuuucuucgguuggcgucuccuguuuugucuuaagugcugucgcagaaccaggggcuugcugaaauacaagcaccucaaggacgaagaggaagccggguauaaaaagauuaucgagcggcugaaugggaaaaagggcaaaucucagcuuuucgauggugagcgacuggcugaccgcaagauugccgaauuguuuuccacuaagauacauaucggg

SEQ ID NO: 10754 - RNA, 1932 nt, Artificial Sequence
  derived and/or modified CDS sequence (opt3) from CCHFV(8402)__AB069674.1__Gc
uucagcgacuccaucgugaagggcaugaaaaaccugcucaauucuaccucacuugagacaagucugagcauugaagcccccuggggagcuauaaacguccaguccacuuuuaagccuacgguuucugcagccaauaucgcguugucguggucaagcguggagcacagagggaacaaaauuuuaguaagugguagguccgaaucuaucaugaagcuggaggaacggaccggcauuagcugggaucuagggguggaggacgcuuccgagucaaaacuccugacagucagugugauggaucuuagccaaauguacucuccaguuuucgaauaucuguccggagaccgccagguggaggaauggccgaaggccacuugcaccggcgauugucccgagcgaugcgguuguacaucaucuaccugcuugcauaaggaguggccucacagucguaauuggagauguaacccaacuuggugcuggggagucgggacaggcuguaccugcuguggccucgacgugaaagaucuguuuacggacuacauguucaucaaguggaaaguagaauauauaaagacugaggcaaucguuugcguggaacugaccucucaggagaggcaguguacacucauugaagccgggacucgguuuaauuuaggacccgucaccaucacacuguccgagccucgcaacauucaacagaaacuuccacccgagaucgugaccuugcauccuagaauagaagaggguuucuuugaucugaugcacgugcagaagguccuaagcgcuucgacgguuugcaagcuccagucuugcacucauggcgugccaggggaccugcaaguauaccacauuggaaaucuucugaaaggcgauaaggugaacggucacuugauccauaaaauugaaccgcacuucaauacauccuggaugucaugggacgggugugaucucgacuauuacugcaacaugggagacuggcccaguuguaccuauacuggcgucacacagcauaaucacgcagccuuugugaacaugcugaauaucgagaccgauuacacgaagaacuuccacuuucauagcaaaaggguuaccgcucacggcgacacaccucaguuagaucugaaggcccggccaacuuacggggcgggagaaaucaccgugcucgucgagguggcagacauggagcuucauacaaagaagauugaaauauccggucugaaguucgccucuuugacuugcaccggcuguuaugcuugcagcucagggaucaguuguaaaguacgcauucacguugaugagcccgacgaacuaacagugcaugucaaguccgaggauccugacaucguggccgcaagcagcucacugauggcucgaaaacucgaauuuggaaccgauaguacuuucaaggccuucagcgcgaugccaaaaacgucccugugcuuuuacauagucgagagagaguauuguaagucuugcucgaaggaagacacacagaaaugugugaacaccaaacuugagcaaccccagagcauucugaucgaacacaaaggcacuaucauugguaagcaguccaauaccugcacagccaaagcaucaugcugguuggagaguguuaagucuuucuuuuacgggcucaagaacaugcugagcggcaucuucggaaauguguuuauuggcguauucuuauuuuucgcuccguuuauacugcuaauccucuucuuuauguucggguggaggauucuguuuuguuucaaaugcugucggcguacccgcggacuuuucaaguauagacacuugaaagaugacgaggaaacugguuacaggaagaucaucgagcggcugaacaauaaaaagggcaagaacaaacuccuggacggggaacgacuugccgaucgcaagauugcugagcuguuuuccacaaaaacgcauauagga

SEQ ID NO: 10755 - RNA, 1932 nt, Artificial Sequence
  derived and/or modified CDS sequence (opt3) from CCHFV(88166)__AB069675.1__Gc
uucagcgacuccaucgugaagggcaugaaaaaccugcucaauucuaccucacuugagacaagucugagcauugaagcccccuggggagcuauaaacguccaguccacuuuuaagccuacgaugucugcagccaauaucgcguugucguggucaagcguugagcacagagggaacaaaauuuuagugagugguagguccgaaucuaucaugaagcuggaggaacggaccggcauuagcuggaaucuagggguagaggaugcuuccgagucaaaacuccugacagugagugucauggaccuuagccaaauguacucuccaguguucgaauaucuguccggagaucgccagguugaggaauggccgaaggccacuugcaccggcgacugucccgagcgaugcgguuguacaucaucuaccugcuugcauaaggaguggccucacagucguaacuggagauguaauccaacuuggugcuggggaguggggacaggcuguaccugcuguggccucgaugucaaagaccuguuuacggauuacauguucaucaaguggaaaguggaauauauaaagacugaggcaaucguaugcguugaacugaccucucaggagaggcaguguacacucauugaagccgggacucgguuuaacuuaggacccgugaccaucacacuguccgagccucgcaauauucaacagaaacuuccacccgagaucgucaccuugcauccuagaauagaagaggguuucuuugaccugaugcacgugcagaaggugcuaagcgcuucgacggucugcaagcuccagucuugcacucauggcguuccaggggaucugcaaguguaccacauuggaaaccuucugaaaggcgacaagguaaauggucacuugauccauaaaauugaaccgcacuucaacacauccuggaugucaugggaugggugugaccucgauuauuacugcaauaugggagacuggcccaguuguaccuauacuggcgugacacagcauaaccacgcagccuuugucaauaugcugaacaucgagaccgacuacacgaagaacuuccacuuucauagcaaaagggugaccgcucacggcgauacaccucaguuagaccugaaggcccggccaacuuacggggcgggagaaaucaccguucucguggaggucgcagauauggagcuucauacuaaaaagauugaaauauccggucugaaguucgccucuuugacaugcaccggcuguuaugcuugcagcucagggaucaguuguaaagugcgcauucacguagacgagcccgaugaacuaacaguucaugugaaguccgaggacccugaucuggucgccgcaagcagcucacucauggcucgaaaacuggaauuuggaaccgacaguacuuucaaggccuucagcgcgaugccaaaaacgucccuuugcuuuuacaucguggagagagaguauuguaagucuugcucgaaggaagauacacagaaaugugucaauaccaagcuggagcaaccccagagcauauugauugaacacaaaggcacuaucaucgguaagcagaacaauaccugcacagccaaagcauccugcuggcucgagucagugaagaguuucuuuuacgggcugaagaacauguuaucuggcauuuucggaaauguuuuuaucggcguguuccuguuuuucgcuccguuuauucuacucauacuguucuuuauguucggguggaggaucuuguuuuguuucaaaugcugucggcguacccgcggacuuuucaaguauagacaccugaaagacgaugaggaaacugguuacaggaagauuaucgagcggcucaacaauaaaaagggcaagaacaaacugcuugacggggaacgacuggccgaccgcaagaucgcugaguuguuuagcacaaaaacgcauauugga

SEQ ID NO: 10756 - RNA, 1932 nt, Artificial Sequence
  derived and/or modified CDS sequence (opt3) from CCHFV(BA88166)__AF338470.1__Gc
uaccuggacagcaucgugaagggcaugaaaaaccuccuuaauuccaccucucuggagacaucauugaguauugaagcccccuggggugcuauaaacguccagagcacuuucaagccuacgauguccgcagccaauaucgcguuaucuuggucgucaguugagcacagaggaaacaaaauucuggugagcgguaggagugaauccaucaugaagcuagaggaacggaccggcauuucuuggaaucucgggguagaggaugcuagcgaguccaaacugcuuacagugucagucauggaccugagucaaauguauagcccaguguuugaauacuugucuggagaucgccagguugaggaauggccgaaggccacuugcaccggcgacugucccgagcgaugcgguuguacauccucaaccugccuccauaaggaguggccucacagccguaacuggagauguaauccaacuuggugcuggggaguggggacaggcuguaccugcuguggccuggaugucaaagaccuguucacggauuauauguuuaucaaguggaaaguggaauacauaaagacugaggcaaucguaugcguugaacucaccagucaggagaggcaguguacauuaauugaagccgggacucgguucaaccugggacccgugaucauuacccuuucugagccucgcaauauccaacagaaauugccacccgagauagucacacugcauccuagaauugaagagggguuuuucgaccuaaugcacgugcagaaggugcucuccgcuagcaccgucugcaagcugcagucgugcacgcauggcguuccaggggaucuucaaguguaucacaucggaaaccuguugaaaggcgacaagguaaauggucaccucauucauaaaaucgaaccgcacuuuaacacuucuuggauguccugggaugggugugaccuggauuacuauugcaauaugggagacuggcccucauguacauacaccggcgugacucagcauaaccacgcagccuucgucaauauguuaaacaucgagacagacuacaccaagaacuuucacuuccauaguaaaagggugacggcucacggcgauaccccucagcuggaccucaaggcccggccaacauauggggcgggagaaauuacuguucuuguggaggucgcagauauggagcugcauaccaaaaagauagaaaucagcgguuugaaguuugccucccuaacaugcacuggcuguuacgcuugcucuagcgggauuucauguaaagugcgcauccacguagacgagcccgaugaacugaccguucaugugaagagugaggacccugauauagucgccgcauccagcucucucauggcucgaaaacuggaguucggaacagacucaaccuuuaaggccuucagugcgaugccaaaaacuagccuuugcuucuauauuguggaaagagaguacuguaaguccugcucuaaggaagauacgcagaaaugugucaauacaaagcuggagcaaccccagucgaucuugaucgaacacaaaggcaccauuaucgguaagcagaacaauacuugcaccgccaaagcaagcugcuggcucgaguccgugaagucauuuuucuaugggcugaagaacauguuaaguggcauuuuuggaaauguuuucauaggcguguuucuguucuuugcuccguucauccuacucauucuguuuuucauguuuggguggaggauccuuuucuguuuuaaaugcugucggcguacacgcggauuguucaaguacagacaccugaaagacgaugaggaaaccgguuauaggaagaucauugagcggcucaacaauaaaaagggcaagaacaaacugcuugacggggaacgacuggccgaccgcaagauagcugaguuguucucuacuaaaacacauaucgga

SEQ ID NO: 10757 - RNA, 1932 nt, Artificial Sequence
  derived and/or modified CDS sequence (opt3) from CCHFV(BA66019)__AF350448.1__Gc
uucagcgacuccaucgugaagggcaugaaaaaccugcucaauucuaccucacuugagacaagucugagcauugaagcccccuggggagcuauaaacguccaguccacuuuuaagccuacgguuucuaccgcaaauaucgccuugucguggucaagcguggagcacagagggaacaaaauuuuaguaagugguagguccgaaucuaucaugaagcuggaggaacggacaggcauuagcugggaucuagggguggaggacgcguccgagucaaaacuccugacugucagugugauggaucuuagccaaauguacucuccaguuuucgaauaucuguccggagaccgccagguggaggaauggccgaaggcuaccugcacaggcgauugucccgaccgaugcgguuguaccucaagcacuugcuugcauaaggaguggccucacagucguaauuggagauguaacccaacauggugcuggggagucgggaccggcuguacgugcuguggccucgaugugaaagaccuguuuacugauuacauguucguaaaguggaaaguugaguauaucaagaccgaagccauagugugcgucgagcuuaauucucaggaaaggcaguguucccucaucgaggcagggacacgguuuaacuuaggacccgugacuauuacccugagcgaaccucgcaauauccaacagaaacuuccacccgagauuaucacauugcauccuagaauagaggaagguuucuuugaccugaugcacgugcagaagguccuaucggccucuaccguuugcaagcuccaguccugcacgcauggcgugccaggggaucugcaaauuuaccacaucggaaaccuucugaaaggcgacaggguaaauggucacuugauucauaagaucgagccgcacuucaacacuucauggaugaguugggaugggugugaccucgacuauuacugcaauaugggagauuggcccagcuguacauauaccggcgugacucagcauaaccacgcugcauuugucaaucuguuaaacaucgaaacagacuacaccaaaaacuuccacuuucauuccaagcgggugacggcccacggcgauaccccucagcuggaccucaaagcucgcccaacauacggggccggagagauuacuguucuuguggaagucgcggauauggagcugcauaccaagaaaauagcaaucucugguuugaaguucgccagccuaacaugcacuggcuguuaugcuugcucaagugggauuuccuguaaggugcgaauccacguagacgagcccgaugaacugaccguucaugugaaaagcgaggacccugauauagucgccgcaucuucaagucucauggcuagaaagcuggaauuuggaacagacagcaccuucaaagccuucuccgcgaugccaaagacuucucuuugcuuuuacauuguggagagggaauauugugagucgugcagcaaagaggauacgcagaagugugucaauacaaagcuggaacaaccccaguccaucuugaucgagcacaaaggcaccauuaucgguaagcagaacgacacuugcaccgccaaagcaucaugcuggcucgaaagugugaagucuuucuuuuacgggcugaaaaauauguuaagcggcauuuucggaaacguuuuuauaggcaucuuccuguuucuagcuccguucauucuccugauccuguuuuucauguuuggguggcggaucuuguucuguuuuaagugcugucgucgcacaagaggacuguucaaguauagguaccucaaagacgaugaggaguccgguuaucggcgaauuauagaacgccugaauaacaagaaaggcaagaauaaacuucuggacggggagagauuggccgauaggcggaucgcugaacucuucucaaccaagacucacauugga

SEQ ID NO: 10758 - RNA, 1932 nt, Artificial Sequence
  derived and/or modified CDS sequence (opt3) from CCHFV(BA8402)__AF350449.1__Gc
uucagcgacuccaucgugaagggcaugaaaaaccugcucaauucuaccucacuugagacaagucugagcauugaagcccccuggggagcuauaaacguccaguccacuuuuaagccuacgguuucugcagccaauaucgcguugucguggucaagcguggagcacagagggaacaaaauuuuaguaagugguagguccgaaucuaucaugaagcuggaggaacggaccggcauuagcugggaucuagggguggaggacgcuuccgagucaaaacuccugacagucagugugauggaucuuagccaaauguacucuccaguuuucgaauaucuguccggagaccgccagguggaggaauggccgaaggccacuugcaccggcgauugucccgagcgaugcgguuguacaucaucuaccugcuugcauaaggaguggccucacagucguaauuggagauguaacccaacuuggugcuggggagucgggacaggcuguaccugcuguggccucgacgugaaagaucuguuuacggacuacauguucaucaaguggaaaguagaauauauaaagacugaggcaaucguuugcguggaacugaccucucaggagaggcaguguacacucauugaagccgggacucgguuuaauuuaggacccgucaccaucacacuguccgagccucgcaacauucaacagaaacuuccacccgagaucgugaccuugcauccuagaauagaagaggguuucuuugaucugaugcacgugcagaagguccuaagcgcuucgacgguuugcaagcuccagucuugcacucauggcgugccaggggaccugcaaguauaccacauuggaaaucuucugaaaggcgauaaggugaacggucacuugauccauaaaauugaaccgcacuucaauacauccuggaugucaugggacgggugugaucuccauuauuacugcaacaugggagacuggcccaguuguaccuauacuggcgucacacagcacaaucacgcagccuuugugaacaugcugaauaucgagaccgacuacacgaagaacuuccauuuucacagcaaaaggguuaccgcucauggcgauacaccucaguuagaccugaaggcccggccaacuuacggggcgggagaaaucaccgugcucgucgagguggcagauauggagcuucacacuaaaaagauugaaauauccggucugaaguucgccucuuugacaugcaccggcuguuaugcuugcagcucagggaucaguuguaaaguacgcauucauguugacgagcccgaugaacuaacagugcacgucaaguccgaggacccugauaucguggccgcaagcagcucacugauggcucgaaaacucgaauuuggaaccgacaguacuuucaaggccuucagcgcgaugccaaaaacgucccugugcuuuuacauagucgagagagaguauugugaaucuugcucgaaggaggauacacagaagugugugaacaccaaacuugaacaaccccagagcauucugaucgagcacaagggcacuaucauugguaaacaguccaauaccugcacagccaaggcaucaugcugguuggagaguguuaaaucuuucuuuuacgggcucaagaacaugcugagcggcaucuucggaaauguguuuauuggcguauucuuauuuuucgcuccguuuauacugcuaauccucuucuuuauguucggguggaggauucuguuuuguuucaagugcugucggcguacccgcggacuuuucaaauauagacauuugaaggacgaugaagagacugguuacaggaaaaucaucgaacggcugaacaauaagaaaggcaagaacaagcuccuggacggggagcgacuugccgaccgcaaaauugcugaacuguuuuccacaaagacgcacauagga

SEQ ID NO: 10759 - RNA, 1932 nt, Artificial Sequence
  derived and/or modified CDS sequence (opt3) from CCHFV(Matin)__AF467769.2__Gc
uuccuggacagcaucauuaagggcaugaaaaaccuccuuaauuccaccucucuggagacaucauugaguauagaagcccccuggggagcuaucaacgugcagagcacuuuuaagccuacgauguccgcagccaauauugcguuaucuuggucgucagucgagcacagagggaacaaaauccugguuagcgguaggagugaauccauuaugaagcuagaggaacggaccggcaucucuugggaucucgggguggaggacgcuagcgaguccaaacugcuuacaguaucagugauggaucugagucaaauguacagcccagucuucgaauauuugucuggagaccgccagguggaggaauggccgaaggccacuugcaccggcgauugucccgagcgaugcgguuguacauccucaaccugccuccauaaggaguggccucacagccguaauuggagauguaacccaacuuggugcuggggaguugggacaggcuguaccugcuguggccuggacgugaaagaucuguuuacggacuacauguucgucaaguggaaaguggaauauauaaagacugagguaaucguuugcguggaacucaccagucaggagaggcaguguucuuuaauugaagcagggacacgguuuaaucugggacccgucacuaucacccuuuccgagccucgcaacauucaacagaaauugccacccgagaucgugacacugcauccuagaauagaagaggguuucuuugaucuaaugcacgugcagaagguccucagcgccucgaccguuugcaagcugcagucuugcacgcauggcgugccaggggaccuucaaguauaccacauuggaaaucuguugaaaggcgauaaggugaacggucaccucauccauaaaauugaaccgcacuucaauacuuccuggaugucaugggacgggugugaucuggacuauuacugcaacaugggagacuggcccaguuguagcuauacaggcgucacccagcauaaucacgcugcauuugugaacauguuauccaucgagacugauuacacaaagaauuuccacuuucauucuaaaaggguuaccgcccacggcgacacgccucagcuggaucucaaggcucggccaaccuacggggccggagaaaucacagugcuugucgagguggcggacauggagcugcauacuaaaaagauugaaauaagcgguuugaaguucgcaucacuaaccugcacaggcuguuaugccugcaguuccgggaucagcuguaaaguacgcauucacguugaugagcccgacgaacugacugugcaugucaagucugaggauccugacaucguggcugccucaaguagccucauggcacgaaaacuggaauuuggaaccgauuccacauucaaggcuuucucugccaugccaaaaaccucgcuuugcuuuuacauagucgagagagaguauuguaagagcugcuccaaggaagacacucagaaaugugugaacacgaagcuggagcaaccccagucaauuuugaucgaacacaaaggcacaaucauugguaagcagaacgauaccugcacugcgaaagccaguugcuggcucgagucuguuaagagcuucuuuuacgggcugaagaauauguuauccggcaucuucggaaacguguuuauuggcauauuccuguuucuagcaccguucgcucuccugauccucuuuuucauguuuggguggaggauuuuguucuguuuuaaaugcugucggcguacccgcggacuguucaaguauagacaccucaaagacgacgaggaaacagguuacaggaagaucaucgagcggcugaauaacaaaaagggcaagaauaaacuucuggauggggaacgauuggccgaccgcaagauugcugagcuuuucucaaccaaaacucauguagga

SEQ ID NO: 10760 - RNA, 1932 nt, Artificial Sequence
  derived and/or modified CDS sequence (opt3) from CCHFV(Baghdad 12)__AJ538197.2__Gc
uuccuggacagcaucgugaagggcaccaaaaaccuccuuaauuccacaucucuggagacuucauugaguauugaagcccccuggggugcuauaaacguccagagcacguacaagccuaccguuuccacagcaaauaucgccuuaucuuggucgucaguggagcacagaggaaacaaaauucugguaagcgguaggagugaauccaucaugaagcuagaggaacggacuggcauuucuugggaucucgggguggaggacgcgagcgaguccaaacugcuuaccgucucagugauggaucugagucaaauguauagcccaguuuuugaauacuugucuggagaccgccagguggaggaauggccgaaggcuacaugcaccggcgauugucccgagcgaugcgguuguacuacaucaaccugccuccauaaggaguggccucacucccguaauuggagauguaacccaacguggugcuggggagucgggacuggcuguaccugcuguggccuggacgugaaagaucuguucacagacuauauguuuguaaaguggaaaguugaauacaucaagacugaugccauagugugcgucgagcucaccagccaggaaaggcaguguaguuuaaucgaggcagggacacgguucaaucugggaucugugaccauuacgcuuuccgaaccccgcaacauccaacagaaauugccuccagagauuaucacucugcaucccagaauagaggaaggguuuuucgaccuaaugcacgugcagaagguccucagcgccucgacaguuugcaagcugcagucuugcacccauggcgugccuggggaucuucaaguauaucacauuggaaaucuguugaaaggcgacaaggugaacggucaccucauccauaaaauugagccacacuuuaauacuuccuggaugucaugggaugggugugaccuggacuacuauugcaacaugggagauuggccgaguuguacauacaccggcgucacgcagcauaaucacgcuagcuucgugaacuuacugaauaucgaaaccgacuacacaaaguccuuucacuuccauucuaaaaggguuacugcacacggcgauacaccccagcucgaccuuaaggugcggccuaccuauggggccggagagaucacuguccugguggaaguagcugauauggaguugcauaccaaaaagauugagauaagcggucuaaaguuugccucacugacaugcaccggcuguuacgcgugcaguuccgggaucagcuguaaaguucgcauucacguggacgaaccagaugagcucacuguccaugugaagucugacgaucccgacgucguggcagccucaaguagccugauggcucgaaaacuugaguucggaacggauuccacauuuaaggccuucucugcaaugccuaaaaccucgcugugcuucuauaucguugaaagagaauacuguaagagcugcuccaaggaggacacucagaaaugugugaacaccaaguuggagcaaccacagucaauacucauugaacacaaaggcacaaucaucgguaagcagaacaauaccugcacugcuaaaacaaguugcuggcuggagucuguaaagagcuuuuucuauggguuaaagaacaugcuguccggcauuuuuggaaauuucuuuaugggcaucuuccuauuucucgcccccuucauucugcuuauauuguuuuucauguuuggguggaggauccuguucuguuuuaaaugcugucggcguacgcgcggacucuucaaguacagacaccugaaagacgaugaagagaccgguuauaggcggauuaucgagcgacuuaacaauaagaaaggcaagaacaagcuguuggacggggaacgccucgcggauagaaggaucgccgagcuguucucaacuaaaacacauauugga

SEQ ID NO: 10761 - RNA, 1932 nt, Artificial Sequence
  derived and/or modified CDS sequence (opt3) from CCHFV(VLG/TI29414)__AY179961.1__Gc
uuccuggacagcaucgugaagggcaugaaaaaccuccuuaauuccaccaaccuggagacaucuuugucaauugaagcccccuggggagcuauaaauguccagaguacuuuuaagccuacgguuagcaccgcaaacaucgccuuauccuggucuucgguggagcacagagggaauaaaauucugguaacagguaggucagaaagcaucaugaagcuagaggaacggacuggcgugaguugggaucucggggucgaggacgcguccgagucuaaacugcuuaccgugagcauuauggaucugucccaaauguacucaccaguuuucgaauauuugaguggagaccgccagguggaggaauggccgaaggcuacaugcaccggcgauugucccgagcgaugcgguuguacuagcucuacaugccuccauaaggaguggccucacucccguaacuggagauguaauccaaccuggugcugggaagucgggacgggauguacuugcuguggcuggaacgugaaagaccuguuuaccgaucauauguucguaaaguggaaaguugaguacaucaagacagaagccauagugugcgucgagcugacuucacaggaaaggcaguguagccucaucgaggcaggcacccgguuuaauuuagggcccgugacaauuacccugagugagccucgcaacauccaacagaaacuuccacccgaaauuaucacguugcacccuaagguggaggaaggauucuuugaccugaugcauguccagaagguucuaucugccuccacugugugcaaacuccagagcugcacacacgguauaccaggcgaucugcaaguauaucacauugggaaucuucugaagggagacagagugaacggccauuugauccacaaaauugagccgcauuucaauaccucguggaugucuugggaugguugugaccucgauuacuauugcaacaugggggacuggcccuccuguacuuacacaggaaugacccagcacaaucacgcugcauuugucaaccuguuaaacaucgaaacggacuauaccaagacauuccauuuucacucaaaaagggugacugcccauggcgauaccccucagcuggaccucaaggcucggccaacauacggcgccggggagaucacuguucuuguggaggucgcggauauggaacugcacaccaaaaagguggagauuaguggauugaaguucgcaagccuagccugcacagguuguuacgcuugcuccucuggcauaagcuguaaaguacgcauccauguugacgaacccgaugagcugaccgugcacgucaagucaaaugacccugaugugauugccgcaaguacuucccucauggcucgaaaacuggaauuugggacggacagcacauucaaggccuucucugcgaugccaaaaaccucacuuugcuuuuauaucgccgagagagaguacuguaagaguugcagcgaagaggauacucagaagugugucgacaccaaacuggaacaaccccaguccauauugauugagcacaagggaacaaucaucggcaaacagaacgauaccugcacugcaaaggcuucuugcuggcucgagucggugaaauccuucuuuuauggucugaagaauauguuagggagcguuuucggcaacuuuuucauuggaauccugcuauuucucgccccguucgugcugcuuguauuguuuuucauguuuggcuggaagauucuguucuguuuuaaaugcuguaggcggacacgugggcuccugaaguaccgccuucugaaagacgacgaagagacgggauauagaaggauaaucgaacgguugaauaacaagaaagguaagaaucgacuccuggauggcgagcgcuuagcugacagaaagauugccgaacuguucucaaccaaaacucauaucggg

SEQ ID NO: 10762 - RNA, 1932 nt, Artificial Sequence
  derived and/or modified CDS sequence (opt3) from CCHFV(TADJ/HU8966)__AY179962.1__Gc
uuccuggacagcaucgugaagggcaugaaaaacccccucaauuccaccucucuugagacaucacugaguauugaagccccuuggggagcuauaaacguccagagcacuuacaagccaacgguuuccaccgcaaauaucgccuugucuuggucgucaauugagcacagagggaacaauaucuuagugagcgguaggagugaauccauuaugaaacuggaggaacggacaggcaucucuggggaucuaggaguagaggacgcgagcgaguccaagcuccugacugugucagucauggaucuuagucaaauguauagcccgguguuugaauaccugucuggcgaccgccagguugaggaauggcccaaagcuaccugcacaggugauuguccugagcgaugcggguguaccuccucaacuugcuugcauaaggaguggccacacagccguaacuggagauguaaucccacauggugcuggggagugggcaccggcuguacgugcugugggcucgacgucaaggaucuguucauagacuauauguuugugaaauggaagguagauuacaucaaaacugaagccauuguuugcguggagcugaccagucaggaaaggcaguguucucucgucgaggcaggaacacgguucaacuuagguccugugacuaucacccuguccgaaccacgcaauauucaacagaaacuucccccugagaucauaacauugcauccaagaauugaggaaggcuuuuucgaccugaugcacgugcagaagguccuaagcgccucgaccguuugcaagcuccagucuugcacgcauggggugccgggagaucugcaaguauaucacaucggcaaccuucugaagggugacaaagagaaugggcacuugauucauaagaucgaaccccacuuuaacacuuccuggaugucaugggauggaugugaccucgacuacuauugcaauaugggcgauuggccuaguuguacauacaccggcgugacucagcauaaccacgcuagcuucgucaaucuguuaaacaucgagacagacuacaccaaauccuuucacuuccauucuaagagggugacggcacacggggauaccccacagcuggaccucaaagcccggcccacauauggagcuggugaaauuacuguucuuguggaggucgccgauauggagcugcauaccaagaaaauagaaaucacaggcuugaaguuugcgagccuaacuugcaccggguguuacgcaugcucaaguggaauuuccuguaaggugcgcauccacguagacgagccugaugaacugacaguucaugugaaaagcgacgauccagacgucguggccgcuucuucaagucucauggcccgaaagcuggaguucggcaccgauagcacuuuuaaagcauucuccgcuaugcccaagacgucucuuugcuucuauauagucgaaagagaguacaggaaaucguguagcaaggaggacacacagaagugcgugaacaccaaacuggaacaaccgcaguccauuuugaucgagcacaaggguacuaucauugggaaacagaauaacaccuguacagccaaggcgucaugcuggcucgaaaguguuaaaucuuucuuuuauggccugaagaauauguuaagcggaaucuuuggcaacguguucguagggauuuuucuguuccuagccccuuuuauacuccugauccuuuucuuuauguucggauggcggauuuuguccugcuuuaaguguugccgucgcaccagaggucugcucaaacacaggcaucugaaggacgaugaggagacuggcuaccggcgaaucaucgaacgccuuaauaacaaaaaggggaaaaauaagcuguuggacggagagagacucgcagauaggcggauugcugaacuguucucaacaaagacgcacauaggc

SEQ ID NO: 10763 - RNA, 1932 nt, Artificial Sequence
  derived and/or modified CDS sequence (opt3) from CCHFV(Hodzha)__AY223476.1__Gc
uuccuggacagcaucgugaagggcaccaaaaaccuccuuaauuccacaucucuggagacuucauugaguauugaagcccccuggggugcuauaaacguccagagcacguacaagccuaccguuuccacagcaaauaucgccuuaucuuggucgucaguggagcacagaggaaacaaaauucugguaagcgguaggagugaauccaucaugaagcuagaggaacggacuggcauuucuugggaucucgggguggaggacgcgagcgaguccaaacugcuuaccgucucagugauggaucugagucaaauguauagcccaguuuuugaauacuugucuggagaccgccagguggaggaauggccgaaggcuacaugcaccggcgauugucccgagcgaugcgguuguacuuccucaacaugccuccauaaggaguggccucacagccguaauuggagauguaacccaaccuggugcuggggagucgggacgggcuguacuugcuguggccuggacgugaaagaucuguucaccgacuauauguuuguaaaguggaaaguugauuacaucaagacagaagccauagugugcgucgagcucacuagccaggaaaggcaguguucuuuaguggaggcagggacccgguucaaucugggacccgugacaaucacccuuuccgaaccucgcaacauucaacagaaauugccacccgagaucauuacgcugcauccuagaaucgaggaaggguuuuucgaccuaaugcacguccagaagguucucagcgccucgacugugugcaagcugcagucuugcacacauggcguaccaggggaucuucaaguguaucacauaggaaaucuguugaaaggcgacaaggucaacggucaccucauucauaaaaucgagccgcacuuuaauaccuccuggaugucaugggaugggugugaccuggacuacuauugcaacaugggagauuggcccaguuguacuuacacaggcgugacccagcauaaucacgcuagcuucguuaacuuacugaauauugaaacggacuacaccaaguccuuucacuuccauucuaaaagggugacagcacacggcgauacuccucagcucgaccuuaaggcccggccaaccuauggggcuggagagaucacaguccugguggaaguagccgauauggaguugcauacuaaaaagaucgagauuaccggucuaaaguuugcgagccugacaugcaccggcuguuacgcaugcucaagugggauauccuguaaaguucgcauccacguggacgaacccgaugagcucacuguccaugugaagagugacgauccugacgucguggccgcuucuucaagucugauggcccgaaaacuugaauuuggaacggauagcacauuuaaggcauucuccgcuaugccaaaaaccucucugugcuucuauauuguugagagagaauacuguaagucgugcagcaaggaggacacucagaaaugugugaacaccaaguuggagcaaccccaguccauccucauagaaaggaaaggcacaauuaucgguaagcagaacaauaccugcacugccaaagcgucaugcuggcuggagaguguaaagucuuucuucuauggguuaaagaacaugcugagcggcaucuuuggaaaugucuucgugggcauuuuucuauuccucgccccguuuauccugcuuauuuuguucuuuauguucggguggcggauacuguuuuguuucaaaugcugucgucgcacaagaggacucuuuaaguacaaacaccugaaggacgaugaagagacggguuauaggcggaucauugagcgacuuaacaauaaaaagggcaagaacaaacuguuggacggggaacgccucgcagauagaaggaucgcugagcuguucuccaccaagacucacaucgga

SEQ ID NO: 10764 - RNA, 1932 nt, Artificial Sequence
  derived and/or modified CDS sequence (opt3) from CCHFV(Kosovo/9553/2001)__AY675511.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucguuaaguggaaaguggaauacaucaagacagaggccauagucugcguggaacugacuagccaggagaggcaguguagucucaucgaagcagggacccgguuuaauuuaggacccgugacaauuacccugucugagccucgcaacauccaacagaaacuuccacccgagauuaucacguugcacccuaagauagaagaggguuucuuugaucugaugcauguccagaagguucuauccgccagcacugugugcaaacuccagucgugcacacacggcauuccaggggaccugcaaguauaucacaucggaaaucuucugaagggcgauagagugaacggucauuugauucacaaaaucgaaccgcauuucaauaccucuuggauguccugggacgggugugaucucgacuacuauugcaacaugggagacuggcccucauguacuuacacaggcgucacccagcacaaucacgcugcauuugugaaccuguuaaauaucgagacggauuauaccaagacauuccauuuucacaguaaaaggguuacugcccauggcgacaccccucagcuggaucucaaggcucggccaacauacggggccggagaaauuacugugcuugucgagguggcggacauggagcugcacaccaaaaagguagaaauaagcgguuugaaguucgcaucccuagccugcacaggcuguuacgcuugcucuagcgggaucucauguaaaguucgcauucauguggaugagcccgacgaacugaccguccacgugaagaguuccgauccugacgucguggccgcaagcacuucucucauggcucgaaaacuggaguuuggaacggauucaacauucaaggccuucagugcgaugccaaaaaccagccuuugcuuuuauaucguugaaaaggaguacuguaaguccugcucugaggacgauacuaaaaaguguguggacaccaaacuggaacagccccaaucgauauugauugagcacagaggcacaaucaucgguaagccgaacgauaccugcccugccaaaacuagcugcuggcucgaauccguaaagucauucuuuuaugggcugaagaacauguuaggcagugucuucggaaacuuuuucauuggcauccugcuauuucucgcacccuucuuucuguggaugcuuucuuucauguuuggguggaaaauuuuguucuguuuuaagugcuguaggcggacacguggacuguucaaauaccgccaucucaaggacgacgaggagacggguuauagaaggauaaucgaacggcugaauaauaaaaagggcaagaaccgacuucuggauggggagcgcuuggcugacagaaaaauugccgaacucuucagcaccaagacucacaucgga

SEQ ID NO: 10765 - RNA, 1932 nt, Artificial Sequence
  derived and/or modified CDS sequence (opt3) from CCHFV(SPU41/84)__AY900142.1__Gc
uuccuggacagcaucgugaagggcaugaaaaaccuccuuaauuccaccucucuggagacaucauugaguauugaagcccccuggggugcuauaaacguccagagcacuuacaagccuacgguuuccaccgcaaauaucgccuuaucuuggucgucaguggagcacagaggaaacaaaauucugguaagcgguaggagugaauccaucaugaagcuagaggaacggacaggcauuucuugggaucucgggguggaggacgcgagcgaguccaaacugcuuacugucucagugauggaucugagucaaauguauagcccaguuuuugaauacuugucuggagaccgccagguggaggaauggccgaaggcuaccugcacaggcgauugucccgagcgaugcgguuguaccuccucaacuugccuccauaaggaguggccucacagccguaauuggagauguaacccaacauggugcuggggagucgggaccggcuguacgugcuguggccuggacgugaaagaucuguucacugacuauauguuuguaaaguggaaaguugaauacaucaagaccgaggccauagugugcgucgaacucacaagucaggagaggcaguguucuuuaaucgaagcagggacucgguucaaucugggacccgugaccauuacacuuuccgagccucgcaacauccaacagaaauugccacccgagauuaucacccugcauccuagaauagaagagggguuuuucgaucuaaugcacgugcagaagguccucagcgccucgacgguuugcaagcugcagucuugcacucauggcgugccaggggaccuucaaguauaucacauuggaaaucuguugaaaggcgauaaggugaacggucaccucguccauaaaaucgaaccgcacuuuaauacauccuggaugucaugggacgggugugaucuggacuacuauugcaacaugggagacuggcccaguuguaccuacacuggcgugacacagcauaaucacgcuagcuucguuaacauguuaaauauugagaccgauuacacgaagaacuuucacuuccauuccaaaagggugaccgcacacggcgacacaccucagcuggaucucaaggcccggccaacuuauggggcuggagaaaucaccguccuuguggagguagccgacauggagcugcauacaaagaagaucgaaauuucugguuugaaguuuacuagccuaaccugcacaggcuguuacgcgugcucaagugggauauccuguaaaguucgcauccacguggaugagcccgacgaacugaccguccaugugaaaagcgaggauccugacgucguggcagccucuucaagucucauggcucgaaaacuggaauuuggaacugauagcacguuuaaggccuucuccgcaaugccaaaaacaucucuuugcuucuauauuguugagagagaguacuguaagucgugcagcgaagaggacacccagaagugugugaacacuaaacuggaacaaccccaguccaucuugauagagaggaagggcaccauuaucgguaaacagaauaacacaugcaaggcuaaagccgggugcuggcucgagucaguaaagaguuucuucuauggccugaagaauauguuaucuggaaucuuuggcaacgucuucauugggaucuuucuguuccuagcgccguuuauucuccugauacuuuucuuuauguucggauggcggaucuuguuuuguuucaaaugcugucgucgcaccagaggucuguuuaaguacaggcaccucaaagaugacgaagagacuggcuaucggaagauuaucgaacgacugaauaacaaaaaggggaagaauaaacuucuggacggagagcgcuuggccgauagaaggaucgcagaacucuucagcacaaagacgcacauuggc

SEQ ID NO: 10766 - RNA, 1932 nt, Artificial Sequence
  derived and/or modified CDS sequence (opt3) from CCHFV(UG3010)__AY900143.1__Gc
uaccuggacagcaucgccaagggcaugaaaucccuccuuaacucuaccaaucuggagacaucauugaguauugaagcucccuggggagcaauaaacgugcagagcacuuucaagccuacggucuccgccgcgaauaucgcuuuaucuuggucgucaguugagcacagagggaacaaaauucuggugagcgguaggagugaauccaucaugaagcuagaggaacggaccggcauuucuuggagccucgggguagaggaugccuccgagucaaaaacacugacugugagugucauggaccuuagccaaauguauucuccaguguuugaauaccuguccggagaucgccagguugaggaauggccgaaggcaaccugcacaggcgacugucaggagcgaugcgguuguaccucaagcacuugcuugcauaaggaguggccccacagucguaauuggagauguaacccuacauggugcuggggaguggggaccggcuguacgugcuguggccucgaugucagggaccuguucacugauuauaugauggugaaauggaagguagaauacguuaaaaccgaggccaucaugugcguggaacugacaucucaggagcggcaauguucccucauagaagcugggacucgcuuuaauuuaggaccagucaccaucacacugagcgagcccagaaacauucagcagaggcuuccuucggagaucgugaccuugcauccaaagauugaagaggguuucuuugaccugaugcacgugcagaaaguccuaucugcauccacgguuugcaagcuccaaucaugcacucauggcgugcccggggaucugcagguauaucacgugggaaaucuucugaagggcgacaaagucaacggucacaguauccauaagauagaaagccacuucaauacauccuggaugucuugggaugggugugacuuggauuacuuuugcaacaugggagacuggccuagcuguaccuauacuggcgugacacagcauaaucgggccgcuuucauuaacaugcucaauaucgagaccgacuacacgaaaaccuuucacuuccacucaaagcgcguuacagcccauggcgauacuccacagcuggacuuaaaagcgcgaccgaccuacggggcaggagaagugacaguccugguggagguagccgaucucgagcuucacacuaagaaaauugaaguuaguggucugaaguuugcuuccuugaccugcagcggcuguuaugccuguucuucagggaucaguugcaaggugagaauccaugucaacgagcccgacgaguucacagugcacgucaaaagcuccgauccugacgugguugcagcuggaucuucgcuaauggccaggaagauugaauuuggcgcggauagcaccuucaaagccuucuccucaaugccaaagaacagucugugcuuuuacauaguggaacgggacuauuguucuagcugcacuaaugaugacacgcaaaaauguguagauacaaagcucgagcauccccaguccauccugauugagcacaaggguaccaucauagggaaacagaacgacacuugcucaaccaagacaagcugcuggcuugaaucugucaaauccuucuuuuacggccugaagaauauguugggaggcauuuucgggaacguguuucucggaaucuuccuguuuuuagcaccuuucgcucugcuaaucuuuuucuuuuucuuugguuggcgucuccuguucugucuuaaaugcugucgcagaaccaggggcuugcugaaguauaagcaacucaaagacgaggaagaggccggguacaagaaaauuaucgagcggcugaaugauaagaaaggaaagagucgacuuuucgacggcgaacgccuggcugauagaaagauugccgaguuguuuagcacuaaaacacacauaggu

SEQ ID NO: 10767 - RNA, 1932 nt, Artificial Sequence
  derived and/or modified CDS sequence (opt3) from CCHFV(Hy13)__AY900145.1__Gc
uucagcgacuccaucgugaagggcaugaaaaaccugcucaauucuaccucacuugagacaagucugagcauugaagcccccuggggagcuauaaacguccaguccacuuuuaagccuacgguuucugcagccaauaucgcguugucguggucaagcguggagcacagagggaacaaaauuuuaguaagugguagguccgaaucuaucaugaagcuggaggaacggaccggcauuagcugggaucuagggguggaggacgcuuccgagucaaaacuccugacagucaguaucauggaucuuagccaaauguacucuccaguguucgaauaucuguccggagaccgccagguugaggaauggccgaaggccacuugcaccggcgauugucccgagcgaugcgguuguacaucaaguaccugcuugcauaaggaguggccucacagucguaauuggagauguaacccaacuuggugcuggggaguggggacaggcuguaccugcuguggccucgacgucaaagaucuguuuacggaccauauguucgugaaguggaaaguagaauacauaaagacugaggcaaucguuugcguggaacugaccucucaggagaggcaguguucccucauugaagccgggacacgguuuaauuuaggacccgucacuaucacccugagcgagccucgcaacauucaacagaaacuuccacccgagaucgugacauugcacccuagaauagaagaggguuucuuugaucugaugcaugugaagaagguccuaucggcuucuaccguuugcaaacuccaguccugcacgcacggcgugccaggggaccugcagguauaucacauuggaaaucuucugaagggcgauaaagugaacggucauuugauccacaagauugaaccgcauuucaauacuucauggaugaguugggacgggugugaucucgacuacuauugcaacaugggagacuggcccagcuguuccuacacaggcgucacccaacacaaucacgcagccuuugugaacaugcugaauaucgagacugauuauacaaaaaucuuccauuuucacucuaagaggguuaccgcucauggcgacacgccucaguuagaucugaaagcccggccaaccuacggggcgggagaaauuacagugcucgucgagguggcagacauggagcuucacacuaagaagauagaaaucagcggucugaaauucgccucauugaccugcacaggcuguuacgcuugcaguuccgggauuagcuguaagguacgcauccauguugaugagcccgacgaacuaacugugcacgucaaaucugaggauccugacauaguggccgcaucaaguagccugauggcucgaaagcucgaauuuggaaccgauuccacauucaaagccuucucugcgaugccaaagaccucgcugugcuuuuauauugucgagagagaguacuguaagagcugcuccaaagaagacacucagaagugugugaacacgaaacuugagcagccccaaucaauccugaucgaacacaagggcacaauuaucgguaaacagaacgauaccugcacuagcaaggccgggugcugguuggagucuguuaagagcuucuuuuauggccucaaaaauaugcuguccggaauuuucggcaacguguuuauagggaucuucuuauuucuggcaccguucauucuacucauccuguuuuucauguuuggauggaggauccuuuucuguuuuaagugcugucggcguacccgcgguuuguucaaauacagacaucugaaggacgacgaggaaacaggcuauaggaaaauuauagagcggcucaauaacaagaaggggaaaaauaagcugcuugauggagaacgacuggcugaccgcaaaaucgccgaguuguucucaaccaagacucacauuggc

SEQ ID NO: 10768 - RNA, 1932 nt, Artificial Sequence
  derived and/or modified CDS sequence (opt3) from CCHFV(Semunya)__DQ094832.1__Gc
uuccuggacagcaucgccaagggcaaaaagucccuccuuaacucuaccaaucuggagacaucauugaguauugaagcucccuggggugcaauaaacgugcagagcacuuuuaaaccuacggucuccgccgcgaauaucgcuuuaucuuggucgucaguugagcacagaggaaacaagauucuggugagcgguaggagugaauccaucaugaaacuagaggaacggaccggcauuucuuggagccucgggguagaggaugccuccgagucaaagacacugacugugagugucauggaccuuagccaaauguacucuccaguguucgaauaucuguccggagaucgccagguugaggaauggccgaaggcaaccugcacaggcgacugucccgagcgaugcgguuguaccucaagcacuugcuugcauaaagaguggccucacagucguaauuggagauguaacccaacauggugcuggggaguggggaccggcuguacgugcuguggccucgaugucagggaccuguuuacugauuacaugauggugaaguggaaaguagaauauguuaagaccgaggccaucaugugcguggaacugacaucucaggagcggcaguguucccucauagaagcugggacucgcuucaauuuaggacccgucaccaucacacugagcgagccuagaaacgugcaacagaggcuuccaucggagauugugaccuugcaucccaaaaucgaagagggguuuuucgaccugaugcacguccagaagguucuauuuugcaaguacucucuccaggcaacguccugcacucauggcgugccuggggaucugcaaguauaucacgugggaaaucuucugaaaggcgacaaggucaacggucacucaauucauaaaaucgaaagucacuucaauacaagcuggauguccugggaugggugugacuuggauuacuuuugcaacaugggagacuggccaucuuguaccuauacuggcgugacacagcauaaucgggccgcuuucguuaacaugcucaauauagagaccgacuacacgaagaccuuucacuuccacagcaaacgcgugacagcccauggcgauacuccgcagcuggacuuaaaggcgcgacccaccuacggggcaggagaagucacagugcugguagagguugccgaucucgagcuucacacuaaaaagauugaagugucaggucugaaguuugcuaguuugaccugcuccggcuguuaugccugcagcucugggaucucauguaaagucaggauucaugugaacgagccugacgaauuuacaguccacgugaagaguaacgauccagacguuguggcagcuggaagcucccuaauggccagaaaaaucgaguucggcgcggauucuaccuucaaggccuucucgagcaugcccaaaaauucccugugcuuuuacaucguagaacgggacuauuguucaaguugcacugaugacgauacgcagaagugugucaacauuaagcucgagcauccucaaucuauacugaucgagcacaaagguacaauuaucgggaagcagaaugauaccugcccaacuaaaaccagcugcuggcuugaauccgugaagucauucuuuuacggccugaaaaacauguugggaggcauauucgggaauguuuuucucggaauuuuccuguuuuuagcacccuucgcucugcuaauccucuuuuucuuuuucgguuggcgucugcuuuucuguuugaagugcugucgcagaacaaggggccugcucaaguauaaacagcugaaggacgaggaagaggccggguacaaaaagaucauugagcggcuuaacgacaaaaagggaaagagccgacuguuugacggcgaacgcuuggcugauagaaaaaucgccaaacucuucucuaccaagacucacauuggu

SEQ ID NO: 10769 - RNA, 1932 nt, Artificial Sequence
  derived and/or modified CDS sequence (opt3) from CCHFV(SPU128/81/7)__DQ157174.1__Gc
uuccuggacagcaucgugaagggcaugaaaaaccuccuuaauuccaccucucuggagacaucauugaguauugaagcccccuggggugcuauaaacguccagagcacuuacaagccuacgguuuccaccgcaaauaucgccuuaucuuggucgucaguggagcacagaggaaacaaaauucugguaagcgguaggagugaauccaucaugaagcuagaggaacggacaggcauuucuugggaucucgggguggaggacgcgagcgaguccaaacugcuuacugucucagugauggaucugagucagauguauagcccaguuuuugaauacuugucuggagaccgccagguggaggaauggccgaaggcuaccugcacaggcgauugucccgagcgaugcgguuguaccuccucaacuugccuccauaaggaguggccucacagccguaauuggagauguaacccaacauggugcuggggagucgggaccggcuguacgugcuguggccuggacgugaaagaucuguucacugacuauauguuuguaaaguggaaaguugaauacaucaagaccgaggccauagugugcgucgaacucacaagucaggagaggcaguguucuuuaaucgaagcagggacucgguucaaucugggacccgugaccauuacacuuuccgagccucgcaacauccaacagaaauugccacccgagauuaucacccugcauccuagaauagaagagggguuuuucgaucuaaugcacgugcagaagguccucagcgccucgacgguuugcaagcugcagucuugcacucauggcgugccaggggaccuucaaguauaucacauuggaaaucuguugaaaggcgauaaggugaacggucaccucauccauaaaauugaaccgcacuuuaauacauccuggaugucaugggacgggugugaucuggacuacuauugcaacaugggagacuggcccaguuguaccuacacuggcgucacacagcauaaucacgcuagcuucgugaacuuacugaauaucgagaccgauuacacgaagaacuuucacuuccauuccaaaaggguuaccgcacacggcgacacaccucagcucgaucuuaaggcccggccaacuuauggggcuggagaaaucaccgugcuggucgagguggccgacauggaguugcauacuaaaaagauugaaauaucuggucuaaaguuugcgagccugacaugcaccggcuguuacgcaugcucaagugggaucuccuguaaaguacgcauucacguugaugagcccgacgaacucacagugcaugucaagagcgaugacccugauguggucgccgcuucuucaagucugauggcccgaaaacuugaguucggaaccgacagcacuuuuaaggcauucuccgcuaugccaaaaacgucucugugcuucuauaucguggaaagagagcacuguaagucgugcagcgaggaagauacaaagaaauguguuaacaccaaguuggagcagccccaauccauacucauugaacacaaaggcacuaucaucgguaagcaaaauucaaccugcacagccaaagcgaguugcuggcuggagucuguaaagagcuuuuucuacggguuaaagaacaugcuguccggcauuuuuggaaauguguucaucggcauuuuucuauuccucgggccguuuauacugcuuaucuuguucuuuauguucggauggaggauucuguuuuguuucaaaugcugucggcguacccgcggucuccugaaguauagacaucuuaaagaggacgaagagacuggcuacaggcggaucaucgaacgacugaacaauaagaaagggaagaacaaguugcucgacggagagcgccuggccgauagaaggauugcagaauuauuuucaacaaaaacgcacauaggc

SEQ ID NO: 10770 - RNA, 1932 nt, Artificial Sequence
  derived and/or modified CDS sequence (opt3) from CCHFV(ROS/HUVLV-100)__DQ206448.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucguuaaguggaaaguggaauacaucaagacagaggccauagucugcguggaacugacuagccaggagaggcaguguagucucaucgaagcagggacccgguuuaauuuaggacccgugacaauuacccugucugagccucgcaacauccaacagaaacuuccacccgagauuaucacguugcacccuaaggucgaagaggguuucuuugaucugaugcauguucagaaggugcuauccgccagcacuguaugcaaacuccagucgugcacacacggcauaccaggggaccugcaaguguaucacauuggaaaucuucugaagggcgauagagucaacggucauuugauccacaaaauugaaccgcauuucaauaccucuuggauguccugggacgggugugaucucgacuacuauugcaacaugggagacuggcccucauguacuuacacaggcgugacccagcacaaucacgcugcauuuguuaaccuguuaaauaucgagacggauuauaccaagacauuccauuuucacaguaaaagggugacugcccauggcgacaccccucagcuggaucucaaggcucggccaacauacggggccggagaaaucacuguccuuguggagguagcggacauggagcugcacaccaaaaagguugaaauuagcgguuugaaguucgcaucccuagccugcacaggcuguuacgcuugcucuagcgggauaucauguaaagugcgcauccaugucgaugagcccgacgaacugaccgugcacgucaagaguuccgauccugacgugguugccgcaagcacuucucucauggcucgaaaacuggaguuuggaacggauucaacauucaaggccuucagugcgaugccaaaaaccagccuuugcuuuuauauuguggaaagagaguacuguaaguccugcucugaggaagacacucagaaguguguagauaccaaacuggagcaaccccagucgaucuugauagaacacaagggcacaauuaucgguaaacagaacgauaccugcacugccaaggcaagcugcuggcucgaguccgucaaaucauucuuuuaugggcugaagaacauguuaggcaguguguucggaaacuuuuucaucggcauucugcuauuucucgcuccguucguucugcuuguguuguuuuucauguuuggguggaagauccuguucuguuuuaaaugcuguaggcggacacguggacuccugaaguaccgccuucugaaagacgacgaggaaacggguuauagaaggauuauagagcgguugaauaauaagaaaggcaagaaccgacuccuggacggggaacgcuuagccgauagaaagaucgcugagcuguucucuaccaaaacucauauugga

SEQ ID NO: 10771 - RNA, 1932 nt, Artificial Sequence
  derived and/or modified CDS sequence (opt3) from CCHFV(AP92)__DQ211625.1__Gc
uuccuggacagcaucgccaagggcgugaaaaaccuccuuaauuccaccucucuggagacaucauugaguauugaagcucccuggggagcaauaaacgcccagagcacuuacaagccuacggcguccucugcuaauaucgccuuaaccuggucgucagucgagcacagagggaacaaaauucugguuagcgguaggagugaauccaucaugaagcuagaggaacggacaggcauuucuuggaaucucgggguggaggaugcaagcgagucccgcacucugaccaucucaguaauggaccuuagucaaauguauagcccaguguuugaauaccugucuggagaucgacaggucgaggaauggccgaaagccacaugcaccggcaacugucccgagcguugcgguuguacuuccucaacaugcuuguauaaggaguggccucauagcagaaauuggagguguaacccaaccuggugcuggggaguggggacgggcuguacuugcuguggccucgacguuaaggaacuguucaccgaucacaugcuggugaaauggaaggucgaguacauaaaaacagaagcuaucgugugcguagagcucaccagucaggaacggcaguguucuuuaauugaggcagggacucgcuuuucccugggacccguuacaaucacccuuagcgagccuagaaauauucaacagaaguugccacccgaacugaucacgcuacauccuaaaauagaggacgguuauuucgaucucaugcacgugcagaaggucaugucggccucuacugugugcaagcugcaguccugcacacauggcgugccaggggaccuucaaauuuaccacgucggaaaccuguugaaaggcgauaggguuaauggucaccucauccauaagguggaaccgcaccugaacaccucauggaugaguugggacgggugugauuuagacuauuuuugcaauaugggagauuggcccagcuguacuuacacaggcguaacccagcauaaccacgcugccuucgcgaaucugcucaacauugagacggacuacaccaaaacauuucacuuccauuccaagcgggugacugcacacggcgacaccccucagcuugaucugaaagcccgcccacgauauggggcuggagaaaucacagucuugguggagguugccgacauggagcuacauacuaagaaaguggaagucaccggucugaaguuugcaucucucacaugcagcggcuguuacgcuugcucaagugggaucuccuguaaggugaggauucacguagaugagcccgacgaacugaccguucaugugaaaagcucugauccugacauagucgccgcgucaaguagccuuauggccagaaagaucgaguucggaguggauuccacuuuuaaagcauucucuucgaugccaaaggacagccugugcuuuuauauugucgaacgggauuacuguaacuccugcaaaaaugaggagacgcagcguugugugaacgcuaaguuggaacaaccccagucaauccucauagagcacacaggcaccauuaucgguaagcagaaugacacuugcgggagucgcaccucuugcuggcuggauagcuucaaauccuucuuuuauggcuuaaagucaaugcugagcggaaucuucggcaacguuuuucuagggauuuuccucuuucuggccccguucgcucuuuugcuguuuuucuuuuucuuuggauggagaauccucuucuguuuuaaaugcuguaggcggacacgaggucuguucaaguaccgccacauuaaagacgacgaagaggugggcuauaagaagauaaucgagagacuuaauaacaaaaaggggaaacauaggcuguuggauggagaacggcucgccgaccgcaagauugcagagcuguucucuaccaaaacucacaucggc

SEQ ID NO: 10772 - RNA, 1932 nt, Artificial Sequence
  derived and/or modified CDS sequence (opt3) from CCHFV(ArD8194)__DQ211626.1__Gc
uuccuggacagaaucgccaagggcaugaaaagccuccuuaacuccaccucucuggagacaucauugaguauugaagcucccuggggugcaauaaaugugcagagcacuuuuaagccuacggucuccgccgcgaacaucgcuuuaucuuggucgucaguugagcacaaaggaaauaagauucuggugagcgguaggagugaauccaucaugaaacuagaggaacggaccggcauuucuuggugccucgggguagaggaugccagcgaguccaagacacugacugugucagucauggaccuuagucaaauguacagcccaguguucgaauaucugucuggagaucgccagguugaggaauggccgaaggcaaccuguacaggcgacugccccgagcgaugugguugcaccuccucaacuuguuugcauaaagaguggccucacagccguaacuggagaugcaauccaacaugguguuggggaguggggaccggcugcacguguugcggccucgaugucaaggaccuguuuacugauuacaugcuggugaaauggaagguagaauauaucaaaaccgaggccauaaucuguguugaacucacaagucaggagaggcagugcucuuuaauugaagcugggacucgguucaaccugggacccgugaccaucacacuuuccgagccucgcaauguccaacagagauugccacccgagauuaucacccugcauccuaagauagaagagggguuuuucgaccuaaugcacgugcagaaggugaugagcgcaucgacggucugcaaacuccagucuuguacucauggcguuccaggggaucugcaaguguaccacguaggaaaccuucugaagggcgacaaagugaauggucacuccauucauaagaucgaaucacacuugaacacaaguuggaugagcugggaugggugcgaccucgauuauuuuuguaauaugggagacuggccguccugcaccuacacuggcgucacacagcauaaccacgccgcuuucauuaauaugcugaacaucgagaccgacuauacgaaaaccuuucacuuccauucuaagagggugacagcccacggcgauacuccccaguuagaccugaaagcgcggccugcauacggggccggagaaaucaccguucucguggaggucgcugaucuugagcugcauacaaagaagauugaagugagcgguuugaaauuugccucacuaaguuguuccggcugcuacgcauguagcucugggauaucaugcaagguacgcauccacguuaaugagccagacgaauuuacugugcaugucaaaaguaacgaucccgacguggucgcugccggaagcucccugauggcgcgaaagauugagucuggcgccgauucgaccuuuaaagcauucagcuccaugccuaagaacucacucuguuucuauaucguggaaagagacuacugcaguucuuguacagaugacgauacccagaagugcguugacauaaaacuggagcacccacaaagcauucuuaucgagcacaaggguacuaucauugggaaacagaaugacacgugccccacaaagaccuccuguuggcuggaaucaaucaagagcuuuuucuauggcuugaaaaacaugcucucuggaauuuuuggcaauguguuccuggggauguuacuguuucuagcuccguucauacuccugauccuuuucuucuuuuucggauggagguugcuguuuugccucaaguguugccggcguacucgcaaacugcuuaaguacaaacaucugagagaugaggaagaguccgguuauaagaaaauuaucgagagguugaacgacaagaagggcaaaagucgacucuucgauggggaacggcuggccgaccgcaagaucgcugaguuauuuagcaccaaaacacacauugga

SEQ ID NO: 10773 - RNA, 1932 nt, Artificial Sequence
  derived and/or modified CDS sequence (opt3) from CCHFV(ArD15786)__DQ211627.1__Gc
agccuggacuccaucgccaagggcaugaaaucucuccuuaacucaaccagucuggagaccagcuuguccauugaagcucccuggggagcaauaaaugugcagucuacuuucaagccuacgaucucggccgcgaacauugcuuuaucauggagcagugucgagcacaaagggaauaagauccugguuuccgguagaucugaaagcauuaugaaacuagaggaaaggaccggcaucuccuggugccucgggguggaggaugccucagagaguaagacacugacuguaagcgugauggaccuuucucaaauguacuccccagucuuugaauaucugucaggagaucgccagguggaggaauggccgaaggcaaccuguacaggcgacugccccgagcggugugguugcaccagcaguacuuguuugcauaaagaguggccucacucucgaaacuggcguugcaauccaacaugguguuggggaguugggaccggcugcacguguugcggccucgaugugaaggaccuguucacugauuacaugcuggucaaauggaagguggaauauauaaaaaccgaggccaucauuuguguagaacucacaucccaggagagacagugcagcuuaaucgaagcugggacuagguuuaaccugggacccguuaccauuacacuuucggagccucggaaugugcaacagcgcuugccacccgagaucauaacccugcauccuaagauugaagaggguuucuuugaccuaaugcacguccagaaggugaugucugcauccacggugugcaaacuccagucauguacucauggcgucccaggggaucugcaaguuuaccacgugggaaaccuucugaagggcgacaaaguaaauggucacaguauccauaagauugaaagccacuugaacacauccuggaugucuugggaugggugcgaccucgauuauuucuguaauaugggagacuggccgagcugcaccuacacuggcgugacacagcauaacagagccgcuuuuaucaauaugcugaacaucgagaccgacuauacgaaaaccuuccacuuucacucaaagagggucacagcccauggcgauacuccccaguuagaccugaaagcgcggccuaccuacggggcaggagaaauuacagugcucguugagguggccgaucuugagcugcacacuaagaagauagaagucagugguuugaaauucgcuucccuaaccuguagcggcugcuacgccuguucuucagggaucaguugcaaggugcgcauucauguaaaugagccagacgaauuuacaguucacgugaaaagcaacgaucccgacgucguggcagcuggauccucucugauggcccgaaagaucgagucgggcgcggauagcaccuucaaagccuuuuccucaaugccuaagaacagucucuguuucuauauagucgaaagagacuacugcucuagcuguacugaugacgauacgcagaagugcguggacauuaaacuggagcauccacaauccauccuuaucgagcacaaggguacaauuaucgggaaacagaaugacacaugccccacuaagaccucauguuggcuggaaagcauuaaaucuuucuuuuauggcuugaagaacaugcucuccggaauauucggcaauaucuuucuggggauguuacuguuccuagcaccguuuguucuccugauucuuuucuuuuucuuuggauggagguugcuguucugccucaaguguugccggcguacacgcaaacugcuuaaguacaaacaccugagagaugaggaagagagugguuauaagaaaaucaucgagagguugaacgacaagaagggcaaaagccggcucuuugauggggaacgacuggcugaccgcaagauugccgaguuauucucuaccaaaacucauguggga

SEQ ID NO: 10774 - RNA, 1932 nt, Artificial Sequence
  derived and/or modified CDS sequence (opt3) from CCHFV(ArD39554)__DQ211628.1__Gc
uuccuggacagcaccgccaaguccaugaaaucucuccuuaacucaacaagucuggagacuagcuuguccaucgaagcucccuggggcgcaauuaaugugcagucuacguuuaagccuaccgccucgacagcgaacauagcuuuaucauggagcagugucgagcacagagggaauaaaauccugguuacuggaagguccgaaucuauuaugaagcuagaggaacggaccgguaucagcuggaaccucggcguggaggaugccuccgagucaaaaacacugaccguaagugugauggaccuuagccaaauguacucuacugucuucgaauaucuguccggggaucgccagguggaggaauggccaaaggcaacaugcaccggagacuguccggagcgaugcggcuguacgucaagcacuugcuugcauaaggccuggccccacagucguaauuggagauguaacccuaccuggugcugggguguugggacaggauguacuugcuguggccucgaugugaaaaaucuguuuaccgacuacaugcugauuaaguggaaagucgaguucaucaagacagaagcuauagugugcguagagcucaccucucaggaaaggcaguguuccuuaaucgaggcaggcacgcgguuuaaccuggggccaguuacuauuacacuuagcgaaccccgcaauauccaacagaaauugccuccagagcuggugacccuacaucccagagucgaggaaggauucuuugaucucaugcacgugcagaaggugcugucggccucuacugucugcaagcuccaguccugcacacaugguguuccuggcgaccugcaaguguaucacguagggaacuugcucaaaggagauaagauuaauggcaacucauuccacaaaaucgagccaaaucugaacaccaguuggaugagcugggacgguugugauuuagacuacuauugcaauaugggggauuggccguccuguacguacaccggagugacacagcauaaccacgcugccuuugucaaccugcucaauauagaaacugacuauaccaagaacuuccauuuucacucuaaaagggugacagcgcacggcgagacuccccagcuugaccugaaggcacggccuaaauacggcgccggggaaguuaccguguuggucgagguggcugauauggagcuacauacaaagaagauugaaaucagcggacugaaauucgccucacuuaccugcacugguuguuacgcaugcaguuccggcauuagcuguaagguacgccugcacguugacgagccagaugaacuuacggugcaugucaaaucugacgaucccgacguggucgcugccucaaguagccugauggcgcgaaagaucgaguuugggacagauuccaccuucaaagccuucucuucgaugccuaaggacaaguugugcuuuuauaucguggaaagagauuacuguagcuccugcucaaaagaggacacucagaaguguguuaaugcaaaacucgagcaaccacagaguauucugauagaacacaagggaaccaucauuggcaaacagaacgauacaugcaccgugaaggcuucuugcugguuagagagcguaaaguccuucuuuuauggucugaaaaauaugcuagggggcaucuucggaaacgucauacucggcauuaucauguuucuggcccccuucgcucuuuugcugcucuuuuuccuguuuggguggaggauccuuuucugucugcggugcugucgucgcacuagaggauuguuuaaguacaaacauauuaaggacgacgaagagucagguuauaaaaggaucauugagcggcucaauaacaagaagggcaaaaauaagcuguucgauggggaacgauuagccgacaaaaagauagcagagcuguuuagcacaaaaacgcacaucgga

SEQ ID NO: 10775 - RNA, 1932 nt, Artificial Sequence
  derived and/or modified CDS sequence (opt3) from CCHFV(C-68031)__DQ211629.1__Gc
uucagcgacuccaucgugaagggcaugaaaaaccugcucaauucuaccucacuugagacaagucugagcauugaagcccccuggggagcuauaaacguccaguccacuuuuaagccuacgguuucugcagccaauaucgcguugucguggucaagcguggagcacagagggaacaaaauuuuaguaagugguagguccgaaucuaucaugaagcuggaggaacggaccggcauuagcugggaucuagggguggaggacgcuuccgagucaaaacuccugacagucaguaucauggaucuuagccaaauguacucuccaguguucgaauaucuguccggagaccgccagguugaggaauggccgaaggccacuugcaccggcgauugucccgagcgaugcgguuguacaucaaguaccugcuugcauaaggaguggccucacagucguaauuggagauguaacccaacuuggugcuggggaguggggacaggcuguaccugcuguggccucgacgucaaagaucuguuuacggacuacauguucgugaaguggaaaguagaauauauaaagacugaggcaaucguuugcguggaacugaccucucaggagaggcaguguucccucauugaagccgggacacgguuuaauuuaggacccgucacuaucacccugagcgagccucgcaacauucaacagaaacuuccacccgagaucgugacauugcauccuagaauagaagaggguuucuuugaucugaugcacgugaagaagguccuaucggcuucuaccguuugcaaacuccaguccugcacgcauggcgugccaggggaccugcagguauaccacauuggaaaucuucugaagggcgauaaagugaacggucacuugauccauaagauugaaccgcacuucaauacuucauggaugaguugggacgggugugaucucgacuauuacugcaacaugggagacuggcccagcuguuccuauacaggcgucacccaacauaaucacgcagccuuugugaacaugcugaauaucgagacugauuacacaaaaaucuuccacuuucauucuaagaggguuaccgcucacggcgacacgccucaguuagaucugaaagcccggccaaccuacggggcgggagaaauuacagugcucgucgagguggcagacauggagcuucauacuaagaagauagaaaucagcggucugaaauucgccucauugaccugcacaggcuguuaugcuugcaguuccgggauuagcuguaagguacgcauccacguugaugagcccgacgaacuaacugugcaugucaaaucugaggauccugacauaguggccgcaucaaguagccugauggcucgaaagcucgaauuuggaaccgauuccacauucaaagccuucucugcgaugccaaagaccucgcugugcuuuuacauugucgagagagaguauuguaagagcugcuccaaagaagacacucagaagugugugaacacgaaacuugagcagccccaaucaauccugaucgaacacaagggcacaauuaucgguaaacagaacgauaccugcacuagcaaggccgggugcugguuggagucuguuaagagcuucuuuuacggccucaaaaauaugcuguccggaauuuucggcaacguguuuauagggaucuucuuauuucuggcaccguucauucuacucauccuguuuuucauguuuggauggaggauccuuuucuguuuuaagugcugucggcguacccgcgguuuguucaaauauagacaccugaaggacgacgaggaaacaggcuacaggaaaauuauagagcggcucaauaacaagaaggggaaaaauaagcugcuugauggagaacgacuggcugaccgcaaaaucgccgaguuguucucaaccaagacucauauuggc

SEQ ID NO: 10776 - RNA, 1932 nt, Artificial Sequence
  derived and/or modified CDS sequence (opt3) from CCHFV(Drosdov)__DQ211630.1__Gc
uuccuggacagcaccgugaagggcaugaaaaaccuccuuaauuccacaucucuggagacuucauugaguaucgaagcccccuggggagcuauuaacguccagagcacguuuaagccuaccguuuccacagcaaauauagccuuaucuuggucgucaguggagcacagagggaacaaaauccugguaacugguaggagcgaaaguauuaugaagcuagaggaacggaccggcguguccugggaucucggggucgaggacgcgucugagagcaaacugcuuacaguguccaucauggaucugucacaaauguacaguccaguuuucgaauauuugagcggagaccgccagguggaggaauggccgaaggcuaccugcacuggcgauugucccgagcgaugcgguuguacaucuuccacaugccuccauaaggaguggccucacucacguaauuggagauguaacccaacguggugcuggggagucgggacuggcuguaccugcuguggcguggacguaaaagaucuguuuacagaccauauguucguuaaguggaaaguggaauacaugaagacugaggccauugucugcguggaacugaccagccaggagaggcaguguagucucaucgaagcagggacacgguuuaauuuaggacccgugaccauaacgcugucugagccucgcaacauccaacagaaacuuccacccgagauuaucacuuugcacccuaagauugaagaggguuucuuugaucugaugcauguccagaagguucuauccgccagcacagugugcaaacuccagucgugcacccacggcaucccaggggaccugcaaauauaucacauuggaaaucuucugaagggcgauagaguaaacggucauuugauccacaaaauugaaccgcauuucaauacuucuuggauguccugggacgggugugaucucgacuacuauugcaacaugggaaauuggcccucauguacauacaccggcgugacgcagcacaaccacgcugcauuugucaaucuguuaaacaucgagaccgacuauacaaagacuuuccauuuucacaguaaaagggugaccgcccauggcgauacaccucagcuggaccucaaggcucggccaacuuacggggccggagaaaucaccguucuuguggaggucgcggauauggagcugcacaccaaaaagguggaaauuagcgguuugaaguucgcaucccuaguaugcaccggcuguuacgccugcucuagcgggauaucauguaaaguucgcauccauguggacgagcccgaugaacugacuguccacgugaagaguuccgacccugaugucguggcugccagcacgucucucauggcacgaaaacuggaguuuggaacagacucaauuuucaaggcuuucagugccaugccaaaaaccagccuuugcuuuuauaucguugaaagagaguacuguaaguccugcucugaggaugacacuaagaaauguguggauaccaagcuggaacagccccaaucgauauugauugagcacaaaggcacaaucaucgguaagcagaacgauaccugcacugcgaaagccagcugcuggcucgaauccguaaagucauucuuuuaugggcugaagaauauguuaggcagugucuucggaaacuuuuucgugggcauucugcuauuucucgcaccguucguucugcuuguguuguuuuucauguuuggguggaaaauccuguucuguuuuaagugcuguaggcggacacguggacucuucaaauaccgccaucugaaggacgacgaggagacggguuauagaaggauuauagaacggcuuaauucuaaaaagggcaagaaccgacuguuggacggggagcgccucgcugauagaaaaaucgccgaacuguucagcaccaagacucacauugga

SEQ ID NO: 10777 - RNA, 1932 nt, Artificial Sequence
  derived and/or modified CDS sequence (opt3) from CCHFV(Kashmanov)__DQ211631.1__Gc
uuccuggacagcaucgugaagggcaugaaaaacucccucaauucuaccucacuugagacaagucugagcauugaagcccccuggggagcuauaaacguccaguccacuuuuaagccuacgguuucuaccgcaaauaucgccuugucguggucaagcguggagcacagagggaacaaaauuuuaguaacagguaggagugaauccaucaugaagcuggaggaacggacuggcgugucuugggaucuaggggucgaggacgcgagcgaguccaaacuccugaccgugucaauuauggaucuuagucaaauguacagcccaguuuucgaauaucugucuggagaccgccagguggaggaauggccgaaggcuacaugcaccggcgauugucccgagcgaugcgguuguacuuccucaacaugcuugcauaaggaguggccucacagccguaauuggagauguaacccaaccuggugcuggggagucgggacgggcuguacuugcuguggcguggacguaaaagaucucuuuaccgaccauauguucguuaaguggaaaguggaauacaucaagacagaggccauagucugcguggaacugaccagucaggagaggcaguguucucugaucgaagcagggacccgguuuaaucucggacccgugacaauuaccuuauccgagccucgcaacauccaacagaaacugccacccgagauuaucacgcuucacccuaaggucgaagaggguuucuuugauuugaugcauguucagaaggugcugagcgccucgacuguaugcaaacuacagucuugcacacacggcauaccaggggaccuccaaguguaucacauuggaaaucugcuuaagggcgauagaaucaacggucaucugauucacaaaaucgaaccgcauuucaauaccuccuggaugucaugggacgggugugauuuggacuacuauugcaacaugggagacuggcccaguuguacuuacacaggcgucacccagcacaaucacgcugcauuugugaaccuccugaauaucgagacggauuauaccaagacauuccauuuucacagcaaaaggguuacugcccauggcgacaccccucaguuagaucugaaggcucggccaacauacggggccggagaaauuacugugcucgucgagguggcggacauggagcuucacaccaaaaagguagaaauauccggucugaaguucgcaucuuuggccugcacaggcuguuacgcuugcagcucagggaucaguuguaaaguucgcauucauguggaugagcccgacgaacuaaccguccacgugaaguccagcgauccugacgucguggccgcaucuacuucacugauggcucgaaaacucgaguuuggaacggauaguacauucaaggccuucagcgcgaugccaaaaaccucccugugcuuuuauaucguugaaagagaguacuguaagucuugcucggaggaagacacucagaaguguguggauaccaaacuugagcaaccccagagcauacugauugaacacaagggcacaaucaucgguaaacagaacgacacuugcacugccaaggcauccugcugguuggagucaguaaaaaguuucuuuuaugggcucaagaacaugcugggcucugucuucggaaacuuuuucauuggcaucuuacuguuucuagcuccguucgugcuccugguuuuguuuuucauguuuggguggaagauucuuuucuguuuuaaaugcuguaggcggacacguggacugcucaaguaccgccaucugaaagacgaugaggaaacggguuauagaaggauaaucgagcggcuuaauaauaagaaaggcaagaaccgacuguuggacggggaacgccucgccgauagaaagauugcugagcuguucagcaccaaaacucacaucgga

SEQ ID NO: 10778 - RNA, 1932 nt, Artificial Sequence
  derived and/or modified CDS sequence (opt3) from CCHFV(Oman)__DQ211632.1__Gc
uuccuggacagcaucgccaagggcaugaaaaaccuccuuaauuccaccucucuggagacaucauugaguauugaagcucccuggggagcaauaaacgugcagagcacuuuuaagccuacggucuccaccgccaauaucgcguuaucuuggucgucaguugagcacagagggaacaaaauucuggugagcgguaggagugaauccaucaugaagcuagaggaacggacaggcauuucuugggaucucgggguagaggacgcuagcgaguccaaacugcuuacugugucagucauggaucugagucaaauguacagcccaguguucgaauauuugucuggagaccgccagguugaggaauggccgaaggcuaccugcacaggcgauugucccgagcgaugcgguuguaccuccucaacuugccuccauaaggaguggccucacagccguaauuggagauguaacccaacauggugcuggggaguggggaccggcuguacgugcuguggccuggacgucaaagaucuguuuacugacuacauguucgugaaguggaaaguagaauauaucaagaccgaggcaauaguuugcguggaacucacaagucaggagaggcaguguucuuuaaucgaagccgggacucgguuuaaucugggacccgucaccauuacacuuuccgagccucgcaacauccaacagaaauugccacccgagauugugacccugcauccuagaaucgaagaggguuucuuugaucuaaugcacgugcagaagguccucagcgcuucgacgguuugcaagcugcagucuugcacucauggcgugccaggggaccuucaaguauaccacauaggaaaucuguugaaaggcgauaaggugaacggucaccucauucauaaagucgaaccgcacuucaauacauccuggaugucaugggacgggugugaucuggacuauuacugcaacaugggagacuggcccaguuguaccuauacuggcgugacacagcauaaucacgcagccuuuguuaacuuacugaauaucgagaccgauuacacgaagaacuuccacuuucauagcaaaagggugaccgcucacggcgacacaccucagcucgaucuuaaggcccggccaaacuacggggcgggagaagucacugugcugguagagguugcagacauggaguugcauaccaaaaagauugaaaucuccggucuaaaguucgccucucugacaugcacuggcuguuaugcuugcagcucagggaucaguuguaaagugcgcauucacgucgaugagcccgacgaacucaccgugcaugucaaguccgaggauccugacauaguggccgcaucuagcucacugauggcucgaaaacuugaauuuggaacagauaguaccuucaaggccuucagcgcgaugccaaaaacuucccugugcuuuuacaucguugagagagaguauuguaagucuugcucgaaggaagacacgcagaaaugugugaaugccaaguuggagaggccccaaagcauucucaucgaacacaaaggcacaauaauugguaagcagaacgauaccugcacugcaaaagccuccugcuggcuggagucaguaaagaguuucuuuuacggguuaaagaauaugcugucuggcaucuucggaaacgucuuuaucggcauuuuccuauuucucgccccguucauccugcuuauuuuguuuuucauguuuggguggcggauacuguucuguuuuaaaugcugucgucgcaccagaggacucuucaaguauaggcaccugaaagacgacgaggaaacagguuaccggaagaucauugagcgacuuaauaacaaaaagggcaagaauaaacuguuggauggggaacgccucgcugacagaaagaucgccgagcuguucagcaccaaaacucauaucgga

SEQ ID NO: 10779 - RNA, 1932 nt, Artificial Sequence
  derived and/or modified CDS sequence (opt3) from CCHFV(SPU97/85)__DQ211633.1__Gc
uuccuggacagcaucgugaagggcaaaaagaaccuccuuaauuccaccucucuggagacaucauugaguauugaagcccccuggggagcuauaaacguccagagcacuuuuaaaccuacgguuuccgcagccaauaucgcguuaucuuggucgucaguggagcacagagggaacaagauucugguaagcgguaggagugaauccaucaugaaacuagaggaacggaccggcauuucuugggaucucgggguggaggacgcuagcgaguccaagcugcuuacagucucagugauggaucugagucaaauguacagcccaguuuucgaauauuugucuggagaccgccagguggaggaauggccgaaggccacuugcaccggcgauugucccgagcgaugcgguuguacauccucaaccugccuccauaaagaguggccucacagccguaauuggagauguaacccaacuuggugcuggggagucgggacaggcuguaccugcuguggccuggacgugaaggaucuguuuacggacuacauguucguaaaauggaagguugaauauaucaaaacugaggcaauagugugcgucgaacucaccagucaggagaggcaguguucuuuaaucgaagccgggacacgguuuaaucugggacccgugacuauuacccuuuccgagccucgcaacauccaacagaaguugccacccgagauuaucacacugcauccuagaauagaagaggguuucuuugaucuaaugcacgugcagaagguccucagcgcuucgaccguuugcaaacugcagucuugcacgcauggcgugccaggggaccuucaaguauaccacauuggaaaucuguugaagggcgauaaagugaacggucaccucauccauaagauugaaccgcacuucaauacuuccuggaugucaugggacgggugugaucuggacuauuacugcaacaugggagacuggcccaguuguacauauaccggcgucacucagcauaaucacgcagccuuugugaacuuacugaauaucgagacagauuacaccaaaaacuuccacuuucauagcaagaggguuacggcucacggcgacaccccucagcucgaucuuaaagcccggccaacauacggggcgggagaagugacuguccugguggagguagcagacauggaguugcauaccaagaagaucgaaauuuccggucuaaaauucgccucucugagcugcacaggcuguuaugcuugcucaagugggauauccuguaagguucgcauccacguggaugagcccgacgaacucacuguccaugugaaaagcgaggauccugacauugucgccgcaggaucuucacugauggcucgaaaacuugaauuuggcgccgauaguaccuucaaagcguucagcgccaugccaaagacaucccugugcuuuuacaucguggagagagaguauuguaagucuugcucgagggaagacacccagaaauguguuaacacuaaguuggagcggccccaaagcauacucauugaacacaaagguacgaucaucgggaagcagaaugauacaugcaccgcaaaggcuuccugcuggcuggagucagugaagaguuucuuuuacggcuuaaagucuaugcugagcggaauuuucggcaacguauuuaucgggauuuuccuauuuauagccccguucguccuccugauccucuuuuucauguuuggauggcguauuuuguucuguuuuaaaugcugucgcagaacuaggggucuguucaaguaucggcaccucaaagacgacgaggaaaccggcuaccgaaagaucaucgagcgccugaauaacaaaaaggggaagaauaaacuucuggauggagaaagauuggcugacaggaagauugccgagcuuuucuccacaaaaucacauauaggc

SEQ ID NO: 10780 - RNA, 1932 nt, Artificial Sequence
  derived and/or modified CDS sequence (opt3) from CCHFV(SPU103/87)__DQ211634.1__Gc
uuccuggacaacaucgugaagggcaugaaaaaucuccuuaacagcaccucccuggagacaucuuugucaauugaagcccccuggggugcuauaaauguccagaguacuuacaagccuacgguuagcaccgcaaacaucgccuuauccuggucuucgguggagcacagaggaaauaaaauucugguaucagguaggagcgaaaguaucaugaagcuagaggaacggacaggcauuuccugggaucucgggguggaggacgcgucugagagcaaacugcuuacugucuccgugauggaucugucacaaauguauaguccaguuuuugaauacuugagcggagaccgccagguggaggaauggccgaaggcuaccugcacaggcgauugucccgagcgaugcgguuguaccucuuccacuugccuccauaaggaguggccucacucacguaacuggagauguaauccaacauggugcuggggagucgggaccggcuguacgugcuguggccuggacgugaaagaucuguucacugacuauauguuuguaaaguggaaaaucgaauacauaaagaccgaggccaucguuugcguggaacucacaagccaggagaggcaguguaguuuaauugaagcagggacucgguucaaccugggacccgucaccaucacacuuucugagccucgcaauauucaacagaaauugccauccgagaucauaacccugcaucccagaauugaagagggguuuuucgaucuaaugcacgugcagaaggugcucagcgccucgacggucugcaagcugcagucuugcacucauggcguuccuggggaccuucaaguguaucacaucggaaaccuguugaaaggcgauaagguaaauggucaccucgugcauaaaauugaaccacacuuuaacacauccuggaugucaugggacgggugugaucuggacuacuauugcaauaugggagacuggccgaguuguaccuacacuggcgucacacagcauaaccacgcuagcuucgugaauuuacugaacaucgagaccgauuacacgaagaacuuucacuuccauuccaaaaggguuaccgcacacggcgacacaccccagcucgaucuuaaggcccggccuacuuauggggcuggagaaaucaccgugcuggucgagguggccgacauggaguugcauacuaaaaagauugaaauaucuggucuaaaguuuacaagccugaccugcacaggcuguuacgcgugcucaagugggaucuccuguaaaguacgcauucacguugaugagccagacgaacucaccgugcaugucaagagcgaugaccccgauguggucgcagccucuucaagucugauggcucgaaaacuugaguucggaacugacagcacguuuaaggccuucuccgcaaugccuaaaacaucucugugcuucuauaucguggaaagagaguacuguaagucgugcagcgaggaagauacccagaaguguguuaauacuaaauuggagcaaccacaguccauacucauugaacacaagggcaccaucaucgguaaacagaacaauacaugcaaggcuagggccgggugcuggcuggagucagugaaaaguuucuuuuauggcuuaaagaacaugcugucuggaauuuuuggcaauguauucaucgggauuuuucuauuccucgcgcccuuuauacugcuuaucuuguucuuuauguucggauggcggauucuguuuuguuucaagugcugucgucgcaccagaggucucuuuaaauacaggcaccugaaggacgacgaggaaacuggcuaucggaaaaucaucgagcgacuuaacaauaagaaagggaagaacaagcuguuggauggagaacgccucgccgacagaaggauugcagagcuguucagcacaaaaacgcauauaggc

SEQ ID NO: 10781 - RNA, 1932 nt, Artificial Sequence
  derived and/or modified CDS sequence (opt3) from CCHFV(SPU415/85)__DQ211635.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccgcagccaauaucgcguuaucuuggucgucaguggagcacagagggaacaaaauucugguaagcgguaggagugaauccaucaugaagcuagaggaacggaccggcauuucuugggaucucgggguggaggacgcuagcgaguccaaacugcuuacagucucagugauggaucugagucaaauguacagcccaguuuucgaauauuugucuggagaccgccagguggaggaauggccgaaggccacuugcaccggcgauugucccgagcgaugcgguuguacauccucaaccugccuccauaaggaguggccucacagccguaauuggagauguaacccaacuuggugcuggggagucgggacaggcuguaccugcuguggccuggacgugaaagaucuguuuacggacuacauguucguaaaguggaaaguugaauauaucaagacugaggcaauagugugcgucgaacucaccagucaggagaggcaguguucuuuaaucgaagccgggacacgguuuaaucugggacccgugacuauuacccuuuccgagccucgcaacauccaacagaaauugccacccgagauuaucacacugcauccuagaauagaagaggguuucuuugaucuaaugcacgugcagaggguccucagcgcuucgaccguuugcaagcugcagucuugcacgcauggcgugccaggggaccuucaaguauaccacauuggaaaucuguugaagggcgauaaagugaacggucaccucauccauaagauugaaccgcacuucaauacuuccuggaugucaugggacgggugugaucuggacuauuacugcaacaugggagacuggcccaguuguacauauaccggcgucacucagcauaaucacgcagccuuugugaacuuacugaauaucgagacagauuacaccaaaaacuuccacuuucauagcaagcggguuacggcucacggcgacaccccucagcucgaucuuaaagcccgcccaacauacggggcgggagaagugacuguccugguggagguagcagacauggaguugcauaccaagaaaaucgaaauuuccggucuaaaguucgccucucugacaugcacuggcuguuaugcuugcagcucagggauaaguuguaagguuaaaauccacguggaugagcccgacgaacucaccguccaugugaaguccgaggauccugacauugucgccgcaggaagcucucugauggcucgaaaacuugaauuuggcgccgauucaacauucaaggcguucagugccaugccaaaaaccagccugugcuuuuacaucguggagagagaguauuguaaguccugcucuagggaagacacucggaaguguguuaacacgaaauuggaucguccccagucgauacucauugagcacaaggguacaaucaucgggaaacaaaauaauaccugcacugcaaaggcuagcugcuggcuggaauccgugaaaucauucuuuuacggcuuaaagaacaugcugaguggaauuuucggcaacguauuuaucgggauuuuccuauuuauagccccguucguccuccugaucuuguuuuucauguuuggauggcgcauucuuuucuguuuuaagugcuguagaaggacccggggucuguucaaauaucgacaccucaaggacgacgaggagacaggcuaccgcaaaaucaucgaaagacugaauaacaagaaagggaagaauaaacuucuggauggagagagguuggcugaccggaagauugccgaacucuucucuaccaagagccauauaggc

SEQ ID NO: 10782 - RNA, 1932 nt, Artificial Sequence
  derived and/or modified CDS sequence (opt3) from CCHFV(Turkey200310849)__DQ211636.1__Gc
uuccuggacagcaucgugaagggcaugaaaaaccuccuuaauuccaccucucuggagacaucauugaguauugaagcccccuggggagcuauaaacguccagagcacuuuuaagccugcaguuuccacggccaauaucgcguuaucuuggucgucaguggagcacagagggaacaaaauucugguaaccgguaggagcgaaaguaucaugaagcuagaggaacggacaggcguguccugggaucucggggucgaggacgcuucugagagcaaacugcuuacuguguccauuauggaucugucacaaauguacaguccaguuuucgaauauuugagcggagaccgccagguggaggaauggccgaaggcuaccugcacaggcgauugucccgagcgaugcgguuguaccucuuccacuugccuccauaaggaguggccucacucacguaauuggagauguaacccaacauggugcuggggagucgggaccggcuguacgugcuguggcguggacguaaaagaucuguuuacugaccauauguucguuaaguggaaaguggaauacaucaagaccgaggcaauagucugcguggaacugacaagccaggagaggcaguguagucucaucgaagccgggacucgguuuaauuuaggacccgugaccauuacacugucugagccucgcaacauccaacagaaacuuccacccgagauuaucaccuugcacccuaagauagaagaggguuucuuugaucugaugcauguccagaagguucuauccgcuagcacggugugcaaacuccagucgugcacucacggcauuccaggggaccugcaaguauaucacaucggaaaucuucugaagggcgauagagugaacggucauuugauucacaaaaucgaaucucauuucaauacauccuggaugucaugggacgggugugaucucgacuacuauugcaacaugggagacuggccgaguuguaccuacacuggcgucacacagcacaaucacgcagccuuugugaaccuguuaaauaucgagaccgauuauacgaagaccuuccauuuucacagcaaaaggguuacagcucauggcgacacuccccagcuggaucucaaggcccggccuaccuacggggcgggagaaauuacagugcuugucgagguggcagacauggagcugcacacuaaaaagguagaaauauccgguuugaaguucgccucucuagcuugcaccggcuguuacgccugcagcucagggaucaguuguaaaguucgcauucauguggaugagccagacgaacugacaguccacgugaaguccagcgaucccgacgucguggcagcuucuaccucacucauggcccgaaaacuggaguuuggaacugauaguacguucaaggcguucagcgccaugccuaaaacaucccuuugcuuuuauaucguugaaagagaguacuguaagucuugcucggaggacgauacccagaaguguguggacacuaggcuggaacaaccacagagcauauugauugagcacaaaggcaccaucaucgguaagcagaacgacacaugcaccgcaaaagccuccugcuggcucgaaucaguaaagaguuucuuuuaugggcugaaaaacauguuaggcucugucuucggaaaucuguuuauuggcauccuacucuuccuggcccccuuugugcuuuugguucuguucuuuauguucggguggaagauucucuuuuguuucaagugcugucggcguacucgcggacuguuuaaauacagacaucuuaaggaugacgaggagacagguuauaggcggauaaucgaacgacugaacagcaaaaagggcaaaaaucgcuugcucgauggggacagacuggcugauaggaagauugccgaguuauucuccacgaagacccacaucgga

SEQ ID NO: 10783 - RNA, 1932 nt, Artificial Sequence
  derived and/or modified CDS sequence (opt3) from CCHFV(Iran-52)__DQ446215.1__Gc
uuccuggacagcaucgugaagggcaugaaaaaccuccuuaauuccaccucucuggagacaucauugaguauugaagcccccuggggugcuauaaacguccagagcacuuacaagccuacgguuuccaccgcaaauaucgccuuaucuuggucgucaguggagcacagaggaaacaaaguacuggugagcgguaggagugaauccauuaugaagcuagaggaacggacaggcaucucuugggaucucggggucgaggacgcgagcgaguccaaacugcuuacugugucaguuauggaucugagucaaauguauagcccaguguuugaauacuugucuggagaccgccaggucgaggaauggccgaaggcuaccugcacaggcgauugucccgagcgaugcgguuguaccuccucaacuugccuccauaaggaguggccucacagccguaauuggagauguaacccaacauggugcuggggaguggggaccggcuguacgugcuguggccuggacguaaaagaucuguucacugacuauauguuuguuaaguggaaaguggaauacauuaagaccgaggccaucgucugcguggaacucacaagucaggagaggcaguguucuuuaauagaagcagggacucgguucaaucugggauccgugaccaucacacuuagcgagccccgcaacauucaacagaaauugccuccagagaucauuacccugcaucccaagaucgaagagggguuuuucgaucuaaugcacguccagaagguucucucggccucuacggugugcaaacugcaguccugcacucauggcguaccuggggaccuucaaguguaucacauaggaaaucuguugaagggcgauagagucaacggucaccucauucauaaaaucgaacagcacuuuaauacaucauggaugaguugggacgggugugaucuggacuacuauugcaacaugggagacuggccaagcuguaccuacacuggcgugacacagcauaaucacgcuuccuucguuaacuuacugaauauugagaccgauuacacgaagaccuuucacuuccauucuaaaagggugacagcacacggcgacacuccgcagcucgaucuuaaggcccggcccaccuauggggcuggagaaaucacaguccugguggagguagccgacauggaguugcauacuaaaaagaucgaaauuagcggucuaaaguuugcgggccugaccugcacaggguguuacgcaugcucaaguggaauauccuguaaaguucgcauccacguggaggaaccugaugagcucaccguccaugugaagucugacgauccagacgucguggccgcuucuucaagucugauggcccgaaaacuugaguucggcacugauagcacguuuaaggcauucuccgcuaugcccaaaacaucucugugcuucuauauuguugagagagaguacuguaagucgugcagcaaggaagacacccaaaaaugugugaacacuaaguuggagcagccucaguccauccucauagaacacaaagguaccauuaucgggaagcaaaacaauacaugcaccgccaaagcgucaugcuggcuggagaguguaaagagcuuuuucuauggcuuaaagaacaugcugggaggcaucuuugggaaugucuucauuggaaucuuuacuuuccuaacaccauuuauucuccugauacuuuucuuuauguucgguuggaggaucuuguuuuguuucaaaugcugucggcguacgcgcggccuguuuaaguacagacaccucaaagaugacgaggaaaccggguauaggaagauuaucgagcggcugaacaauaaaaagggaaagaaccgacuucuggacggcgaacgcuuggccgauagaaaaaucgcagaacucuucagcacuaagacacauauuggu

SEQ ID NO: 10784 - RNA, 1932 nt, Artificial Sequence
  derived and/or modified CDS sequence (opt3) from CCHFV(Iran-53)__DQ446216.1__Gc
uuccuggacagcaucgugaagggcaugaaaaaccuccuuaauuccaccucucuggagacaucauugaguauugaagcccccuggggugcuauaaacguccagagcacuuacaagccuacgguuuccaccgcaaauaucgccuuaucuuggucgucaguggagcacagaggaaacaaaguacuggugagcgguaggagugaauccauuaugaagcuagaggaacggacaggcaucucuugggaucucggggucgaggacgcgagcgaguccaaacugcuuacugugucaguuauggaucugagucaaauguauagcccaguguuugaauacuugucuggagaccgccaggucgaggaauggccgaaggcuaccugcacaggcgauugucccgagcgaugcgguuguaccuccucaacuugccuccauaaggaguggccucacagccguaauuggagauguaacccaacauggugcuggggaguggggaccggcuguacgugcuguggccuggacguaaaagaucuguucacugacuauauguuuguuaaguggaaaguggaauacauuaagaccgaggccaucgucugcguggaacucacaagucaggagaggcaguguucuuuaauagaagcagggacucgguucaaucugggauccgugaccaucacacuuagcgagccccgcaacauucaacagaaauugccuccagagaucauuacccugcaucccaagaucgaagagggguuuuucgaucuaaugcacguccagaagguucucucggccucuacggugugcaaacugcaguccugcacucauggcguaccuggggaccuucaaguguaucacauaggaaaucuguugaagggcgauagagucaacggucaccucauucauaaaaucgaacagcacuuuaauacaucauggaugaguugggacgggugugaucuggacuacuauugcaacaugggagacuggccaagcuguaccuacacuggcgugacacagcauaaucacgcuuccuucguuaacuuacugaauauugagaccgauuacacgaagaccuuucacuuccauucuaaaagggugacagcacacggcgacacuccgcagcucgaucuuaaggcccggcccaccuauggggcuggagaagucacagugcugguagagguugccgacauggaguugcauacuaaaaagaucgaaaucagcggucuaaaguuugcgggccugaccugcacaggguguuacgcaugcucaaguggaauuuccuguaaagugcgcauacacgucgaugagccugacgaacucaccgugcaugucaagagcgaugacccagaugugguugccgcuucuucaagucugauggcccgaaaacuugaguucggcacugacagcacguuuaaggcauucuccgcuaugcccaaaacaucucugugcuucuauaucguggaaagagaguacuguaagucgugcagcaaggaggauacccaaaaauguguaaacacuaaguuggaacagccucaguccauucucaucgagcacaaagguaccauaauugggaagcaaaacaauacaugcaccgccaaagcgucaugcuggcuggaaagugucaagagcuuuuucuauggcuuaaagaacaugcugggaggcaucuuugggaauguguucaucggaauuuuuacuuuccuaacaccauuuauccuccugauucuuuucuuuauguucgguuggaggauauuguuuuguuucaaaugcugucggcguacgcgcggccuguuuaaguacagacaccucaaagacgacgaggagaccggguauaggaagaucauugaacggcugaacaauaaaaagggaaagaaccgacuucuggauggcgagcgcuuggccgacagaaaaaucgcagaacucuucucuacuaagacacauaucggu

SEQ ID NO: 10785 - RNA, 1932 nt, Artificial Sequence
  derived and/or modified CDS sequence (opt3) from CCHFV(Kosova Hoti)__EU037902.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcauuuccugggaucucgggguggaggacgcgucugagagcaaacugcuuaccgucuccaucauggaucugucacaaauguacaguccaguguucgaauauuugagcggagaccgccagguugaggaauggccgaaggcuacaugcaccggcgauuguccccagcgaugcgguuguacuucuuccacaugccuccauaaggaguggccucacucacguaauuggagauguaacccaaccuggugcuggggaguggggacgggcuguacuugcuguggcgucgacgugaaagaucuguuuaccgaccauauguucguaaaguggaaaguugaguacauaaagacagaagccaucgugugcgucgagcugacuagccaggaaaggcaauguagucucauugaggcagggacccgguuuaauuuaggacccgugacaaucacccugucugaaccucgcaacauucagcagaaacuuccacccgagaucauaacguugcacccuaagauugaggaagguuucuuugaucugaugcaugugcagaagguccuauccgccagcacuguuugcaaacuccaaucgugcacacacggcaucccaggggaccuucagguguaucacauuggaaaucugcugaagggcgauagaguaaacggucauuugauccacaaaaucgagccgcauuucaauaccucuuggauguccugggacgggugugaucucgacuacuauugcaacaugggagacuggcccucauguacuuacacaggcgugacccagcacaaucacgcugcauuugucaaccuguuaaauauugaaacggauuauaccaagacauuccauuuucacaguaaaagggugacugcccauggcgacaccccucagcuggaucucaaggcucggccaacauacggggccggagagauaacuguucuuguggaagucgcggacauggagcugcacaccaaaaagguggagaucagcgguuugaaguucgcaucccuagccugcacaggcuguuacgcuugcucuagcgggauuucauguaaaguacgcauccauguugaugaacccgacgagcugaccgugcacgucaagaguuccgauccugacguggucgccgcaggaacuagccucauggcucgaaaacuggaauuuggcacggauucuacauucaaggccuucucagcgaugccaaaaaccagucuuugcuuuuauauaguggagaaggaauacuguaagagcugcuccgaggacgauacuaaaaaguguguugacaccaaacuggagcaaccccagucuauuuugaucgaacacagagguacaaucauugggaagcagaacgauaccugcacugccaaagcaucgugcuggcucgagagcgugaaguccuucuuuuauggccugaagaacauguuaggaucaguauucggcaacuuuuucaucgggauucugcuauuucucgcuccguucguccugcuuguguuguuuuucauguuuggauggaaaauacuguucuguuuuaagugcuguaggcggacacguggucucuucaaauaccgccaucugaaggacgacgaagagacgggcuauagaaggaucauugagcggcuuaauaauaaaaaggggaagaaccgacuguuggauggagaacgccucgccgacagaaaaaucgcugagcuguucaguaccaagacucacaucggc

SEQ ID NO: 10786 - RNA, 1932 nt, Artificial Sequence
  derived and/or modified CDS sequence (opt3) from CCHFV(YL04057)__FJ562094.1__Gc
uuccuggacagcaucgccaagggcaaaaagucccuccuuaacucuaccucacuggagacaaguuugagcauugaagcucccuggggagcaauaaaugugcaguccacuuuuaaaccuacggucucugccgcgaacaucgcuuuaucguggucaagcguugagcacagaggaaauaagauucuggugagugguagguccgaaucuaucaugaaacuagaggaacggaccggcguaagcuggaaccucgggguggaggaugccuccgagucaaagacacugacugucagugugauggaccuuagccaaauguacucuccaguuuucgaauaucuguccggagaucgccagguggaggaauggccgaaggcaaccugcacaggcgacugucccgagcgaugcgguuguaccucaagcacuugcuugcauaaagaguggccucacagucguaauuggagauguucuccaacauggugcuggggagucgggaccggcuguacgugcuguggccucgaugugaaggacuuuuucacugauuacaugcugguaaaauggaagguugaauauauuaaaaccgaggccaucgugugcgucgaacugacaucccaggagaggcaguguagccucauagaagcugggacucgguuuaacuuaggacccgugaccaucacacugucggagccucgcaaugugcaacagagacuuccacccgagauugucaccuugcauccuaagaucgaagaggguuucuuugaccugaugcacguucagaagauucuaucugcauccacggugugcaaacuccagucaugcacucauggcguaccaggggauuuccaaguguaccacgucggaaaccugcuuaggggcgacaaggugaauggucacaguauccauaaaauagaaccgcacuuuaacacaagcuggauguccugggaugggugugaccuggauuauuucugcaauaugggagacuggcccucuuguaccuacacuggcguuacacagcauaaccgggccgcuuuuauuaauauguugaacaucgagaccgacuauacgaagaccuuccacuuucacagcaaacgcgugacagcccauggcgauacuccucagcucgaccugaaggcgcgaccagcauacggggccggagaagucaccguguuaguagagguugcugaucuggagcuccacacaaagaaacuugaagugucaggucugaagauugccaguuugacuugcuccggcuguuacgcaugcagcucugggaucucauguaaagucagaauccaugugaaugagcccgacgaauuuaccguccacgugaggaguagcgauccugacguuguggcugccggauccucucuaauggcgcggaagauugaguucggcgccgauucgacauucaaagcauucagcuccaugccaaaggacucacugugcuuuuauauaguagaaaaagauuacuguaguucuugcaccgacgaugacacucagaagugugucaacacgaagcucgaccauccccaaagcauccugauugagcacaaagguacaaucauagggaagcagaacgauaccugcuccacuaaaaccucaugcuggcuugagagcgugaagggcuucuuuuauggacugaaaaauauguugucuggcauuuucgggaacguuuuucucggaauccuguuauuccuggcuccguuugugcuacucaucuucuuuuucuuuuucgguuggcgucugcuuuucuguuugaagugcugucgcagaacaaggggccugcucaaguacaaacaccugaaggacgaagaggaagccggguauaaaaagauuaucgagcggcuuaaugggaaaaagggcaagucccagcuguuugauggugagcgauuggcugaccgcaaaauugccgaacucuucaguaccaagauacauaucggg

SEQ ID NO: 10787 - RNA, 1932 nt, Artificial Sequence
  derived and/or modified CDS sequence (opt3) from CCHFV(V42/81)__GU477490.1__Gc
uuccuggacagcaucgugaagggcaaaaagaaccuccuuaauuccaccucucuggagacaucauugaguauugaagcccccuggggagcuauaaacauccagagcacuuuuaaaccuacggucuccgcagccaauauugcguuaucuuggucgucaguugagcacagagggaacaagauccuggugagcgguaggagugaauccauuaugaaacuagaggaacggaccggcguaucuuggaaucucgggguggaggaugcuagcgaguccaagcugcuuacagucucaaucauggaccugagucaaauguacagcccaguguucgaauauuugucuggagaucgccagguugaggaauggccgaaggccacuugcaccggcgacugucccgagcgaugcgguuguacauccucaaccugccuccauaaagaguggccucacagccguaacuggagauguaauccaacuuggugcuggggaguggggacaggcuguaccugcuguggcgucgaugugaaggaccuguuuauagaucauauguucguaaaauggaagguugaauacaucaaaacggaggcaauugugugcgucgaacugaccagucaggagaggcaguguucucucaucgaagccgggacccgguuuaacuuaggacccgugacaauuacucuguccgagccucgcaauauccaacagaaacuuccacccgagauaauuaccuugcacccuaagaucgaagaggguuucuuugaccugaugcaugugcagaagguccuaagcgcuucgacaguuugcaagcuccagucuugcacccacggcauuccaggggaucugcaaguguaucacaucggaaaccuucugaaaggcgacagaguaaauggucauuugauccacaagauugaaccgcauuucaacacguccuggaugucaugggaugggugugaccucgauuacuauugcaauaugggagacuggcccaguuguacuuacacaggcgugacccagcacaaccacgcagccuuugucaaucuguuaaacauagagacugacuauacaaaaaccuuccauuuucacagcaagagggugacggcucauggcgaaaccccucagcuggaucucaaagcccggccagcguacggggcaggagagaucacaguucuuguggaggucgccgacauggaacugcacacuaagaagguggagauuuccgguuugaaauucgcuucucuagccugcaccggcuguuacgcaugcagcucagggaucaguuguaagguacgcauacauguugaugaacccgacgagcugacagugcacgucaaauccaacgauccugacguggucgcugccagcacuucucucauggcgcgaaagcuggaaucaggaaccgauaguacauuuaaagccuucagcgcaaugccaaagaccucccuuugcuucuauauuguggagagagaguacuguaagucuugcucggaagacgauacucagaaauguguugagacgaagcuggaacaaccccagagcaucuugaucgagcacaaaggcacaauuaucgguaagcagaaugacacuugcacugcuaaagccuccugcuggcucgagucagugaagaguuucuuuuaugggcugaagaacauguuaggcucuguauuuggaaauuucuuuauuggcauacugcuauuccucgcuccguuuguccugcuuguguuguucuuuauguucggguggaaaauccuguuuuguuucaagugcuguaggcggacccguggacucuuuaaauaccgccaucugaaggaagaugaggaaacagguuauagaaggauuaucgagcggcuuaacagcaaaaagggcaagaaucgacuguuggacggggaacgccucgccgacagaaaaaucgcagagcuguucuccaccaagacucacauugga

SEQ ID NO: 10788 - RNA, 1932 nt, Artificial Sequence
  derived and/or modified CDS sequence (opt3) from CCHFV(79121M18)__GU477493.1__Gc
uuccuggacagcaccgccaagggcaugaaaucccuccuuaacucuacaucacuggagacgaguuugagcaucgaagcucccuggggagcaauuaaugugcaguccacuuuuaagccuaccgucucugccgcgaacauagcuuuaucguggucaagcguugagcacagagggaauaaaauccuggugagugguagguccgaaucuauuaugaagcuagaggaacggacaggcguaagcuggaaccucgggguggaggaugccuccgagucaaaaacucugaccgucagugugauggaccuuagccaaauguacucuccaguuuucgaauaucuguccggagaucgccagguggaggaauggccgaaggcaacaugcaccggcgacugucccgagcgaugcgguuguacuucaagcacaugcuugcauaaggaguggccucacagucguaauuggagauguaacccaaccuggugcuggggagucgggacgggcuguacuugcuguggccucgaugugaaagacuuuuucaccgauuacaugcugguaaaguggaaaguugaauauaucaagacagaggccauugugugcgucgaacugacuucucaggagaggcaguguucccucaucgaagcugggacccgguuuaauuuaggacccgugacaauaacccugagcgagccucgcaacgugcaacagagacuuccacccgagaucgucacguugcauccuaaaauugaagaggguuucuuugaccugaugcacguucagaagauccuaucggcaucuacugugugcaagcuccaguccugcacacauggcguaccaggggauuuccaaauuuaccacgugggaaaucugcuuaggggcgacaaagucaacggucacucaauccauaagauagaaccgcacuuuaauaccaguuggaugagcugggaugggugugaccuggauuauuucugcaacaugggagacuggcccuccuguacuuacacaggcgugacccagcauaaucgggccgcuuuuauuaacauguugaauaucgagacggacuauaccaaaacauuccacuuucacucuaagcgcguuacugcccauggcgauaccccucagcucgaccugaaagcgcgaccagcauacggggccggagaagugacagucuuaguggagguagcugaucuggagcuccacacuaagaaacuugaaguuagcggucugaagauugccucauugaccugcaguggcuguuacgcaugcuccagcgggaucucuuguaaggugagaauccaugucaacgagcccgacgaauuuacagugcacgucaggucaagugauccugacgugguugcugccggaagcucccuaauggcgcggaaaauugaguucggcgccgauucuaccuucaaggcauucucgagcaugccaaaagacucccugugcuuuuauauaguggaaaaggauuacuguucaaguugcacugacgaugacacgcagaaauguguaaacacaaagcucgaccauccccaaucuauccugauugagcacaaggguaccaucauagggaaacagaaugauacuugcagcaccaagacauccugcuggcuugagucagucaaaggcuucuuuuauggacugaagaacauguugagcggcauuuucgggaauguguuucucggaaucuuccuguuuuuagcuccguucguucugcuaaucuuuuucuuuuucuucgguuggcgucuccuguuuugucuuaaaugcugucgcagaaccaggggcuugcugaaguacaagcaccucaaagacgaagaggaagccggguauaagaaaauuaucgagcggcugaacggaaagaaaggcaagucucagcuuuucgauggugagcgacuggcugaccgcaagauugccgaauuguuuuccacuaaaauacauaucggg

SEQ ID NO: 10789 - RNA, 1932 nt, Artificial Sequence
  derived and/or modified CDS sequence (opt3) from CCHFV(Afg09-2990)__HM452306.1__Gc
uuccuggacagcaucgugaagggcaugaaaaaccuccuuaauuccaccucucuggagacaucauugaguauugaagcccccuggggugcuauaaacguccagagcacuuacaagccuacgguuuccaccgcaaauaucgccuuaucuuggucgucaguggagcacagaggaaacaaaguacuggugagcgguaggagugaauccauuaugaagcuagaggaacggacaggcaucucuugggaucucggggucgaggacgcgagcgaguccaaacugcuuacugugucaguuauggaucugagucaaauguauagcccaguguuugaauacuugucuggagaccgccaggucgaggaauggccgaaggcuaccugcacaggcgauugucccgagcgaugcgguuguaccuccucaacuugccuccauaaggaguggccucacagccguaauuggagauguaacccaacauggugcuggggaguggggaccggcuguacgugcuguggccuggacguaaaagaucuguucacugacuauauguuuguuaaguggaaaguggaauacauuaagaccgaggccaucgucugcguggaacucacaagucaggagaggcaguguucuuuaauagaagcagggacucgguucaaucugggauccgugaccaucacacuuagcgagccccgcaacauucaacagaaauugccuccagagaucauuacccugcaucccaagaucgaagagggguuuuucgaucuaaugcacguccagaagguucucucggccucuacggugugcaaacugcaguccugcacucauggcguaccuggggaccuucaaguguaucacauaggaaaucuguugaagggcgauagagucaacggucaccucauucauaaaaucgaacagcacuuuaauacaucauggaugaguugggacgggugugaucuggacuacuauugcaacaugggagacuggccaagcuguaccuacacuggcgugacacagcauaaucacgcuuccuucguuaacuuacugaauauugagaccgauuacacgaagaccuuucacuuccauucuaaaagggugacagcacacggcgacacuccgcagcucgaucuuaaggcccggcccaccuauggggcuggagaaaucacaguccugguggagguagccgacauggaguugcauacuaaaaagaucgaaauuagcggucuaaaguuugcgggccugaccugcacaggguguuacgcaugcucaaguggaauauccuguaaaguucgcauccacguggaugagccugacgaacucaccguccaugugaagucugaugacccagaugucguggccgcuucuucaagucugauggcccgaaaacuugaguucggcacugacagcacguuuaaggcauucuccgcuaugcccaaaacaucucugugcuucuauauuguugaaagagaguacuguaagucgugcagcaaggaggauacccaaaaaugugugaacacuaaguuggaacagccucaguccauccucauagagcacaaagguaccauuaucgggaagcaaaacaauacaugcaccgccaaagcgucaugcuggcuggaaaguguaaagagcuuuuucuauggcuuaaagaacaugcugggaggcaucuuugggaaugucuucauuggaaucuuuacuuuccuaacaccauuuauucuccugauacuuuucuuuauguucgguuggaggaucuuguuuuguuucaaaugcugucggcguacgcgcggccuguuuaaguacagacaccucaaagacgacgaggagaccggguauaggaagauuaucgaacggcugaacaauaaaaagggaaagaaccgacuucuggauggcgagcgcuuggccgacagaaaaaucgcagaacucuucagcacuaagacacauauuggu

SEQ ID NO: 10790 - RNA, 1932 nt, Artificial Sequence
  derived and/or modified CDS sequence (opt3) from CCHFV(Sudan Al-Fulah 3-2008)__HQ378184.1__Gc
uuccuggacagcaucgugaagggcaugaaaaaccuccuuaauuccaccucucuggagacaucauugaguauugaagcccccuggggugcuauaaacguccagagcacuuacaagccuacgguuuccaccgcaaauaucgccuuaucuuggucgucaguggagcacagaggaaacaaaauucugguaagcgguaggagugaauccaucaugaagcuagaggaacggacaggcauuucuugggaucucgggguggaggacgcgagcgaguccaaacugcuuacugucucagugauggaucugagucagauguauagcccaguuuuugaauacuugucuggagaccgccagguggaggaauggccgaaggcuaccugcacaggcgauugucccgagcgaugcgguuguaccuccucaacuugccuccauaaggaguggccucacagccguaauuggagauguaacccaacauggugcuggggagucgggaccggcuguacgugcuguggccuggacgugaaagaucuguucacugacuauauguuuguaaaguggaaaguugaauacaucaagaccgaggccauagugugcgucgaacucacaagucaggagaggcaguguucuuuaaucgaagcagggacucgguucaaucugggacccgugaccauuacacuuuccgagccucgcaacauccaacagaaauugccacccgagauuaucacccugcauccuagaauagaagagggguuuuucgaucuaaugcacgugcagaagguccucagcgccucgacgguuugcaagcugcagucuugcacucauggcgugccaggggaccuucaaguauaucacauuggaaaucuguugaaaggcgauaaggugaacggucaccucauccauaaaauugaaccgcacuuuaauacauccuggaugucaugggacgggugugaucuggacuacuauugcaacaugggagacuggcccaguuguaccuacacuggcgucacacagcauaaucacgcuagcuucgugaacuuacugaauaucgagaccgauuacacgaagaacuuucacuuccauuccaaaaggguuaccgcacacggcgacacaccucagcucgaucuuaaggcccggccaacuuauggggcuggagaaaucaccgugcuggucgagguggccgacauggaguugcauacuaaaaagauugaaauaucuggucuaaaguuugcgagccugacaugcaccggcuguuacgcaugcucaagugggaucuccuguaaaguacgcauucacguugaugagcccgacgaacucacagugcaugucaagagcgaugacccugauguggucgccgcuucuucaagucugauggcccgaaaacuugaguucggaaccgacagcacuuuuaaggcauucuccgcuaugccaaaaacgucucugugcuucuauaucguggaaaaggaguacuguaagucgugcagcgaggaagauaccaaaaaguguguuaacacaaaauuggagcagccccaauccauacucauugaacacaagggcacuaucaucgguaaacaaaauucaaccugcacagccaaggugaguugcuggcuggagucugccaagagcuuuuucuauggguuaaaagacaugcuguccggcauuuuuggaaacguauucaucggcauuuuucuauuccucgcgccguuuguccugcuuguguuguucuuuauguucggguggagaauacugcucuguuuuaggugcugucggcguacccgcggacuguucaaguacagacaccuuaaagacgaugaggaaacugguuauaggcggaucauugagcgacugaauaacaagaaaggcaagaauaaguugcucgacggggaacgccuggcagauagaaaaaucgcugaguuauuuucaacaaagacgcauaucgga

SEQ ID NO: 10791 - RNA, 1932 nt, Artificial Sequence
  derived and/or modified CDS sequence (opt3) from CCHFV(Sudan AB1-2009)__HQ378187.1__Gc
uuccuggacagcaucgccaagggcaugaaaaaccuccuuaauuccaccucucuggagacaucauugaguauugaagcucccuggggugcaauaaacgugcagagcacuuacaagccuacggucuccaccgccaauaucgcguuaucuuggucgucaguugagcacagaggaaacaaaauucuggugagcgguaggagugaauccaucaugaagcuagaggaacggacaggcauuucuugggaucucgggguagaggacgcuagcgaguccaaacugcuuacugugucagucauggaucugagucaaauguauagcccaguguuugaauacuugucuggagaccgccagguugaggaauggccgaaggcaaccugcacaggcgauugucccgagcgaugcgguuguaccuccucaacuugccuccauaaggaguggccucacagccguaauuggagauguaacccaacauggugcuggggaguggggaccggcuguacgugcuguggccuggacgucaaagaucuguucacugacuauauguuugugaaguggaaaguagaauacaucaagaccgaggcaauaguuugcguggaacucacaagucaggagaggcaguguucuuuaaucgaagccgggacucgguucaaucugggacccgucaccauuacacuuuccgagccucgcaacauccaacagaaauugccacccgagauuaucacccugcauccuagaauagaagagggguuuuucgaucuaaugcacgugcagaaggugcucagcgcuucgacggucugcaagcugcagucuugcacucauggcguuccaggggaccuucaaguguaucacauuggaaaucuguugaaaggcgauaagguaaacggucaccucauccauaaaauugaaccgcacuuuaauacauccuggaugucaugggacgggugugaucuggacuacuauugcaacaugggagacuggcccaguuguaccuacacuggcgugacacagcauaaucacgccagcuucgucaacuuacugaauaucgagaccgauuacacgaagaacuuucacuuccauuccaaaagggugaccgcccacggcgacacaccucagcucgaucuuaaggcucggccaacuuauggggccggagaaaucaccguucugguggaggucgcggacauggaguugcauacaaagaagauugaaauaucuggucuaaaguuugcaagccugacuugcaccggcuguuacgccugcucaagugggaucuccuguaaagugcgcauucacguagaugagcccgacgaacucacaguucaugugaaaagcgaugacccugaugucguggcugccucuucaagucugauggcacgaaaacuugaguucggaaccgacagcacuuuuaaggcuuucuccgccaugccaaaaacgucucugugcuucuauaucgucgaaagagagcacuguaagucgugcaacgaggaagauacaaagaaaugugugaauaccaaguuggagcagccccaaagcauacucauugaacacaaaggcacuaucaucgguaagcagaacucuaccugcacagcgagggccucaugcuggcuggagaguguuaaauccuuuuucuacggguuaaagaauaugcugagcggcauuuuuggaaacguguucaugggcaucuuucuauuccucgcaccguuuauucugcuuauauuguucuuuauguucggguggcggauccuguuuuguuucaagugcugucgucgcaccagaggacucuuuaaauauaggcaucugaaggacgacgaggaaacugguuaccggcgaauuaucgagcgccuuaauaacaaaaagggcaaaaauaagcuguuggauggggaaagacucgcugacaggcggaucgccgagcuguucuccacaaagacgcacauugga

SEQ ID NO: 10792 - RNA, 1932 nt, Artificial Sequence
  derived and/or modified CDS sequence (opt3) from CCHFV(NIVA 118595)__JN572083.1__Gc
uuccuggacagcaucgugaagggcaugaaaaaccuccuuaauuccaccucucuggagacaucauugaguauugaagcccccuggggugcuauaaacguccagagcacuuacaagccuacgguuuccgcagccaauaucgcguuaucuuggucgucaguggagcacagaggaaacaaaauucugguaagcgguaggagugaauccaucaugaagcuagaggaacggaccggcauuucuugggaucucgggguggaggacgcuagcgaguccaaacugcuuacagucucagugauggaucugagucaaauguauagcccaguuuuugaauacuugucuggagaccgccagguggaggaauggccgaaggccacuugcaccggcgauugucccgagcgaugcgguuguacauccucaaccugccuccauaaggaguggccucacagccguaauuggagauguaacccaacuuggugcuggggagucgggacaggcuguaccugcuguggccuggacgugaaagaucuguucacggacuauauguuuguaaaguggaaaguugaauacaucaagacugaggcaauagugugcgucgaacucaccagucaggagaggcaguguucuuuaaucgaagccgggacacgguucaaucugggauccgugacuauuacccuuagcgagccccgcaacauccaacagaaauugccuccagagauuaucacacugcaucccagaauagaagagggguuuuucgaucuaaugcacgugcagaagguccucucggcuucuaccguuugcaagcugcaguccugcacgcauggcgugccuggggaccuucaaguauaucacauuggaaaucuguugaaaggcgauagggugaacggucaccucauccauaagauugaacagcaccugaauacuucauggaugaguugggacgggugugauuuagacuacuauugcaacaugggagacuggccaagcuguacauacaccggcgucacucagcauaaucacgcauccuuugugaaccugcucaauaucgagacagauuacaccaaaacguuccacuuucauucuaagcggguuaccgcccacggcgacacaccgcagcuugaucugaaagcucgccccacuuauggggccggagaaaucaccguguuggucgagguggcggacauggagcuacauacaaagaaaauugaaauaagcggucugaaguucgcaucacucaguugcacuggcuguuacgccugcuccagcgggaucucuuguaagguacgaauccacguugaugagccugacgaacugaccgugcaugucaaaucagaugacccagauguggucgcugccaguagcucccuuauggcaagaaagcuggagucuggaacagacucgaccuuuaaggcuuucagcgccaugcccaaaacuuccuugugcuuuuauauuguggaaagggaguacuguaaaggcugcucaaaggaggauacgcaaaaguguguuaacacaaaacucgaacagccucagaguauacugauugagcacaaggguaccaucaucgggaaacaaaacaauacuugcaccgcgaaggccucuugcugguuagaaagcgugaaauccuucuucuauggccugaagaacaugcuaucaggaauuuuuggcaauguauuccucgggaucuuuagcuuccuggcaccauuuguccuuuugauucuguucuuuauguucggauggcggauacucuuuuguuucaagugcugucgucgcacaagaggucuguuuaaauacaggcaccuuaaggacgacgaggagaccggcuaucggaaaaucauugaacgacugaacaauaagaaagggaagaacaaguugcucgauggagagcgccuggcugacagaaaaaucgccgaauuauucucuacuaagacacauaucggc

SEQ ID NO: 10793 - RNA, 1932 nt, Artificial Sequence
  derived and/or modified CDS sequence (opt3) from CCHFV(NIV 112143)__JN572085.1__Gc
uuccuggacagcaucgugaagggcaugaaaaaccuccuuaauuccaccucucuggagacaucauugaguauugaagcccccuggggugcuauaaacguccagagcacuuacaagccuacgguuuccgcagccaauaucgcguuaucuuggucgucaguggagcacagaggaaacaaaauucugguaagcgguaggagugaauccaucaugaagcuagaggaacggaccggcauuucuugggaucucgggguggaggacgcuagcgaguccaaacugcuuacagucucagugauggaucugagucaaauguauagcccaguuuuugaauacuugucuggagaccgccagguggaggaauggccgaaggccacuugcaccggcgauugucccgagcgaugcgguuguacauccucaaccugccuccauaaggaguggccucacagccguaauuggagauguaacccaacuuggugcuggggagucgggacaggcuguaccugcuguggccuggacgugaaagaucuguucacggacuauauguuuguaaaguggaaaguugaauacaucaagacugaggcaauagugugcgucgaacucaccagucaggagaggcaguguucuuuaaucgaagccgggacacgguucaaucugggauccgugacuauuacccuuagcgagccccgcaacauccaacagaaauugccuccagagauuaucacacugcaucccagaauagaagagggguuuuucgaucuaaugcacgugcagaagguccucucggcuucuaccguuugcaagcugcaguccugcacgcauggcgugccuggggaccuucaaguauaucacauuggaaaucuguugaaaggcgauagggugaacggucaccucauccauaagauugaacagcaccugaauacuucauggaugaguugggacgggugugauuuagacuacuauugcaacaugggagacuggccaagcuguacauacaccggcgucacucagcauaaucacgcauccuuugugaaccugcucaauaucgagacagauuacaccaaaacguuccacuuucauucuaagcggguuaccgcccacggcgacacaccgcagcuugaucugaaagcucgccccacuuauggggccggagaaaucaccguguuggucgagguggcggacauggagcuacauacaaagaaaauugaaauaagcggucugaaguucgcaucacucaguugcacuggcuguuacgccugcuccagcgggaucucuuguaagguacgaauccacguugaugagccugacgaacugaccgugcaugucaaaucagaugacccagauguggucgcugccaguagcucccuuauggcaagaaagcuggaguuuggaacagacucuaccuucaaggcuuuuucggccaugcccaaaacuagcuugugcuucuauauuguggaaagggaguacuguaaaggcugcuccaaggaggauacgcaaaaguguguuaacacaaaacucgaacagccucagucaauacugauugagcacaaggguaccaucaucgggaaacaaaacaauacuugcaccgcgaaggccaguugcugguuagaaucugugaaauccuucuuuuauggccugaagaacaugcuaagcggaauuuucggcaauguauuucucgggaucuucucauuucuggcaccauucguccuuuugauucuguuuuucauguuuggauggcggauacucuucuguuuuaagugcugucgucgcacaagaggucuguucaaauacaggcaccuuaaggacgacgaggagaccggcuaucggaaaaucauugaacgacugaacaauaagaaagggaagaacaaguugcucgauggagagcgccuggcugacagaaaaaucgccgaauuauuuagcacuaagacacauaucggc

SEQ ID NO: 10794 - RNA, 1932 nt, Artificial Sequence
  derived and/or modified CDS sequence (opt3) from CCHFV(SCT ex Afghanistan)__KC344856.1__Gc
uuccugaacagcaucgugaagggcaugaaaaaucuccuuaacuccaccaaucuggagacaucuuugucaauugaagcccccuggggagcuauaaacguccagaguacuuuuaagccuacgguuagcaccgcaaauaucgccuuauccuggucuucgguggagcacagagggaacaaaauucugguaucagguaggagcgaaaguaucaugaagcuagaggaacggacaggcauuuccugggaccucgggguggaggaugcgucugagagcaaaucccugacugucucagugauggaccuuagucaaauguacagcccaguuuucgaauaucugucuggagaucgccagguggaggaauggccgaaggcuaccugcacaggcgacugucccgagcgaugcgguuguaccuccucaacuugcuugcauaaggaguggccucacagccguaauuggagauguaacccaacauggugcuggggagucgggaccggcuguacgugcuguggccucgaugugaaagaccuguuuacugauuacauguucguaaaguggaaaguugaauauaucaagaccgaggccauagugugcgucgaacugacaagucaggagaggcaguguucucucaucgaagcagggacucgguuuaauuuaggacccgugaccauuacacuguccgagccucgcaacauccaacagaaacuuccacccgagauuaucaccuugcauccuagaauagaagaggguuucuuugaccugaugcacgugcagaagguccuaagcgccucgacgguuugcaagcuccagucuugcacucauggcgugccaggggaucugcaaguauaccacauuggaaaucuucugaaaggcgacaaguugaacggucacaugauccauaaaauugaaccgcacuucaauacauccuggaugucaugggaugggugugaccucgauuauuacugcaacaugggagacuggcccaguuguaccuauacuggcgugacacagcauaaucacgcugcauuugucaaccuguuaaacaucgagaccgacuacacgaagaauuuccacuuucauagcaaaagggugaccgcccacggcgauacaccucagcuggaccucaaggcucggccaacuuacggggccggagaaaucaccguucuuguggaggucgcggauauggagcugcauacuaaaaagauugacauauccgguuugaaguucgcaucucuaacaugcgccggcuguuaugcuugcagcucagggaucaguuguaaagugcgcauucacguagaugaacccgacgagcugaccguucaugugaaguccgaagauccugacaucgucgccgcaagcacaucucucauagcucgaaaacuggagcuuggaaccgauucaacuuuuaaggccuucagugcgaugccaaaaacgagccugugcuucuacauuguggaaagagaguauuguaaguccugcucuaaggaggacacacagaaaugugucaacaccaaguuggaacacccccaaggcauccucaucgagcacaaagguacuauuaucgggaagcagaaugauaccugcacagccaaagcaggcugcuggcuggaaucgguuaagagcuuuuucuacggauuaaagaacaugcuguccggcauuuuugggaauguguucauaggaaucuuucuauuccucgcuccguuugugcugcuuauuuuguucuuuauguucgguuggaggcugcucuuuuguuucaaaugcugucggcguacccgcggccuguuuaaguauagacaucuuaaagaggacgaggaaucaggguacaggcggaucaucgagcgacugaacaauaagaaaggaaagaacaaguugcucgacggcgaacgccuggccgauagaaggauugcugaguuauucaguacuaaaacacacauaggu

SEQ ID NO: 10795 - RNA, 1932 nt, Artificial Sequence
  derived and/or modified CDS sequence (opt3) from CCHFV(Zahedan 2007)__KC867273.1__Gc
uuccuggacagcaucgugaaggauaugaaaaaccuccuuaauuccaccucucuggagacaucauugaguauugaagcccccuggggcgcuauaaacguccagagcacuuacaagccuacgguuuccaccgcaaauaucgccuuaucuuggucgucaguggagcacagagggaacaaaguacuggugagcggaaggagugaauccauuaugaagcuagaggaacggacagguaucucuugggaccucggcgucgaggaugcgagcgaguccaaacugcuuacugugucaguuauggaccugagucaaauguauagcccaguguuugaauacuugucuggggaucgccaggucgaggaauggccgaaggcuaccugcacaggagacugucccgagcgaugcggcuguaccuccucaacuugccuccauaaggaguggccucacagccguaauuggagauguaacccaacauggugcugggguguggggaccggauguacgugcuguggccuggauguaaaagaccuguucacugauuauauguuuguuaaguggaaaguggaauacauuaagaccgaggccaucgucugcguggaacucacaagucaggagaggcaguguucuuuaauagaagcaggcacucgguucaaucugggguccgugaccaucacacuuagcgagccccgcaacauucaacagaaauugccuccagagaucauuacccugcaucccaagaucgaagagggauuuuucgaccuaaugcacguccagaagguucucucggccucuacggugugcaaacugcaguccugcacucaugguguaccuggcgaucuucaaguguaucacauagggaaucuguugaagggagacagagucaacggccaccucauucauaaaaucgaacagcacuuuaauacaucauggaugaguugggaugguugugaccuggacuacuauugcaacaugggggauuggccaagcuguaccuacacuggagugacacagcauaaucacgcuuccuucguuaacuuacugaauauugagaccgacuacacgaagaccuuucacuuccauucuaaaagggugacagcacacggcgauacuccgcagcucgaccuuaaggcccggcccaccuauggcgcuggggaaaucacaguccugguggagguagccgauauggaguugcauacuaaaaagaucgaaauuagcggacuaaaguuugcgggucugaccugcacaggcuguuacgcaugcucaagugggauauccuguaaaguucgcauccacguggacgagccugaugaacucaccguccaugugaagucugacgauccagacgucguggccgcuucuucaagucugauggcccgaaaacuugaguucggaacugauagcacguuuaaggcauucuccgcuaugcccaaaacaucucugugcuucuauauuguugaaagagaguacuguaagucgugcagcaaggaggacacccaaaaaugugugaacacuaaguuggaacagccucaguccauccucauagagcacaaaggcaccauuaucgguaagcaaaacaauacaugcaccgccaaagcgucaugcuggcuggaaaguguaaagagcuuuuucuauggguuaaagaacaugcugggcggaaucuuuggcaaugucuucauugggaucuuuacuuuccuaacaccauuuauucuccugauauucuuuuucauguuuggauggaggauccuuuucuguuuuaaaugcugucggcguacgcgcgguuuguucaaguacagacaccugaaagacgaugaggagaccggcuauaggaagauuaucgaacggcucaacaauaaaaaggggaagaaccgacugcuugacggagagcgccuggccgauagaaaaaucgcagaauuguucagcacuaagacacauauuggc

SEQ ID NO: 10796 - RNA, 1932 nt, Artificial Sequence
  derived and/or modified CDS sequence (opt3) from CCHFV(SPU 44/08)__KJ682805.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccgcagccaauaucgcguuaucuuggucgucaguggagcacagagggaacaaaauucugguaagcgguaggagugaauccaucaugaagcuagaggaacggaccggcauuucuugggaucucgggguggaggacgcuagcgaguccaaacugcuuacagucucagugauggaucugagucaaauguacagcccaguuuucgaauauuugucuggagaccgccagguggaggaauggccgaaggccacuugcaccggcgauugucccgagcgaugcgguuguacauccucaaccugccuccauaaggaguggccucacagccguaauuggagauguaacccaacuuggugcuggggagucgggacaggcuguaccugcuguggccuggacgugaaagaucuguuuacggacuacauguucguaaaguggaaaguugauuauaucaagacugaagcaauagugugcgucgagcucaccagucaggaaaggcaguguucuuuaaucgaggccgggacacgguuuaaucugggacccgugacuauuacccuuuccgaaccucgcaacauccaacagaaauugccacccgagauugugacacugcauccuagaaucgaggaagguuucuuugaccuaaugcacauacagaagguccucagcgcuucgaccguuugcaagcugcagucuugcacgcauggcgugccaggggaucuucaaauuuaccacaucggaaaucuguugaaaggcgacaagguaaacggucaccucauucauaaaaucgagccgcacuucaauacuuccuggaugucaugggaugggugugaccuggacuauuacugcaacaugggagauuggcccaguuguagcuauacaggcgugacccagcauaaucacgcagccuuugucaacauguuaaauaucgaaacugacuacacaaagaacuuccacuuucauuccaaaagggugaccgcucacggcgauacgccucagcuggaccucaaggcccggccaaccuacggggcgggagagauuacaguucuuguggaagucgcagauauggagcugcauacuaaaaagauagagaucucugguuugaaguucgccagccuaaccugcacaggcuguuaugcuugcucaagugggauuuccuguaaagugcgcauccacguagacgaacccgaugagcugacuguucaugucaagagcgaagacccugauauaguggccgcaucuucaagucucauggcucgaaaacuggaguuuggaaccgacagcacauucaaggccuucuccgcgaugccaaaaaccucucuuugcuuuuacauuguggaaagagaguauuguaagucgugcagcaaggaggauacucagaaaugugucaacacgaagcuggaacaaccccaguccaucuugaucgagcacaaaggcacaauuaucgguaagcagaaugauaccugcacugccaaagcaucaugcuggcucgaaaguauuaagucuuucuuuuacgggcugaagaacauguuaagcggcauauucggaaauguguuuaucggcauuuuccuguuucuagcuccguucaucaugcucauccuguuuuucauguuuggguggaggauucuuuucuguuuuaaaugcugucggcguacccgcggauuguucaaguauagacaccugaaagacgacgaggagauagguuacaggaagaucauugaacggcucaacaauaaaaagggcaagaacaaacugcuugacggggagcgacuggccgaucgcaagaucgcugaauuguucuccacaaaaacccauauugga

SEQ ID NO: 10797 - RNA, 1932 nt, Artificial Sequence
  derived and/or modified CDS sequence (opt3) from CCHFV(SPU 383/87)__KJ682806.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccgcagccaauaucgcguuaucuuggucgucaguggagcacagagggaacaaaauucugguaagcgguaggagugaauccaucaugaagcuagaggaacggaccggcauuucuugggaucucgggguggaggacgcuagcgaguccaaacugcuuacagucucagugauggaucugagucaaauguacagcccaguuuucgaauauuugucuggagaccgccagguggaggaauggccgaaggccacuugcaccggcgauugucccgagcgaugcgguuguacauccucaaccugccuccauaaggaguggccucacagccguaauuggagauguaacccaacuuggugcuggggagucgggacaggcuguaccugcuguggccuggacgugaaagaucuguuuacggacuacauguucguaaaguggaaaguugauuauaucaagacugaagcaauagugugcgucgagcucaccagucaggaaaggcaguguucuuuaaucgaggccgggacacgguuuaaucugggacccgugacuauuacccuuuccgaaccucgcaacauccaacagaaauugccacccgagauugugacacugcauccuagaaucgaggaagguuucuuugaccuaaugcacauacagaagguccucagcgcuucgaccguuugcaagcugcagucuugcacgcauggcgugccaggggaucuucaaauuuaccacaucggaaaucuguugaaaggcgacaagguaaacggucaccucauucauaaaaucgagccgcacuucaauacuuccuggaugucaugggaugggugugaccuggacuauuacugcaacaugggagauuggcccaguuguagcuauacaggcgugacccagcauaaucacgcagccuuugucaacauguuaaauaucgaaacugacuacacaaagaacuuccacuuucauuccaaaagggugaccgcucacggcgauacgccucagcuggaccucaaggcccggccaaccuacggggcgggagagauuacaguucuuguggaagucgcagauauggagcugcauacuaaaaagauagagaucucugguuugaaguucgccagccuaaccugcacaggcuguuaugcuugcucaagugggauuuccuguaaagugcgcauccacguagacgaacccgaugagcugacuguucaugucaagagcgaagacccugauauaguggccgcaucuucaagucucauggcucgaaaacuggaguuuggaaccgacagcacauucaaggccuucuccgcgaugccaaaaaccucucuuugcuuuuacauuguggaaagagaguauuguaagucgugcagcaaggaggauacucagaaaugugucaacacgaagcuggaacaaccccaguccaucuugaucgagcacaaaggcacaauuuucgguaagcagaaugauaccugcacugccaaagcaucaugcuggcucgaaagugugaagucuuucuuuuacgggcugaagaacauguuaagcggcaucuuuggaaauguuuucauuggcguguuucuguuccuagcuccguuuauaaugcucauccuguucuuuauguucggguggaggauuuuguuuuguuucaaaugcugucggcguacccgcggacuuuucaaguauagacaccugaaagacgacgaggagaucgguuacaggaagaucauugaacggcucaacaauaaaaagggcaagaacaaacugcuugacggggagcgacuggccgaucgcaagauagcugaauuguuuuccacaaaaacccauaucgga

SEQ ID NO: 10798 - RNA, 1932 nt, Artificial Sequence
  derived and/or modified CDS sequence (opt3) from CCHFV(SPU 130/89)__KJ682807.1__Gc
agccuggacuccaucgugaagggcaugaaaaaccuccuuaauucuaccucacuggagacaaguuugagcauugaagcccccuggggugcuauaaacguccaguccacuuucaagccuacgguuucugcagccaauaucgcguuaucguggucaagcguggagcacagaggaaacaaaauucugguaagugguagguccgaaucuaucaugaagcuagaggaacggaccggcauuagcugggaucucgggguggaggacgcuuccgagucaaaacugcuuacagucagugugauggaucugagccaaauguacucuccaguuuuugaauauuuguccggagaccgccagguggaggaauggccgaaggccacuugcaccggcgauugucccgagcgaugcgguuguacaucaaguaccugccuccauaaggaguggccucacagccguaauuggagauguaacccaacuuggugcuggggagucgggacaggcuguaccugcuguggccuggacgugaaagaucuguucacggacuacauguuuguaaaguggaaaguugauuauaucaagacugaagcaauagugugcgucgagcucaccucucaggaaaggcaguguuccuuaaucgaggccgggacacgguucaaucugggacccgugacuauuacccuuagcgaaccucgcaacauccaacagaaauugccacccgagauugugacacugcauccuagaaucgaggaaggguuuuucgaccuaaugcacauacagaagguccucucggcuucuaccguuugcaagcugcaguccugcacgcauggcgugccaggggaucuucaaauuuaccacaucggaaaucuguugaaaggcgacaagguaaacggucaccucauucauaaaaucgagccgcacuuuaauacuucauggaugaguugggaugggugugaccuggacuauuacugcaacaugggagauuggcccagcuguuccuauacaggcgugacccagcauaaucacgcagccuucgucaacauguuaaauaucgaaacugacuacacaaagaacuuucacuuccauucuaaaagggugaccgcucacggcgauacgccucagcuggaccucaaggcccggccaaccuacggggcgggagagauuacaguucuuguggaagucgcagauauggagcugcauacuaaaaagguggagauaagcgguuugaaguuugccucacuaaccugcacaggcuguuaugcuugcaguuccgggaucagcuguaaaguacgcauucacguugacgaacccgaugagcugacugugcaugucaagucugaagacccugauaucguggccgcaucaaguagccucauggcucgaaaacuggaguucggaaccgacuccacauuuaaggccuucucugcgaugccaaaaaccucgcuuugcuucuacauagucgaaagagagcacuguaagagcugcuccaaggaggauacucagaggugugugaacacgaaacuggaacaaccccagucaauuuugaucgagcacaagggcacaaucauugguaaacagaaugauaccugcacugccaaggcaaguugcuggcucgaaucuaucaagagcuuuuucuaugggcugaagaacauguuauccggcauuuuuggaaauguuuucauaggcguguuucuguuccuagcuccguuuaucauucucauccuguucuuuauguucggguggcggaucuuguuuuguuucaagugcugucgucgcaccagaggacuucugaaauacaggcaucucaaggacgacgaggagauugguuaucggaaaauaaucgaacgacugaacaauaagaaaggcaagaacaaacuucuggacggggagcgcuuggccgauagaaaaauugcugaacucuuuucaacaaagacccacaucgga

SEQ ID NO: 10799 - RNA, 1932 nt, Artificial Sequence
  derived and/or modified CDS sequence (opt3) from CCHFV(SPU 497/88)__KJ682808.1__Gc
uuccuggacagcaucgugaagggcaugagaaaccuccuuaauuccaccucucuggagacaucauugaguauugaagcccccuggggagcuauaaacguccagagcacuuuuaaaccuacgguuuccgcagccaauaucgcguuaucuuggucgucaguggagcacagggggaacaagauucugguaagcggucggagugaauccaucaugaaacuagaggaacgcaccggcauuucuugggaucucgggguggaggacgcuagcgaguccaagcugcuuacagucucagugauggaucugagucaaauguacagcccaguuuucgaauauuugucuggagaccgacagguggaggaauggccgaaagccacuugcaccggcgauugucccgagcguugcgguuguacauccucaaccugccuccauaaggaguggccucacagcagaaauuggagguguaacccaacuuggugcuggggagucgggacaggcuguaccugcuguggccuggacgugaaggaucuguuuacggacuacauguucguaaaauggaagguugauuauaucaaaacugaagcaauagugugcgucgagcucaccagucaggaacggcaguguucuuuaaucgaggccgggacacgcuuuaaucugggacccgugacuauuacccuuuccgaaccuagaaacauccaacagaaguugccacccgagauugugacacugcauccuaggaucgaggaagguuucuuugaccuaaugcacauacagaaaguccucagcgcuucgaccguuugcaagcugcagucuugcacgcauggcgugccaggggaucuucaaauuuaccacaucggaaaucuguugaagggcgacaaaguaaacggucaccucauucauaagaucgagccgcacuucaauacuuccuggaugucaugggaugggugugaccuggacuauuacugcaacaugggagauuggcccaguuguagcuauacaggcgugacccagcauaaucacgcagccuuugucaacauguuaaauaucgaaacugacuacaccaaaaacuuccacuuucauuccaagcgggugaccgcucacggcgauacgccucagcuggaccucaaagcccgcccaaccuacggggcgggagagauuacaguucuuguggaagucgcagauauggagcugcauacuaagaaaauagagaucucugguuugaaguucgccagccuaaccugcacaggcuguuaugcuugcucaagugggauuuccuguaaggugcgaauccacguagacgaacccgaugagcugacuguucaugugaaaagcgaagacccugauauagucgccgcaucuucaagucucauggcuagaaagcuggaguuuggaaccgacagcacauucaaagccuucuccgcgaugccaaagaccucucuuugcuuuuacauuguggaaagggaguauuguaaaucgugcagcaaggaggauacucagaagugugucaacacgaaacuggaacaaccccaguccaucuugaucgagcacaagggcacaauuaucgguaaacagaaugacacaugcacugcccgggcaucaugcuggcucgaaaguauuaagucuuucuuuuacgggcugaaaaacauguuaagcggcauauucggaaauguguuuaucggcauuuuccuguuuuucgcuccguuuaucaugcuaauccucuucuuuauguucggguggcguauucuguuuuguuucaagugcugucgcagaaccaggggacuuuucaaguaucggcacuugaaagacgaugaggagguugguuaccgaaagauaaucgaacgccugaacaauaaaaagggcaaaaacaagcuccuggacggggagagacuugccgauaggaagauugcugaacuguuuuccacaaaaacccauaucgga

SEQ ID NO: 10800 - RNA, 1932 nt, Artificial Sequence
  derived and/or modified CDS sequence (opt3) from CCHFV(SPU 18/88)__KJ682810.1__Gc
uuccuggacagcaucgugaagggcaaaaagaaccuccuuaauuccaccucucuggagacaucauugaguauugaagcccccuggggagcuauaaacguccagagcacuuuuaaaccuacgguuuccgcagccaauaucgcguuaucuuggucgucaguggagcacagagggaacaagauucugguaagcgguaggagugaauccaucaugaaacuagaggaacggaccggcauuucuugggaucucgggguggaggacgcuagcgaguccaagcugcuuacagucucagugauggaucugagucaaauguacagcccaguuuucgaauauuugucuggagaccgccagguggaggaauggccgaaggccacuugcaccggcgauugucccgagcgaugcgguuguacauccucaaccugccuccauaaagaguggccucacagccguaauuggagauguaacccaacuuggugcuggggagucgggacaggcuguaccugcuguggccuggacgugaaggaucuguuuacggacuacauguucguaaaauggaagguugauuauaucaaaacugaagcaauagugugcgucgagcucaccagucaggaaaggcaguguucuuuaaucgaggccgggacacgguuuaaucugggacccgugacuauuacccuuuccgaaccucgcaacauccaacagaaguugccacccgagauugugacacugcauccuagaaucgaggaagguuucuuugaccuaaugcacauacagaagguccucagcgcuucgaccguuugcaaacugcagucuugcacgcauggcgugccaggggaucuucaaauuuaccacaucggaaaucuguugaagggcgacaaaguaaacggucaccucauucauaagaucgagccgcacuucaauacuuccuggaugucaugggaugggugugaccuggacuauuacugcaacaugggagauuggcccaguuguagcuauacaggcgugacccagcauaaucacgcagccuuugucaacauguuaaauaucgaaacugacuacaccaaaaacuuccacuuucauuccaagagggugaccgcucacggcgauacgccucagcuggaccucaaagcccggccaaccuacggggcgggagagauuacaguucuuguggaagucgcagauauggagcugcauacuaagaagauagagaucucugguuugaaauucgccagccuaaccugcacaggcuguuaugcuugcucaagugggauuuccuguaaggugcgcauccacguagacgaacccgaugagcugacuguucaugugaaaagcgaagacccugauauagucgccgcaucuucaagucucauggcucgaaagcuggaguuuggaaccgacagcacauucaaagccuucuccgcgaugccaaagaccucucuuugcuuuuacauuguggaaagagaguauuguaagucgugcagcaaagaggauacucagaagugugucaacacgaaacuggaacaaccccaguccaucuugaucgagcacaagggcacaauuaucgguaaacagaaugacacaugcacugggaaggccggcugcuggcucgaaucaauuaagaguuucuuuuacggacugaaaaacauguuaucuggcauauucgggaauguguuuaucggaauuuuccuguuucuagcaccguucaucaugcucauccuguuuuucauguuugguuggaggauucuuuucuguuuuaagugcugucggcguacccgcggcuuguucaaauauagacaccugaaggacgaugaggagauaggguacaggaaaaucauugaacggcucaagaacaagaaaggaaagaauaaacugcuugacggcgagcgacuggcugaucgcaagaucgccgaauuguucagcacaaaaacccauauuggu

SEQ ID NO: 10801 - RNA, 1932 nt, Artificial Sequence
  derived and/or modified CDS sequence (opt3) from CCHFV(SPU 431/85)__KJ682812.1__Gc
uuccuggacagcaucgugaagggcagaaagaaccuccuuaauuccaccucucuggagacaucauugaguauugaagcccccuggggagcuauaaacguccagagcacuuuuaagccuacgguuuccgcagccaauaucgcguuaucuuggucgucaguggagcacagggggaacaaaauucugguaagcggucggagugaauccaucaugaagcuagaggaacgcaccggcauuucuugggaucucgggguggaggacgcuagcgaguccaaacugcuuacagucucagugauggaucugagucaaauguacagcccaguuuucgaauauuugucuggagaccgacagguggaggaauggccgaaggccacuugcaccggcgauugucccgagcguugcgguuguacauccucaaccugccuccauaaggaguggccucacagcagaaauuggagguguaacccaacuuggugcuggggagucgggacaggcuguaccugcuguggccuggacgugaaagaucuguuuacggacuacauguucguaaaguggaaaguugaauauaucaagacugaggcaauagugugcgucgaacucaccagucaggagcggcaguguucuuuaaucgaagccgggacacgcuuuaaucugggacccgugacuauuacccuuuccgagccuagaaacauccaacagaaauugccacccgagauuaucacacugcauccuaggauagaagaggguuucuuugaucuaaugcacgugcagcggguccucagcgcuucgaccguuugcaagcugcagucuugcacgcauggcgugccaggggaccuucaaguauaccacauuggaaaucuguugaagggcgauaaagugaacggucaccucauccauaagauugaaccgcacuucaauacuuccuggaugucaugggacgggugugaucuggacuauuacugcaacaugggagacuggcccaguuguacauauaccggcgucacucagcauaaucacgcagccuuugugaacuuacugaauaucgagacagauuacaccaaaaacuuccacuuucauagcaagcgcguuacggcucacggcgacaccccucagcucgaucuuaaagcccgaccaacauacggggcgggagaagugacuguccugguggagguagcagacauggaguugcauaccaagaaaaucgaaauuuccggucuaaaguucgccucucugacaugcacuggcuguuaugcuugcagcucagggauaaguuguaagguuaaaauccacguggaugagcccgacgaacucaccguccaugugaaguccgaggauccugacauugucgccgcaggaagcucucugauggcuagaaaacuugaauuuggcgccgauucaacauucaaggcguucagugccaugccaaaaaccagccugugcuuuuacaucguggagagggaguauuguaaguccugcucucgggaagacacucguaaguguguuaacacgaaauuggaucgcccccagucgauacucauugagcacaaggguacaaucaucgggaaacaaaauaauaccugcacugcaaaggcuagcugcuggcuggaauccgugaaaucauucuuuuacggcuuaaagaacaugcugaguggaauuuucggcaacguauuuaucgggauuuuccuauuuauagccccguucguccuccugauccuuuucuuuauguuuggauggagaauuuuguucuguuuuaagugcuguaggcggacccgaggucuguucaaauaucgccaccucaaggacgacgaggagacaggcuacagaaaaaucaucgaaaggcugaauaacaagaaagggaagaauaaacuucuggauggagagcgguuggcugaccgcaaaauugccgaacucuucucuaccaagagccauauaggc

SEQ ID NO: 10802 - RNA, 1932 nt, Artificial Sequence
  derived and/or modified CDS sequence (opt3) from CCHFV(SPU 48/90)__KJ682813.1__Gc
uucagagacagcaucgugaagggcaugaaaaaccugcucaauuccaccucucuugagacaucacugaguauugaagcccccuggggugcuauaaacguccagagcacuuacaagccuacgguuuccaccgcaaauaucgccuugucuuggucgucaguggagcacaggggaaacaaaauuuuaguaagcggucggagugaauccaucaugaagcuggaggaacgcacaggcauuucuugggaucuagggguggaggacgcgagcgaguccaaacuccugacugucucagugauggaucuuagucagauguauagcccaguuuuugaauaccugucuggagaccgacagguggaggaauggccgaaggcuaccugcacaggcgauugucccgagcguugcgguuguaccuccucaacuugcuugcauaaggaguggccucacagcagaaauuggagguguaacccaacauggugcuggggagucgggaccggcuguacgugcuguggccucgacgugaaagaucuguucacugacuauauguuuguaaaguggaaaguugaauacaucaagaccgaggccauagugugcgucgaacugacaagucaggagcggcaguguucucucaucgaagcagggacucgcuucaauuuaggacccgugaccauuacacuguccgagccuagaaacauccaacagaaacuuccacccgagauuaucaccuugcauccuaggauagaagagggguuuuucgaucugaugcacgugcagaagguccuaagcgccucgacgguuugcaagcuccagucuugcacucauggcgugccaggggaccugcaaguauaucacauuggaaaucuucugaaaggcgauaaggugaacggucacuugauccauaaaauugaaccgcacuuuaauacauccuggaugucaugggacgggugugaucucgacuacuauugcaacaugggagacuggcccaguuguaccuacacuggcgucacacagcauaaucgggcuagcuucgugaaccuguuaaauaucgagaccgauuacacgaagaacuuucacuuccacuccaaacgcguuaccgcacauggcgacacaccucagcuggaucucaaggcccgaccaacuuauggggcuggagaaaucaccgugcuugucgagguggccgacauggagcugcacacuaaaaagauugaaauaucugguuugaaguuugcgagccuaacaugcaccggcuguuacgcaugcucaagugggaucuccuguaaaguaaggauucauguugaugagcccgacgaacugacagugcacgucaagagcgaugacccugauguggucgccgcuucuucaagucucauggccagaaaacuggaguucggaaccgacagcacuuuuaaggcauucuccgcuaugccaaaaacgucucuuugcuucuauaucguggaaaaggaguacuguaagucgugcagcgaggaagauaccaaaaaguguguuaacacaaaacuggagcagccccaauccauauugauugaacauaagggcacuaucaucgguaaacaaaauucaaccugcacagccaaggugaguugcuggcucgagucugccaagagcuuuuucuaugggcugaaagacauguuauccggcauuuuuggaaacguauucaucggcauuuuucuguuccuagcgccguuuauacuccugauccuuuucuuuauguucggguggcggauuuugcuguguuuuaagugcugucgucgcaccagaggacucuucaaauacaggcaccugaaggacgaugaggaaacugguuaucggcgaaucaucgagcgccuuaauaacaaaaagggcaagaauaaacuguuggacggggaaagacucgcagauaggcggauugcugagcuguuuucaacaaagacgcacauagga

SEQ ID NO: 10803 - RNA, 1932 nt, Artificial Sequence
  derived and/or modified CDS sequence (opt3) from CCHFV(SPU 187/90)__KJ682814.1__Gc
uuccuggacagcaucgugaagggcaugaaaaaccuccuuaauuccaccucucuggagacaucauugaguauugaagcccccuggggugcuauaaacguccagagcacuuacaagccuacgguuuccaccgcaaauaucgccuuaucuuggucgucaguggagcacagaggaaacaaaauucugguaagcgguaggagugaauccaucaugaagcuagaggaacggacaggcauuucuugggaucucgggguggaggacgcgagcgaguccaaacugcuuacugucucagugauggaucugagucaaauguauagcccaguuuuugaauacuugucuggagaccgccagguggaggaauggccgaaggcuaccugcacaggcgauugucccgagcgaugcgguuguaccuccucaacuugccuccauaaggaguggccucacagccguaauuggagauguaacccaacauggugcuggggagucgggaccggcuguacgugcuguggccuggacgugaaagaucuguucacugacuauauguuuguaaaguggaaaguugaauacaucaagaccgaggccauagugugcgucgaacucacaagucaggagaggcaguguucuuuaaucgaagcagggacucgguucaaucugggacccgugaccauuacacuuuccgagccucgcaacauccaacagaaauugccacccgagauuaucacccugcauccuagaauagaagagggguuuuucgaucuaaugcacgugcagaagguccucagcgccucgacgguuugcaagcugcagucuugcacucauggcgugccaggggaccuucaaguauaucacauuggaaaucuguugaaaggcgauaaggugaacggucaccucauccauaaaauugaaccgcacuuuaauacauccuggaugucaugggacgggugugaucuggacuacuauugcaacaugggagacuggcccaguuguaccuacacuggcgucacacagcauaaucacgcuagcuucgugaacuuacugaauaucgagaccgauuacacgaagaacuuucacuuccauuccaaaaggguuaccgcacacggcgacacaccucagcucgaucuuaaggcccggccaacuuauggggcuggagaaaucaccgugcuggucgagguggccgacauggaguugcauacuaaaaagauugaaauaucuggucuaaaguuugcgagccugacaugcaccggcuguuacgcaugcucaagugggaucuccuguaaaguacgcauucacguugaugagcccgacgaacucacagugcaugucaagagcgaugacccugauguggucgccgcuucuucaagucugauggcccgaaaacuugaguucggaaccgacagcaucuuuaaggcauucuccgcuaugccaaaaacuucucugugcuucuauauaguggaaagagagcacuguaagucgugcagcgaggaagauacgaagaaauguguuaacacaaaguuggagcagccccaauccauucucaucgaacacaaaggcaccaucauugguaagcagaauagcacuugcaccgccaaaacaaguugcuggcuggagucugugaagucauuuuucuacggguuaaagaacaugcuguccggcaucuuuggaaauguauucauuggcauauuucuauuccucgcgccguuuauccugcuuauuuuguucuuuauguucggguggaggauccuguuuuguuucaaaugcugucggcguacccgcggacucuuuaaguauagacaucugaaagacgacgaggaaacugguuacaggcggaucauugagcgacuuaacaauaagaaaggcaagaacaagcuguuggauggggaacgccucgccgacagaaggauagcagagcuguucucaacaaaaacgcacaucgga

SEQ ID NO: 10804 - RNA, 1932 nt, Artificial Sequence
  derived and/or modified CDS sequence (opt3) from CCHFV(Haskovo-V46/13)__KR092379.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucguuaaguggaaaguggaauacaucaagacagaggccauagucugcguggaacugacuagccaggagaggcaguguagucucaucgaagcagggacccgguuuaauuuaggacccgugacaauuacccugucugagccucgcaacauccaacagaaacuuccacccgagauuaucacguugcacccuaagauagaagaggguuucuuugaucugaugcauguccagaagguucuauccgccagcacugugugcaaacuccagucgugcacacacggcauuccaggggaccugcaaguauaucacaucggaaaucuucugaagggcgauagagugaacggucauuugauucacaaaaucgaaccgcauuucaauaccucuuggauguccugggacgggugugaucucgacuacuauugcaacaugggagacuggcccucauguacuuacacaggcgucacccagcacaaucacgcugcauuugugaaccuguuaaauaucgagacggauuauaccaagacauuccauuuucacaguaaaaggguuacugcccauggcgacaccccucagcuggaucucaaggcucggccaacauacggggccggagaaauuacugugcuugucgagguggcggacauggagcugcacaccaaaaagguagaaauaagcgguuugaaguucgcaucccuaacaugcaccggcuguuacgccugcucuagcgggaucucauguaaaguucgcauucauguggaugagcccgacgaacugacuguccacgugaagaguuccgauccugacgucguggcugccggaacgagccucauggcacgaaaacuggaguuuggcacagauucuaccuucaaggcuuucucagccaugccaaaaaccagucuuugcuuuuauaucguugaaagagaguacuguaagagcugcuccgaggacgauacucagaaguguguggacacaaaacuggaacaaccccagucuauauugauugagcacaaggguaccaucaucgggaaacagaacgacacuugcacagcgagggccucgugcuggcucgaaagcguaaaguccuucuuuuauggccugaaaaacauguuaggaucagucuucggcaauuuucugauugggauccuacucuuccuggcaccguuugugcuuuugguucuguucuuuauguucggauggaagauucucuuuuguuucaagugcugucggcguacgcgcggucuguuuaaauacagacaucuuaaggaugacgaggagaccggcuauaggcggauaaucgaacgacugaacaguaaaaaggggaaaaaucgcuugcucgauggagagagacuggcugacaggaagauugccgaauuauucucuacuaagacacacaucggc

SEQ ID NO: 10805 - RNA, 1932 nt, Artificial Sequence
  derived and/or modified CDS sequence (opt3) from CCHFV(24-R-2012)__KR814856.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucguuaaguggaaaguggaauacaucaagacagaggccauagucugcguggaacugacuagccaggagaggcaguguagucucaucgaagcagggacccgguuuaauuuaggacccgugacaauuacccugucugagccucgcaacauccaacagaaacuuccacccgagauuaucacguugcacccuaaggucgaagaggguuucuuugaucugaugcauguucagaaggugcuauccgccagcacuguaugcaaacuccagucgugcacacacggcauaccaggggaccugcaaguguaucacauuggaaaucuucugaagggcgauagagucaacggucauuugauccacaaaauugaaccgcauuucaauaccucuuggauguccugggacgggugugaucucgacuacuauugcaacaugggagacuggcccucauguacuuacacaggcgugacccagcacaaucacgcugcauuuguuaaccuguuaaauaucgagacggauuauaccaagacauuccauuuucacaguaaaagggugacugcccauggcgacaccccucagcuggaucucaaggcucggccaacauacggggccggagaaaucacuguccuuguggagguagcggacauggagcugcacaccaaaaagguugaaauuagcgguuugaaguucgcaucccuagccugcacaggcuguuacgcuugcucuagcgggauaucauguaaagugcgcauccaugucgaugagcccgacgaacugaccgugcacgucaagaguaacgauccugacgugguugccgcauccacuagccucauggcucgaaaacuggaguuuggaacggauucuacauucaaggccuucucagcgaugccaaaaaccagucuuugcuuuuauauuguggaaagagaguacuguaagagcugcuccgaggaagacacucagaaguguguagauaccaaacuggagcaaccccagucuaucuugauagaacacaagggcacaauuaucgguaaacagaacgauaccugcacugccaaggcaucgugcuggcucgagagcgucaaauccuucuuuuaugggcugaagaauauguuaggcucaguguucggaaacuuuuucaucggcauucugcuauuucucgcuccguucguucugcuuguguuguuuuucauguuuggguggaagauccuguucuguuuuaaaugcuguaggcggacacguggacuccugaaguaccgccuucugaaagacgacgaggaaacggguuauagaaggauuauagagcgguugaauaacaagaaaggcaagaaucgacuccuggacggggaacgcuuagccgauagaaagaucgcugagcuguucaguaccaaaacucauauugga

SEQ ID NO: 10806 - RNA, 1932 nt, Artificial Sequence
  derived and/or modified CDS sequence (opt3) from CCHFV(36-ST-2014)__KR814857.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucaucaaguggaaaguugaauacauaaagacagaggccaucgugugcgucgaacugacuagccaggagaggcaguguagucucauugaagcagggacccgguuuaauuuaggacccgugacaaucacccugucugagccucgcaacauucaacagaaacuuccacccgagaucauaacguugcacccuaagauugaagaggguuucuuugaucugaugcaugugcagaagguccuauccgccagcacuguuugcaaacuccagucgugcacacacggcaucccaggggaccugcaaauuuaucacaucggaaaucuucugaagggcgauagauugaacggucaucucauccacaaaauugaaccgcauuucaauaccucuuggauguccugggacgggugugaucuggacuacuauugcaacaugggagacuggcccucauguacuuacacaggcgugacccagcacaaucacgcugcauuuguaaacuuacugaauauagagacggauuauaccaagacauuccauuuucacaguaaaagggugacugcccauggcgacaccccucagcucgaucuuaaggcucggccaacauacggggccggagaaaucacuguccugguggagguugcggacauggaguugcacaccaaaaagguggaaauuagcggucuaaaguucgcaucccuggccugcacaggcuguuacgcuugcucuagcgggaucucauguaaaguccgcauacauguggaugagcccgacgaacucaccguacacguuaagaguuccgauccugacguggucgccgcaagcacuucucugauggcucgaaaacuugaguuuggaacggauucaacauucaaggccuucagugcgaugccaaaaaccagccugugcuuuuauauuguggaaagagaguacuguaaguccugcucugaggacgauacuaagaaaugugucgacaccaaguuggaccagccccaaucgauccucaucgaacacaaaggcacaauuaucgguaagcagaacgauaccugcacugccaaagcaagcugcuggcuggaguccgugaagucauucuuuuauggguuaaagaacaugcugggcaguguuuucggaaauuucuuugugggcauucuacucuuucuggcuccguucguacuuuugguccuguuuuucauguguggguggaaauuucucuucugcuuuaaguguugcaggcggacacguggacuguucaaauaccgccaucuuaaggacgaugaagagacggguuauagaaggauaaucgagcggcugaacucuaaaaagggcaagaaucgauugcucgacggggaacgccuggccgauagaaaaauugcugaguuauucagcaccaagucccacaucgga

SEQ ID NO: 10807 - RNA, 1932 nt, Artificial Sequence
  derived and/or modified CDS sequence (opt3) from CCHFV(37-R-2013)__KR814858.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgacgaugcgucugagagcaaacugcuuaccguguccauuauggaccugucacaaauguacaguccaguuuucgaguauuugagcggagaucgccagguggaagaguggccgaaggcuacaugcaccggcgacugucccgaacgaugcgguuguacuucuuccacaugccuccauaaggaguggccucacucacguaauuggagauguaacccaaccuggugcuggggagucgggacgggcuguacuugcuguggcguggauguaaaagaccuguuuaccgaucauauguucguuaaguggaaaguggaguacaucaagacagaagccauagucugcguggagcugacuagccaggaaaggcaguguagucucaucgaggcagggacccgguuuaauuuaggacccgugacaauuacccugucugaaccucgcaacauccaacagaaacuuccacccgagauuaucacguugcacccuaaggucgaggaagguuucuuugaccugaugcauguucagaaggugcuauccgccagcacuguaugcaaacuccagucgugcacacacggcauaccaggggaucugcaaguguaucacauuggaaaucuucugaagggcgacagagucaacggucauuugauccacaaaauugagccgcauuucaauaccucuuggauguccugggaugggugugaccucgacuacuauugcaacaugggagauuggcccucauguacuuacacaggcgugacccagcacaaucacgcugcauuuguuaaccuguuaaauaucgaaacggacuauaccaagacauuccauuuucacaguaaaagggugacugcccauggcgauaccccucagcuggaccucaaggcucggccaacauacggggccggagagaucacuguccuuguggaaguagcggauauggagcugcacaccaaaaagguugagauuagcgguuugaaguucgcaucccuagccugcacaggcuguuacgcuugcucuagcgggauaucauguaaagugcgcauccaugucgacgaacccgaugagcugaccgugcacgucaagaguaacgacccugaugugguugccgcauccacuagccucauggcucgaaaacuggaauuuggaacggacucuacauucaaggccuucucagcgaugccaaaaaccagucuuugcuuuuauauuguggagagagaauacuguaagagcugcuccgaggaggauacucagaaguguguagacaccaaacuggaacaaccccagucuaucuugauagagcacaagggcacaauuaucgguaaacagaacgugaccugcacugccaaggcaucgugcuggcucgaaagcgucaaauccuucuuuuaugggcugaagaauauguuaggcucaguuuucggaaacuuuuucaucggcauucugcuauuucucgcuccguucgugcugcuugucuuguuuuucauguuuggguggaagauccuguucuguuuuaaaugcuguaggcggacacguggacuccugaaguaccgccuucugaaagacgaugaggagacggguuauagaaggauuauagaacgguugaauaacaagaaaggcaagaaucgacuccuggacggggagcgcuuagccgauagaaagaucgcugaacuguucaguaccaaaacucauauugga

SEQ ID NO: 10808 - RNA, 1932 nt, Artificial Sequence
  derived and/or modified CDS sequence (opt3) from CCHFV(44-ST-2010)__KR814859.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucaucaaguggaaaguugaauacauaaagacagaggccaucgugugcgucgaacugacuagccaggagaggcaguguagucucauugaagcagggacccgguuuaauuuaggacccgugacaaucacccugucugagccucgcaacauucaacagaaacuuccacccgagaucauaacguugcacccuaagauugaagaggguuucuuugaucugaugcaugugcagaagguccuauccgccagcacuguuugcaaacuccagucgugcacacacggcaucccaggggaccugcaaauuuaucacaucggaaaucuucugaagggcgauagauugaacggucaucucauccacaaaauugaaccgcauuucaauaccucuuggauguccugggacgggugugaucuggacuacuauugcaacaugggagacuggcccucauguacuuacacaggcgugacccagcacaaucacgcugcauuuguaaacuuacugaauauagagacggauuauaccaagacauuccauuuucacaguaaaagggugacugcccauggcgacaccccucagcucgaucuuaaggcucggccaacauacggggccggagaaaucacuguccugguggagguugcggacauggaguugcacaccaaaaagguggaaauuagcggucuaaaguucgcaucccuggccugcacaggcuguuacgcuugcucuagcgggaucucauguaaaguccgcauacauguggaugagcccgacgaacucaccguacacguuaagaguuccgauccugacguggucgccgcaagcacuucucugauggcucgaaaacuugaguuuggaacggauucaacauucaaggccuucagugcgaugccaaaaaccagccugugcuuuuauauuguggaaagagaguacuguaaguccugcucugaggacgauacuaagaaaugugucgacaccaaguuggaccagccccaaucgauccucaucgaacacaaaggcacaauuaucgguaagcagaacgauaccugcacugccaaagcaagcugcuggcuggaguccgugaagucauucuuuuauggguuaaagaacaugcugggcaguguuuucggaaauuucuuugugggcauucuacucuuucuggcuccguucguacuuuugguccuguuuuucauguguggguggaaaauacucuuuugcuucaaguguugcaggcggacacguggacuguuuaaauaccgccaucuuaaggacgaugaagagacggguuauagaaggaucauugagcggcugaacucuaaaaagggcaagaaucgauugcucgacggggaacgccuggccgauagaaaaaucgcugaguuauucagcaccaagucccacaucgga

SEQ ID NO: 10809 - RNA, 1932 nt, Artificial Sequence
  derived and/or modified CDS sequence (opt3) from CCHFV(46-ST-2012)__KR814860.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucguuaaguggaaaguggaauacaucaagacagaggccauagucugcguggaacugacuagccaggagaggcaguguagucucaucgaagcagggacccgguuuaauuuaggacccgugacaauuacccugucugagccucgcaacauccaacagaaacuuccacccgagauuaucacguugcacccuaaggucgaagaggguuucuuugaucugaugcauguucagaaggugcuauccgccagcacuguaugcaaacuccagucgugcacacacggcauaccaggggaccugcaaguguaucacauuggaaaucuucugaagggcgauagaaucaacggucauuugauucacaaaaucgaaccgcauuucaauaccucuuggauguccugggacgggugugaucucgacuacuauugcaacaugggagacuggcccucauguacuuacacaggcgucacccagcacaaucacgcugcauuugugaaccuguuaaauaucgagacggauuauaccaagacauuccauuuucacaguaaaaggguuacugcccauggcgacaccccucagcuggaucucaaggcucggccaacauacggggccggagaaauuacugugcuugucgagguggcggacauggagcugcacaccaaaaagguagaaauaagcgguuugaaguucgcaucccuagccugcacaggcuguuacgcuugcucuagcgggaucucauguaaaguucgcauucauguggaugagcccgacgaacugaccguccacgugaagaguuccgauccugacgucguggccgcaagcacuucucucauggcucgaaaacuggaguuuggaacggauucaacauucaaggccuucagugcgaugccaaaaaccagccuuugcuuuuauaucguugaaagagaguacuguaaguccugcucugaggaagacacucagaaguguguggauaccaggcuggagcaaccccagucgauauugauugaacacaaaggcacaaucaucgguaagcagaacgauaccugcacugccaaagcaagcugcuggcucgaguccguaaagucauucuuuuaugggcugaaaaacauguuaggcagugucuucggaaacuuuuucauuggcauccugcuauuucucgcuccguucgugcugcuuguuuuguuuuucauguuuggguggaagauucuguucuguuuuaagugcugucggcguacacgcggacuccugaaauacagacaucuuaaggacgacgaggaaacggguuauaggcggauaaucgagcgacugaauaauaaaaagggcaaaaaccgcuugcucgacggggaaagacuggccgauaggaagauugcugaguuauucucuaccaagacucacaucgga

SEQ ID NO: 10810 - RNA, 1932 nt, Artificial Sequence
  derived and/or modified CDS sequence (opt3) from CCHFV(47-ST-2013)__KR814861.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgagugucccgagcgaugcgguuguacuucuuccacaugccuccauaaggaauggccucacucacguaauuggagauguaacccaaccuggugcuggggagucgggacgggcuguacuugcuguggcguggauguaaaagaccuguuuaccgaucauauguucaucaaguggaaaguugaguacauaaagacagaagccaucgugugcgucgagcugacuagccaggaaaggcaguguagucucauugaggcagggacccgguuuaauuuaggacccgugacaaucacccugucugagccucgcaacauucaacagaaacuuccacccgaaaucauaacguugcacccuaagauugaggaagguuucuuugaccugaugcaugugcagaagguccuauccgccagcacuguuugcaaacuccagucgugcacacacggcaucccaggggaucugcaaauuuaucacaucggaaaucuucugaagggcgacagagugaacggucauuugauccacaaaauugagccgcauuucaauaccucuuggauguccugggaugggugugaccucgauuacuauugcaacaugggagacuggcccucauguacuuacacaggcguaacccagcacaaucacgcugcauuugugaaccuguuaaauauagaaacggacuauaccaagacauuccauuuucacaguaaaagggucacugcccauggcgauaccccucagcuggaccucaaggcucggccaacauacggggccggagagaucacugugcuuguugagguggcggauauggaacugcacaccaaaaaggucgaggugagcgguuugaaguucgcaucccuagccugcacaggcuguuacgcuugcucuagcgggauuucauguaaaguacgcauccauguugacgaacccgaugagcugaccgugcacgucaagaguuccgacccugauguggucgccgcaagcacuucucucauggcucgaaaacuggaauuuggaacggacucaacauucaaggccuucagugcgaugccaaaaaccagccuuugcuuuuauauaguggagagagaguacuguaaguccugcucugaagaugacacuaagaaauguguugauaccaagcuggagcagccccaaucgauuuugaucgaacacaaaggcacaaucauugguaagcagaacgauaccugcacugccaaagcaagcugcuggcucgaguccgugaagucauucuuuuaugggcugaagaacauguuaggcaguguauucggaaacuuuuucgucggcauccugcuauuucucgcuccguucgugcugcuuguuuuguuuuucauguuuggguggaaaauucuguucuguuuuaagugcuguaggcggacacguggacucuucaaauaccgccaucugaaggacgacgaggaaacggguuauagaaggauaaucgagcggcuuaauucuaaaaagggcaagaaucgacuguuggacggggaacgccucgccgauagaaaaauugcugagcuguucagcaccaagacucacaucgga

SEQ ID NO: 10811 - RNA, 1932 nt, Artificial Sequence
  derived and/or modified CDS sequence (opt3) from CCHFV(52-R-2014)__KR814862.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgacgaugcgucugagagcaaacugcuuaccguguccauuauggaccugucacaaauguacaguccaguuuucgaguauuugagcggagaucgccagguggaagaguggccgaaggcuacaugcaccggcgacugucccgaacgaugcgguuguacuucuuccacaugccuccauaaggaguggccucacucacguaauuggagauguaacccaaccuggugcuggggagucgggacgggcuguacuugcuguggcguggauguaaaagaccuguuuaccgaucauauguucguuaaguggaaaguggaguacaucaagacagaagccauagucugcguggagcugacuagccaggaaaggcaguguagucucaucgaggcagggacccgguuuaauuuaggacccgugacaauuacccugucugaaccucgcaacauccaacagaaacuuccacccgagauuaucacguugcacccuaaggucgaggaagguuucuuugaccugaugcauguucagaaggugcuauccgccagcacuguaugcaaacuccagucgugcacacacggcauaccaggggaucugcaaguguaucacauuggaaaucuucugaagggcgacagagucaacggucauuugauccacaaaauugagccgcauuucaauaccucuuggauguccugggaugggugugaccucgacuacuauugcaacaugggagauuggcccucauguacuuacacaggcgugacccagcacaaucacgcugcauuuguuaaccuguuaaauaucgaaacggacuauaccaagacauuccauuuucacaguaaaagggugacugcccauggcgauaccccucagcuggaccucaaggcucggccaacauacggggccggagagaucacuguccuuguggaaguagcggauauggagcugcacaccaaaaagguugagauuagcgguuugaaguucgcaucccuagccugcacaggcuguuacgcuugcucuagcgggauaucauguaaagugcgcauccaugucgacgaacccgaugagcugaccgugcacgucaagaguaacgacccugaugugguugccgcauccacuagccucauggcucgaaaacuggaauuuggaacggacucuacauucaaggccuucucagcgaugccaaaaaccagucuuugcuuuuauauuguggagagagaauacuguaagagcugcuccgaggaggauacucagaaguguguagacaccaaacuggaacaaccccagucuaucuugauagagcacaagggcacaauuaucgguaaacagaacgauaccugcacugccaaggcagggugcuggcucgaaucggucaagagcuucuuuuauggccugaaaaauauguuaggauccguguucggcaacuuuuucaucgggauucugcuauuucucgcuccguucguucugcuuguguuguuuuucauguuuggauggaagauccuguucuguuuuaaaugcuguaggcggacacguggucuccugaaguaccgccuucugaaagacgacgaggagacgggcuauagaaggauuauagaacgguugaauaacaagaaagggaagaaucgacuccuggauggagagcgcuuagccgacagaaagaucgcugaacuguucucaaccaaaacucauauuggc

SEQ ID NO: 10812 - RNA, 1932 nt, Artificial Sequence
  derived and/or modified CDS sequence (opt3) from CCHFV(75-R-2012)__KR814863.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucguuaaguggaaaguggaauacaucaagacagaggccauagucugcguggaacugacuagccaggagaggcaguguagucucaucgaagcagggacccgguuuaauuuaggacccgugacaauuacccugucugagccucgcaacauccaacagaaacuuccacccgagauuaucacguugcacccuaaggucgaagaggguuucuuugaucugaugcauguucagaaggugcuauccgccagcacuguaugcaaacuccagucgugcacacacggcauaccaggggaccugcaaguguaucacauuggaaaucuucugaagggcgauagagucaacggucauuugauccacaaaauugaaccgcauuucaauaccucuuggauguccugggacgggugugaucucgacuacuauugcaacaugggagacuggcccucauguacuuacacaggcgugacccagcacaaucacgcugcauuuguuaaccuguuaaauaucgagacggauuauaccaagacauuccauuuucacaguaaaagggugacugcccauggcgacaccccucagcuggaucucaaggcucggccaacauacggggccggagaaaucacuguccuuguggagguagcggacauggagcugcacaccaaaaagguugaaauuagcgguuugaaguucgcaucccuagccugcacaggcuguuacgcuugcucuagcgggauaucauguaaagugcgcauccaugucgaugagcccgacgaacugaccgugcacgucaagaguuccgauccugacgugguugccgcaagcacuucucucauggcucgaaaacuggaguuuggaacggauucaacauucaaggccuucagugcgaugccaaaaaccagccuuugcuuuuauauuguggaaagagaguacuguaaguccugcucugaggaagacacucagaaguguguagauaccaaacuggagcaaccccagucgaucuugauagaacacaagggcacaauuaucgguaaacagaacgauaccugcacugccaaggcaagcugcuggcucgaguccgucaaaucauuccuguauggguuaaagaacaugcugggcaguguguuuggaaauuucuuuaucggcauucuacucuuccuggcuccguuuguucuuuuggugcuguucuuuauguucggguggaagauccucuuuuguuucaaaugcuguaggcggacacguggacugcuuaaguaccgccuguugaaagacgacgaggaaacggguuauagaaggauuauagagcggcucaacaauaagaaaggcaagaaccgacuguuagacggggaacgccuggccgauagaaagaucgcugagcuauuuucuaccaaaacucauauugga

SEQ ID NO: 10813 - RNA, 1932 nt, Artificial Sequence
  derived and/or modified CDS sequence (opt3) from CCHFV(75-ST-2010)__KR814864.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucguuaaguggaaaguggaauacaucaagacagaggccauagucugcguggaacugacuagccaggagaggcaguguagucucaucgaagcagggacccgguuuaauuuaggacccgugacaauuacccugucugagccucgcaacauccaacagaaacuuccacccgagauuaucacguugcacccuaaggucgaagaggguuucuuugaucugaugcauguucagaaggugcuauccgccagcacuguaugcaaacuccagucgugcacacacggcauaccaggggaccugcaaguguaucacauuggaaaucuucugaagggcgauagagucaacggucauuugauccacaaaauugaaccgcauuucaauaccucuuggauguccugggacgggugugaucucgacuacuauugcaacaugggagacuggcccucauguacuuacacaggcgugacccagcacaaucacgcugcauuuguuaaccuguuaaauaucgagacggauuauaccaagacauuccauuuucacaguaaaagggugacugcccauggcgacaccccucagcuggaucucaaggcucggccaacauacggggccggagaaaucacuguccuuguggagguagcggacauggagcugcacaccaaaaagguugaaauuagcgguuugaaguucgcaucccuagccugcacaggcuguuacgcuugcucuagcgggauaucauguaaagugcgcauccaugucgaugagcccgacgaacugaccgugcacgucaagaguuccgauccugacgugguugccgcaagcacuucucucauggcucgaaaacuggaguuuggaacggauucaacauucaaggccuucagugcgaugccaaaaaccagccuuugcuuuuauauuguggaaagagaguacuguaaguccugcucugaggaagacacucagaaguguguagauaccaaacuggagcaaccccagucgaucuugauagaacacaagggcacaauuaucgguaaacagaacgauaccugcacugccaaggcaagcugcuggcucgaguccgucaaaucauucuuuuaugggcugaagaacauguuaggcaguguguucggaaacuuuuucaucggcauucugcuauuucucgcuccguucguucugcuuguguuguuuuucauguuuggguggaagauccuguucuguuuuaaaugcuguaggcgggcccguggacuccugaaguaccgccaucuuaaagacgacgaggaaacagguuauagaaagauuauagagaggcugaauaauaaaaagggcaagaaccgguugcucgacggggaacgacuggcugaucgcaaaaucgccgaguuauucucuacgaagacccacauugga

SEQ ID NO: 10814 - RNA, 1932 nt, Artificial Sequence
  derived and/or modified CDS sequence (opt3) from CCHFV(3756-ST-2007)__KR814866.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucaucaaguggaaaguugaauacauaaagacagaggccaucgugugcgucgaacugacuagccaggagaggcaguguagucucauugaagcagggacccgguuuaauuuaggacccgugacaaucacccugucugagccucgcaacauucaacagaaacuuccacccgagaucauaacguugcacccuaagauugaagaggguuucuuugaucugaugcaugugcagaagguccuauccgccagcacuguuugcaaacuccagucgugcacacacggcaucccaggggaccugcaaauuuaucacaucggaaaucuucugaagggcgauagagugaacggucauuugauccacaaaauugaaccgcauuucaauaccucuuggauguccugggacgggugugaucucgacuacuauugcaacaugggagacuggcccucauguacuuacacaggcguaacccagcacaaucacgcugcauuugugaaccuguuaaauauagagacggauuauaccaagacauuccauuuucacaguaaaagggucacugcccauggcgacaccccucagcuggaucucaaggcucggccaacauacggggccggagaaaucacugugcuuguugagguggcggacauggagcugcacaccaaaaaggucgaaauuagcgguuugaaguucgcaucccuaacaugcaccggcuguuacgccugcucuagcgggaucucauguaaagugcgcauacauguagaugagcccgacgaacugacuguucacgugaagaguuccgauccugacgucguggcugccagcacgucucucauggcacgaaaacuggaguuuggaacagauucaaccuucaaggcuuucagugccaugccaaaaacuagccuuugcuuuuauauugucgaaagagaguacuguaaguccugcucugaggacgauaccaagaaauguguggacacaaagcuggaacagccccaaucgaucuugaucgagcacaaaggcaccauuaucgguaagcagaacgacacuugcacagcgaaagccagcugcuggcucgaauccguuaagucauucuuuuaugggcugaagaacauguuaggcaguguguucggaucuuucuuuguaggcauucugcuauuucucacgccguucguccugcuuguguuguuuuucauguuuggguggaaaauacuguucuguuuuaagugcuguaggcggacccguggacucuucaaauaccgccaucugaaggaugacgaggagacugguuauagaaggaucauugaacggcuuaauagcaaaaagggcaagaaccgacuguuggauggggagcgccucgcagacagaaaaaucgcugaacuguucuccacaaagacccacaucgga

SEQ ID NO: 10815 - RNA, 1932 nt, Artificial Sequence
  derived and/or modified CDS sequence (opt3) from CCHFV(3809-ST-2007)__KR814867.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucguuaaguggaaaguggaauacaucaagacagaggccauagucugcguggaacugacuagccaggagaggcaguguagucucaucgaagcagggacccgguuuaauuuaggacccgugacaauuacccugucugagccucgcaacauccaacagaaacuuccacccgagauuaucacguugcacccuaaggucgaagaggguuucuuugaucugaugcauguucagaaggugcuauccgccagcacuguaugcaaacuccagucgugcacacacggcauaccaggggaccugcaaguguaucacauuggaaaucuucugaagggcgauagagucaacggucauuugauccacaaaauugaaccgcauuucaauaccucuuggauguccugggacgggugugaucucgacuacuauugcaacaugggagacuggcccucauguacuuacacaggcgugacccagcacaaucacgcugcauuuguuaaccuguuaaauaucgagacggauuauaccaagacauuccauuuucacaguaaaagggugacugcccauggcgacaccccucagcuggaucucaaggcucggccaacauacggggccggagaaaucacuguccuuguggagguagcggacauggagcugcacaccaaaaagguugaaauuagcgguuugaaguucgcaucccuagccugcacaggcuguuacgcuugcucuagcgggauaucauguaaagugcgcauccaugucgaugagcccgacgaacugaccgugcacgucaagaguuccgauccugacgugguugccgcaagcacuucucucauggcucgaaaacuggaguuuggaacggauucaacauucaaggccuucagugcgaugccaaaaaccagccuuugcuuuuauauuguggaaaaggaguacuguagauccugcucugaggaagacacucagaaguguguagauaccaaacuggagcaaccccagucgaucuugauagaacacaagggcacaauuaucgguaaacagaacgauaccugcacugccaaggcaagcugcuggcucgaguccgucaaaucauucuuuuaugggcugaagaacauguuaggcaguguguucggaaacuuuuucaucggcauucugcuauuucucacaccguucguucugcuuguguuguuuuucauguuuggguggaagauccuguucuguuuuaaaugcuguaggcggacgcguggacuccugaaguaccgccaucuuaaagacgacgaggaaaccgguuauagaaggauuauagagcggcugaauaauaagaaaggcaagaaccgauugcucgacggggaacgccuggcugauagaaagaucgccgaguuauucucuacuaaaacacacauugga

SEQ ID NO: 10816 - RNA, 1932 nt, Artificial Sequence
  derived and/or modified CDS sequence (opt3) from CCHFV(3820-ST-2007)__KR814868.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucaucaaguggaaaguugaauacauaaagacagaggccaucgugugcgucgaacugacuagccaggagaggcaguguagucucauugaagcagggacccgguuuaauuuaggacccgugacaaucacccugucugagccucgcaacauucaacagaaacuuccacccgagaucauaacguugcacccuaagauugaagaggguuucuuugaucugaugcaugugcagaagguccuauccgccagcacuguuugcaaacuccagucgugcacacacggcaucccaggggaccugcaaauuuaucacaucggaaaucuucugaagggcgauagagugaacggucauuugauccacaaaauugaaccgcauuucaauaccucuuggauguccugggacgggugugaucucgacuacuauugcaacaugggagacuggcccucauguacuuacacaggcguaacccagcacaaucacgcugcauuugugaaccuguuaaauauagagacggauuauaccaagacauuccauuuucacaguaaaagggucacugcccauggcgacaccccucagcuggaucucaaggcucggccaacauacggggccggagaaaucacugugcuuguugagguggcggacauggagcugcacaccaaaaaggucgaaauuagcgguuugaaguucgcaucccuaacaugcaccggcuguuacgccugcucuagcgggaucucauguaaagugcgcauacauguagaugagcccgacgaacugacuguucacgugaagaguuccgauccugacgucguggcugccagcacgucucucauggcacgaaaacuggaguuuggaacagauucaaccuucaaggcuuucagugccaugccaaaaacuagccuuugcuuuuauauugucgaaagagaguacuguaaguccugcucugaggacgauaccaagaaauguguggacacaaagcuggaacagccccaaucgaucuugaucgagcacaaaggcaccauuaucgguaagcagaacgacacuugcacagcgaaagccagcugcuggcucgaauccguuaagucauucuuuuaugggcugaagaacauguuaggcaguguguucggaucuuucuuuguaggcauucugcuauuucucgcaccguucguccugcuuguguuguuuuucauguuuggguggaaaauacuguucuguuuuaagugcuguaggcggacgcguggacucuucaaauaccgccaucugaaggaugacgaggagaccgguuauagaaggaucauugaacggcuuaauagcaaaaagggcaagaaccgacuguuggauggggagcgccucgcugacagaaaaaucgccgaacuguucuccacuaagacacacaucgga

SEQ ID NO: 10817 - RNA, 1932 nt, Artificial Sequence
  derived and/or modified CDS sequence (opt3) from CCHFV(4495-ST-2008)__KR814869.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcauuuccugggaucucgggguggaggacgcgucugagagcaaacugcuuaccgucuccaucauggaucugucacaaauguacaguccaguguucgaauauuugagcggagaccgccagguugaggaauggccgaaggcuacaugcaccggcgauugucccgagcgaugcgguuguacuucuuccacaugccuccauaaggaguggccucacucacguaauuggagauguaacccaaccuggugcuggggaguggggacgggcuguacuugcuguggcgucgacgugaaagaucuguuuaccgaccauauguucguaaaguggaaaguugaauacauaaagacagaggccaucgugugcgucgaacugacuagccaggagaggcaguguagucucauugaagcagggacccgguuuaauuuaggacccgugacaaucacccugucugagccucgcaacauucaacagaaacuuccacccgagaucauaacguugcacccuaagguggaagaggguuucuuugaucugaugcauguccagaagguucuauccgccagcacugugugcaaacuccagucgugcacacacggcauuccaggggaccugcaaguauaucacaucggaaaucuucugaagggcgauagagugaacggucauuugauucacaaaaucgaaccgcauuucaauaccucuuggauguccugggacgggugugaucucgacuacuauugcaacaugggagacuggcccucauguacuuacacaggcgucacccagcacaaucacgcugcauuugugaaccuguuaaauaucgagacggauuauaccaagacauuccauuuucacaguaaaaggguuacugcccauggcgacaccccucagcuggaucucaaggcucggccaacauacggggccggagaaauuacugugcuugucgagguggcggacauggagcugcacaccaaaaagguagaaauaagcgguuugaaguucgcaucccuagccugcacaggcuguuacgcuugcucuagcgggaucucauguaaaguucgcauucauguggaugagcccgacgaacugaccguccacgugaagaguuccgauccugacgucguggccgcaagcacuucucucauggcucgaaaacuggaguuuggaacggauucaacauucaaggccuucagugcgaugccaaaaaccagccuuugcuuuuauaucguugaaagagaguacuguaaguccugcucugaggaagacacucagagguguguggauaccaagcuggagcaaccccagucgauauugauugaacacaaaggcacaaucaucgguaagcagaacgauaccugcacugccaaagcaagcugcuggcucgaguccguaaagucauucuuuuaugggcugaaaaacauguuaggcagugucuucggaaacuuuuucauuggcauccugcuauuucucgcuccguucgugcugcuuguuuuguuuuucauguuuggguggaagauucuguucuguuuuaagugcugucggcgugcccgcggacuccugaaauacagacaucuuaaggacgacgaggaaacagguuauaggaaaauaaucgagcggcugaauaauaagaaaggcaagaaccgauugcucgacggggaacgccuggcugauagaaagauugccgaguuauucucuacgaaaacccacaucgga

SEQ ID NO: 10818 - RNA, 1932 nt, Artificial Sequence
  derived and/or modified CDS sequence (opt3) from CCHFV(4691-ST-2009)__KR814871.1__Gc
uuccuggacagcaucgugaagggcaugaaaaaccuccuuaauuccaccucucuggagacaucauugaguauugaagcccccuggggagcuauaaacguccagagcacuuuuaagccugcaguuuccacggccaauaucgcguuaucuuggucgucaguggagcacagagggaacaaaauucugguaaccgguaggagcgaaaguaucaugaagcuagaggaacggacaggcguguccugggaucucggggucgaggacgcuucugagagcaaacugcuuacuguguccauuauggaucugucacaaauguacaguccaguuuucgaauauuugagcggagaccgccagguggaggaauggccgaaggcaaccugcacaggcgauugucccgagcgaugcgguuguaccucuuccacuugccuccauaaggaguggccucacucacguaauuggagauguaacccaacauggugcuggggagucgggaccggcuguacgugcuguggcguggacguaaaagaucuguuuacugaccauauguucaucaaguggaaaguugaauacauaaagaccgaggccaucgugugcgucgaacugacaagccaggagaggcaguguagucucauugaagccgggacucgguuuaauuuaggacccgugaccaucacacugucugagccucgcaacauucaacagaaacuuccacccgagaucauaaccuugcacccuaagauugaagaggguuucuuugaucugaugcaugugcagaagguccuauccgcuagcacgguuugcaaacuccagucgugcacucacggcaucccaggggaccugcaaauuuaucacaucggaaaucuucugaagggcgauagagugaacggucauuugauccacaaaauugaaccgcauuucaauacaucuuggauguccugggacgggugugaucucgacuacuauugcaacaugggagacuggcccucauguaccuacacuggcguaacacagcacaaucacgcagccuuugugaaccuguuaaauauagagaccgauuauacgaagaccuuccauuuucacaguaaaagggucacagcucauggcgacacuccucagcuggaucucaaggcccggccaaccuacggggcgggagaaaucacagugcuuguugagguggcagacauggagcugcacacuaaaaaggucgaaauuagcgguuugaaguucgccucccuagcuugcaccggcuguuacgccugcucuagcgggaucucauguaaagugcgcauacauguagaugagcccgacgaacugacaguucacgugaagaguuccgauccugacgucguggcagcuagcaccucucucauggcccgaaaacuggaguuuggaacugauucaacguucaaggcguucagugccaugccaaaaacaagccuuugcuuuuauauugucgaaagagaguacuguaaguccugcucugaggacgauaccaagaaauguguggacacuaagcuggaacagccccaaucgaucuugaucgagcacaaaggcaccauuaucgguaagcagaacgacacaugcaccgcaaaagcuagcugcuggcucgaauccguuaagucauucuuuuaugggcugaagaacauguuaggcaguguguucggaaacuuuuucguaggcauucugcuauuucucgccccguucguccugcuuguguuguuuuucauguuuggguggaaaauacuguucuguuuuaagugcuguaggcggacucguggacucuucaaauaccgccaucugaaggaugacgaggagacagguuauagaaggaucauugaacggcuuaauucuaaaaagggcaagaaucgacuguuggauggggagcgccucgcugacagaaaaaucgccgaacuguucagcacgaagacccacaucgga

SEQ ID NO: 10819 - RNA, 1932 nt, Artificial Sequence
  derived and/or modified CDS sequence (opt3) from CCHFV(4701-ST-2009)__KR814872.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucaucaaguggaaaguugaauacauaaagacagaggccaucgugugcgucgaacugacuagccaggagaggcaguguagucucauugaagcagggacccgguuuaauuuaggacccgugacaaucacccugucugagccucgcaacauucaacagaaacuuccacccgagaucauaacguugcacccuaagauugaagaggguuucuuugaucugaugcaugugcagaagguccuauccgccagcacuguuugcaaacuccagucgugcacacacggcaucccaggggaccugcaaauuuaucacaucggaaaucuucugaagggcgauagagugaacggucauuugauccacaaaauugaaccgcauuucaauaccucuuggauguccugggacgggugugaucucgacuacuauugcaacaugggagacuggcccucauguacuuacacaggcguaacccagcacaaucacgcugcauuugugaaccuguuaaauauagagacggauuauaccaagacauuccauuuucacaguaaaagggucacugcccauggcgacaccccucagcuggaucucaaggcucggccaacauacggggccggagaaaucacugugcuuguugagguggcggacauggagcugcacaccaaaaaggucgaaauuagcgguuugaaguucgcaucccuaacaugcaccggcuguuacgccugcucuagcgggaucucauguaaagugcgcauacauguagaugagcccgacgaacugacuguucacgugaagaguuccgauccugacgucguggcugccagcacgucucucauggcacgaaaacuggaguuuggaacagauucaaccuucaaggcuuucagugccaugccaaaaacuagccuuugcuuuuauauugucgaaagagaguacuguaaguccugcucugaggacgauaccaagaaauguguggacacaaagcuggaacagccccaaucgaucuugaucgagcacaaaggcaccauuaucgguaagcagaacgacacuugcacagcgaaagccagcugcuggcucgaauccguuaagucauucuuuuaugggcugaagaacauguuaggcaguguguucggaggcuuuuucguagggauucugcuauuucucgcaccguucguccugcuuguguuguuuuucauguuuggauggaaaauacuguucuguuuuaagugcuguaggcggacgcguggucucuucaaauaccgccaucugaaggaugacgaggagaccggcuauagaaggaucauugaacggcuuaauucuaaaaaggggaagaaccgacuguuggauggagagcgccucgcugacagaaaaaucgccgaacuguucagcacuaagacacacaucggc

SEQ ID NO: 10820 - RNA, 1932 nt, Artificial Sequence
  derived and/or modified CDS sequence (opt3) from CCHFV(Oman-199809166)__KR864901.1__Gc
uuccuggacagcaucgccaagggcaugaaaaaccuccuuaauuccaccucucuggagacaucauugaguauugaagcucccuggggagcaauaaacgugcagagcacuuuuaagccuacggucuccaccgccaauaucgcguuaucuuggucgucaguugagcacagagggaacaaaauucuggugagcgguaggagugaauccaucaugaagcuagaggaacggacaggcauuucuugggaucucgggguagaggacgcuagcgaguccaaacugcuuacugugucagucauggaucugagucaaauguacagcccaguguucgaauauuugucuggagaccgccagguugaggaauggccgaaggcuaccugcacaggcgauugucccgagcgaugcgguuguaccuccucaacuugccuccauaaggaguggccucacagccguaauuggagauguaacccaacauggugcuggggaguggggaccggcuguacgugcuguggccuggacgucaaagaucuguuuacugacuacauguucgugaaguggaaaguagaauauaucaagaccgaggcaauaguuugcguggaacucacaagucaggagaggcaguguucuuuaaucgaagccgggacucgguuuaaucugggacccgucaccauuacacuuuccgagccucgcaacauccaacagaaauugccacccgagauugugacccugcauccuagaaucgaagaggguuucuuugaucuaaugcacgugcagaagguccucagcgcuucgacgguuugcaagcugcagucuugcacucauggcgugccaggggaccuucaaguauaccacauaggaaaucuguugaaaggcgauaaggugaacggucaccucauucauaaagucgaaccgcacuucaauacauccuggaugucaugggacgggugugaucuggacuauuacugcaacaugggagacuggcccaguuguaccuauacuggcgugacacagcauaaucacgcagccuuuguuaacuuacugaauaucgagaccgauuacacgaagaacuuccacuuucauagcaaaagggugaccgcucacggcgacacaccucagcucgaucuuaaggcccggccaaacuacggggcgggagaaauuacuguccugguggagguagcagacauggaguugcauaccaaaaagaucgaaaucuccggucuaaaguucgccucucugacaugcacuggcuguuaugcuugcagcucagggauuaguuguaaaguucgcauacacguggaugagcccgacgaacucaccguccaugugaaguccgaggauccugacaucgucgccgcaucuagcucacugauggcucgaaaacuugaauuuggaacagauaguaccuucaaggccuucagcgcgaugccaaaaacuucccugugcuuuuacauuguggagagagaguauuguaagucuugcucgaaggaagacacgcagaaauguguuaaugccaaguuggagaggccccaaagcauccucauagaacacaaaggcacaauuaucgguaagcagaacgauaccugcacugcaaaagccuccugcuggcuggagucagugaagaguuucuuuuacggguuaaagaauaugcugucuggcaucuucggaaacguauuuauuggcaucuuccuauuucucgccccguucauucugcuuauauuguuuuucauguuuggguggcggauccuguucuguuuuaaaugcugucgucgcaccagaggacucuucaaguauaggcaccugaaagacgacgaggaaacagguuaccggaagauuaucgagcgacuuaauaacaaaaagggcaagaauaaacuguuggauggggaacgccucgcugacagaaagaucgccgagcuguucagcaccaaaacucauauugga

SEQ ID NO: 10821 - RNA, 1932 nt, Artificial Sequence
  derived and/or modified CDS sequence (opt3) from CCHFV(200406546-Turkey)__KR864902.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaauugagcacagagggaacaaaauccuggugacagguaggagcgaaaguauuaugaagcuagaggaacggacuggcguauccugggaucucgggguggaggacgcgucugagagcaaacugcuuaccgucuccaucauggaucugucacaaauguacaguccaguguucgaauauuugagcggagaccgccagguugaggaauggccgaaggcuacaugcaccggcgauugucccgagcgaugcgguuguacuucuuccacaugccuccauaaggaguggccucacucacguaauuggagauguaacccaaccuggugcuggggaguggggacgggcuguacuugcuguggcgucgacgugaaagaucuguuuaccgaccauauguucguaaaguggaaaguugaauacauaaagacagaggccaucgugugcgucgaacugacuagccaggagaggcaguguagucucauugaagcagggacccgguuuaauuuaggacccgugacaaucacccugucugagccucgcaacauucaacagaaacuuccacccgagaucauaacguugcacccuaagguggaagaggguuucuuugaucugaugcauguccagaagguucuauccgccagcacugugugcaaacuccagucgugcacacacggcauuccaggggaccugcaaguauaucacaucggaaaucuucugaagggcgauagagugaacggucauuugauucacaaaaucgaaccgcauuucaauaccucuuggauguccugggacgggugugaucucgacuacuauugcaacaugggagacuggcccucauguacuuacacaggcgucacccagcacaaucacgcugcauuugugaaccuguuaaauaucgagacggauuauaccaagacauuccauuuucacaguaaaaggguuacugcccauggcgacaccccucagcuggaucucaaggcucggccaacauacggggccggagaaauuacugugcuugucgagguggcggacauggagcugcacaccaaaaagguagaaauaagcgguuugaaguucgcaucccuagccugcacaggcuguuacgcuugcucuagcgggaucucauguaaaguucgcauucauguggaugagcccgacgaacugaccguccacgugaagaguuccgauccugacgucguggccgcaagcacuucucucacggcucgaaaacuggaguuuggaacagauucaaccuucaaggccuucagugcgaugccaaaaacuagccuuugcuuuuauaucguugaaaaggaguacuguaaguccugcaacgaggacgauacccagaaauguguggacacaaagcuggaacaaccccagucuauauugauugagcacaaaggcaccaucaucgguaagcagaacgacacuugcacagccaaagcaucgugcuggcucgaaagcguaaaguccuucuuuuaugggcugaagaauauguuaggcucagucuucggaaacuuuuucauuggcauccugcuauuucucgcuccguucgugcugcuuguuuuguuuuucauguuuggguggaaaauucuguucuguuuuaagugcuguagaaggacgcggggacucuucaaauaccgucaucugaaggaugacgaggagaccgguuauaaacgcauaaucgaaagacuuaauaacaagaagggcaaaaauaggcuguuggauggggagcggcucgccgaccgaaagauugcugaacuguucaguacuaaaacacacaucgga

SEQ ID NO: 10822 - RNA, 1932 nt, Artificial Sequence
  derived and/or modified CDS sequence (opt3) from CCHFV(1-CR/HU-2015)__KU161584.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucguuaaguggaaaguggaauacaucaagacagaggccauagucugcguggaacugacuagccaggagaggcaguguagucucaucgaagcagggacccgguuuaauuuaggacccgugacaauuacccugucugagccucgcaacauccaacagaaacuuccacccgagauuaucacguugcacccuaagauagaagaggguuucuuugaucugaugcauguccagaagguucuauccgccagcacugugugcaaacuccagucgugcacacacggcauuccaggggaccugcaaguauaucacaucggaaaucuucugaagggcgauagagugaacggucauuugauucacaaaaucgaaccgcauuucaauaccucuuggauguccugggacgggugugaucucgacuacuauugcaacaugggagacuggcccucauguacuuacacaggcgucacccagcacaaucacgcugcauuugugaaccuguuaaauaucgagacggauuauaccaagacauuccauuuucacaguaaaaggguuacugcccauggcgacaccccucagcuggaucucaaggcucggccaacauacggggccggagaaauuacugugcuugucgagguggcggacauggagcugcacaccaaaaagguagaaauaagcgguuugaaguucgcaucccuagccugcacaggcuguuacgcuugcucuagcgggaucucauguaaaguucgcauucauguggaugagcccgacgaacugaccguccacgugaagaguuccgauccugacgucguggccgcaagcacuucucucauggcucgaaaacuggaguuuggaacggauucaacauucaaggccuucagugcgaugccaaaaaccagccuuugcuuuuauaucguugaaagagaguacuguaaguccugcucugaggacgauacuaagaaauguguggacaccaagcuggaacagccccaaucgauauugauugagcacaaaggcacaaucaucgguaagcagaacgauaccugcacugccaaagcaagcugcuggcucgaauccguaaagucauucuuuuaugggcugaagaacauguuaggcagugucuucggaaacuuuuucauuggcauccugcuauuucucgcuccguucgugcugcuuguuuuguuuuucauguuuggguggaaaauucuguucuguuuuaagugcuguaggcggacacguggacucuucaaauaccgccaucugaaggacgacgaggagacggguuauagaaggauaaucgaacggcuuaauaauaaaaagggcaagaaccgacuguuggauggggagcgccucgccgacagaaaaauugcugaacuguucucuaccaagacucacaucgga

SEQ ID NO: 10823 - RNA, 1932 nt, Artificial Sequence
  derived and/or modified CDS sequence (opt3) from CCHFV(Gaib)__KX013445.1__Gc
uucagcgacuccaucgugaagggcaugaaaaaccugcucaauucuaccucacuugagacaagucugagcauugaagcccccuggggagcuauaaacguccaguccacuuuuaagccuacgguuucuaccgcaaauaucgccuugucguggucaagcauugagcacagagggaacaaaaucuuagugagugguagguccgaaucuauuaugaagcuggaggaacggacaggcaucagcugggaucuagggguagaggacgcguccgagucacgccuccugacugugagugucauggaucuuagccaaauguacucuccaguguucgaauaucuguccggagaccgacagguugaggaauggccgaaagcuaccugcacaggcgauugucccgagcguugcgguuguaccucaagcacuugcuugcauaaggaguggccucacaguagaaauuggagguguaacccaacauggugcuggggaguggggaccggcuguacgugcuguggccucgacgucaaggaucuguuuacugacuacauguucgugaaauggaagguagaauauauaaaaaccgaggccaucguuugcguggaacugacaucucaggagcggcaguguucccucauugaagcagggacucgcuuuaauuuaggacccgucaccaucacacugagcgagccuagaaacauucaacagaaacuuccacccgagaucauaaccuugcauccuaggauugaagaggguuucuuugaucugaugcacgugcagaaagugcuaucggccucuacggucugcaagcuccaguccugcacucauggcguuccaggggaccugcaaguguaccacaucggaaaucuucugaagggcgauaaaguaaacggucacuugauucauaagaucgaaccgcacuucaauacaucauggaugaguugggacgggugugaucucgacuauuacugcaacaugggagacuggcccagcuguaccuauacuggcgugacacagcauaaucacgcugcauuugucaaccuguuaaauaucgagaccgauuacacgaaaaacuuccacuuucauuccaagcgggugaccgcccacggcgacacaccucagcuggaucucaaagcucgcccaacuuacggggccggagaaauuaccguucuuguggaggucgcggacauggagcugcauacaaagaaaauagaaaucucugguuugaaguucgcaagccuaacuugcaccggcuguuaugccugcucaagugggauuuccuguaaggugcgaauccacguagaugagcccgacgaacugacaguucaugugaaaagcgaggauccugacauagucgcugccucuucaagucucauggcaagaaagcuggaauuuggaaccgauagcacuuucaaggcuuucuccgccaugccaaagacgucucuuugcuuuuacauuguggagagggaguauuguaaaucgugcagccgggaagacacacagaagugugucuccaccaagcuggagcaaccccagucaaucuugaucgaacacaaaggcacuauuaucgguaagcagaacaauaccugcacaaccaaaacuacaugcuggcucgagagugugaagucuuucuuuuacgggcugaaaaacauguuaagcuccauuuucggcaauguuuuugugggaauauucucauuucuggcgccguucauccuacucauucuguuuuucauguuuggcuggcguauccuuuucuguuuuaagugcugucgcagaacgaggggguuguucaaguaucggcaccugaaagaugacgaggaaaccggauaccgacgcaucauugagagacucaacaauaagaaagguaagagcaaacugcuugacggcgaaaggcuggccgaucggaagauagcagaguuguucucuacuaagacacauaucggg

SEQ ID NO: 10824 - RNA, 1932 nt, Artificial Sequence
  derived and/or modified CDS sequence (opt3) from CCHFV(Hodzha)__KX013448.1__Gc
uuccuggacagcaucgugaagggcaaaaagaaccuccuuaauuccaccucucuggagacaucauugaguauugaagcccccuggggugcuauaaacguccagagcacuuacaaaccuacgguuuccaccgcaaauaucgccuuaucuuggucgucaguggagcacagaggaaacaagauucugguaagcgguaggagugaauccaucaugaaacuagaggaacggacaggcauuucuugggaucucgggguggaggacgcgagcgaguccaagcugcuuacugucucagugauggaucugagucaaauguauagcccaguuuuugaauacuugucuggagaccgccagguggaggaauggccgaaggcuaccugcacaggcgauuguuccgagcgaugcgguuguaccucaagcacuugccuccauaaagaguggccccacagucguaauuggagauguaacccuacauggugcuggggagucgggaccggcuguacgugcuguggccuggacgugaaggaucuguucacugacuauauguuuguaaaauggaagguugauuacaucaaaaccgaagccauagugugcgucgagcucacaucucaggaaaggcaguguuccuuaguggaggcagggacucgguucaaucugggaccagugaccaucacacuuagcgaaccccgcaacauucaacagaaguugccuccagagaucauuacccugcaucccagaaucgaggaaggguuuuucgaccuaaugcacguccagaagguucucucggccucuacggugugcaaacugcaguccugcacucauggcguaccuggggaucuucaaguguaucacauaggaaaucuguugaagggcgacaaagucaacggucaccucauucauaagaucgagccacacuuuaauacaucauggaugaguugggaugggugugaccuggacuacuauugcaacaugggagauuggccgagcuguaccuacacuggcgugacacagcauaaucacgcuuccuucguuaacuuacugaauauugaaaccgacuacacgaaaucuuuucacuuccauagcaagagggugaccgcacacggcgauacaccccagcucgaccuuaaagcccggccuacuuauggggcuggagagaucaccguccugguggaaguagccgauauggaguugcauacaaagaagaucgagauuacuggucuaaaauuugcgucacugaccugcacaggcuguuacgcaugcaguuccgggauaagcuguaagguucgcauccacguggacgaaccagaugagcucaccguccaugugaaaucugacgaucccgacgucguggccgcuucaaguagccugauggcccgaaaacuugaguucggaacugauuccacguuuaaagcauucucugcuaugccuaagacaucgcugugcuucuauauuguugaaagagaauacuguaagagcugcuccaaagaggacacccagaagugugugaacacuaaauuggagcaaccacagucaauccucauagaacagaagggcaccauuaucgguaaacaaaacaauacaugcaccgccaaggcgaguugcuggcuggagucuguaaagagcuuuuucuauggguuaaagaacaugcuguccggcaucuuuggaaaugucuucgugggcauuuuucuauuccucgcccccuuuauccugcuuauuuuguucuuuauguucggguggaggauacuguuuuguuucaagugcugucggcguacucgcggacucuuuaaauacaagcaccugaaagacgaugaagagacagguuauagaaggaucauugagcggcuuaacaauaagaagggcaaaaacaagcuguuggacggggaacgacucgcagaucgcagaaucgcugagcuguucucaacgaaaacccacaucgga

SEQ ID NO: 10825 - RNA, 1932 nt, Artificial Sequence
  derived and/or modified CDS sequence (opt3) from CCHFV(IbAn7620)__KX013451.1__Gc
uuccuggacagcaucgccaagggcaugaaaaacccccucaauuccaccucucuugagacaucacugaguauugaagcuccuuggggugcaauagaugugcagagcacuuacaagccaacggucuccaccgccaacaucgcguugucuuggucgucaguugagcacagaggaaauaaaauuuuagugagcgguaggagugaauccaucaugaagcuggaggaacggacaggcauuucuugggaccuagggguagaggaugcuagcgaguccaaacuccugacugugucagucauggaccuuagucagauguauagcccgguguuugaauaccugucuggagaucgccagguugaggaauggcccaaggcaaccugcacaggcgacuguccugagcgaugcgguuguaccuccucaacuugcuugcauaaggaguggccacacagccguaacuggagauguaaucccacauggugcuggggaguggggaccggcuguacgugcuguggccucgaugucaaagaccuguucacugauuauauguuugugaaguggaaaguagaauacaucaagaccgaggcaauaguuugcguggaacugacaagucaggagaggcaguguucucucaucgaagccgggacucgguucaacuuaggaccugucaccauuacacuguccgagccacgcaauauccaacagaaacuucccccugagauuaucaccuugcauccaagaauagaagagggguuuuucgaccugaugcacgugcagaaggugcuaagcgcuucgacggucugcaagcuccagucuugcacucauggcguuccgggggaucugcaaguguaucacauuggaaaccuucugaaaggcgacaagguaaauggucacuugauccauaaaauugaaccccacuuuaacacauccuggaugucaugggaugggugugaccucgacuacuauugcaauaugggagauuggccuaguuguaccuacacuggcgugacacagcauaaccacgccagcuucgucaaucuguuaaacaucgagaccgacuacacgaagaauuuucacuuccauuccaaaagggugaccgcccacggcgauacaccacagcuggaccucaaggcucggcccacuuauggggccggagaaaucaccguucuuguggaggucgcgaacauggagcugcauacaaagaagauugaaauaucugguuugaaguuugcaagccuaacuugcaccggcuguuacgccugcucaagugggaucuccuguaaagugcgcauucacguagaugagccugacgaacugacaguucaugugaaaagcgaugacccagaugucguggcugccucuucaagucucauggcacgaaaacuggaguucggaaccgacagcacuuuuaaggcuuucuccgccaugcccaaaacgucucuuugcuucuauaucgucgaaagagagcacuguaagucgugcagcgaggaagauacaaagaaaugugugaacaccaagcuggagcagccgcaauccauauugauugaacacaaaggcacuaucaucgguaagcaaaauucaaccugcacagcgaaagccaguugcuggcucgagucuguuaagagcuuuuucuacgggcugaagaacauguuauccggcauuuuuggaaauguguucaugggcaucuuucuguuccuagcaccuuuuauucuccugauacuuuucuuuauguucggguggaggaucuuguuuuguuucaaaugcugucggcguacccgcggacuguuuaaguauagacaucucaaagacgacgaggaaacugguuacaggcggauuaucgagcgacugaacaauaagaaaggcaagaacaagcuccuggauggggaacgcuuggcugacagaaggaucgccgagcuuuucucaacaaaaacgcacauugga

SEQ ID NO: 10826 - RNA, 1932 nt, Artificial Sequence
  derived and/or modified CDS sequence (opt3) from CCHFV(K128_76)__KX013454.1__Gc
uuccaggacagcaucgugaagggcaugaaaaaccugcucaauuccaccucucuugagacaucacugaguauugaggcccccuggggugcuauaaacguccaaagcacuuacaagccugcaguuuccgccgcgaauaucgcuuugucuuggucgucaguggagcacagaggaagcaaaauuuuaguaagugguagguccgaaucuaucaugaagcuggaggaacggacgggcauuagcugggaucuagggguggaggacgccuccgagucaaaacuccugaccgucagugugauggaucuuagccagauguauucuccaguuuuugaauaccuguccggagaccgccagguggaggaauggccgaaggcaacaugcacuggcgauugucccgagcgaugcgguuguaccucaagcacaugcuugcauaaggaguggccucacagucguaacuggagauguaauccaaccuggugcuggggagucgggacuggcuguacaugcuguggccucgacgugaaagaucuguucaccgacuauauguuuguaaaguggaaaguugaauacaucaagacggaggccauagugugcgucgaacugacuucucaggagaggcaauguucccucaucgaagcugggacccgguucaacuuaggacccgugacaauuacucugagcgagccucgcaauauccagcagaaacuuccacccgagauuaucaccuugcauccuagaauagaagagggguuuuucgaucugaugcacgugcagaagguccuaucggcaucuacaguuugcaagcuccaauccugcacccauggcgugccaggggaccugcagguauaucacauuggaaaccuucugaaaggcgauagggugaauggucacuugauccauaagauugaaccgcacuuuaacacgucauggaugaguugggacgggugugaucucgacuacuauugcaauaugggagacuggcccagcuguacuuacacaggcgucacccagcauaaccacgccuccuucgugaaucuguuaaacaucgagacugauuacacaaaaucuuuucacuuccauagcaagcggguuaccgcucacggcgacacgccucagcuggaucucaaagcccgcccaaauuauggggcgggagaaaucaccgugcuugucgagguggcagacauggagcugcauacaaagaaaauugaaauaucagguuugaaguuugccagucuaacuugcaccggcuguuacgcuugcuccagcgggaucucuuguaagguacgaauccacguugaugagcccgacgaacugacagugcaugucaaaucagaugacccugauguggucgccgcaaguagcucccucauggcuagaaagcuggaguucggaacugacucuaccuuuaaagccuucucggcgaugccaaagacaagccuuugcuucuauauuguggaaagggaguacuguaaauccugcucaaaggaggauacccaaaaguguguuaacacuaaacuggaacagccccagaguauauugauugagcacaagggcacgaucaucgguaaacaaaacaauacaugcaccgccaagacuucuugcuggcucgaaagcgugaaauccuuuuucuaugggcugaagaacauguuaucaggcauuuuuggaaauguauucgucggcaucuuucuguuccuagcaccguuuauucuccugauacuuuucuuuauguucggguggcggaucuuguuuuguuucaagugcugucgucgcaccagaggacuguuuagguacaaacaccucgagaacgacgaggaaacagguuaucggcgaauuaucgagcgccugaauaacaagaaaggcaagaauaaacuucuggacggggaaagauuggcugauaggcggaucgccgaacucuucagcaccaagacucauauugga

SEQ ID NO: 10827 - RNA, 1932 nt, Artificial Sequence
  derived and/or modified CDS sequence (opt3) from CCHFV(K168_40)__KX013457.1__Gc
uuccuggacggcaucgugaaggggaugaaaaaccuccuuaauagcaccucccuggagacaucuuugucaauugaagcccccuggggagcuauaaacguccagaguacuuacaagccuacgguuagcgcagccaauaucgcguuauccuggucuucgguggagcacagagguaacaaaauucugguaucaggcaggagcgaaaguaucaugaagcuagaggaacggaccgggauuuccugggaucucggaguggaggacgcuucugagagcaaacugcuuacagucuccgugauggaucugucacaaauguauaguccaguuuuugaauacuugagcggcgaccgccagguggaggaauggccgaaggccacuugcaccggugauugucccgagcgaugcggguguacaucuucuaccugccuccauaaggaguggccucacucacguaauuggagauguaacccaacuuggugcuggggagucggcacaggcuguaccugcugugggcuggacgugaaagaucuguucacggacuauauguuuguaaaguggaaaguugaauacaucaagacugaggcaauagugugcgucgaacucaccagccaggagaggcaguguaguuuaaucgaagccggaacacgguucaaucugggucccgugacuauuacccuuucugagccucgcaacauccaacagaaauugccacccgagauuaucacacugcauccuagaauagaagagggcuuuuucgaucuaaugcacgugcagaagguccucuccgcuagcaccguuugcaagcugcagucgugcacgcauggggugccaggagaccuucaaguauaucacauuggcaaucuguugaaaggugauaaggugaacgggcaccucauccauaaaauugaaccgcacuuuaauacuucuuggauguccugggacggaugugaucuggacuacuauugcaacaugggcgacuggcccucauguacauacaccggcgucacucagcauaaucacgcaaguuucaucaacuuacugaauaucgagacagauuacaccaagagcuuucacuuccauuccaaaagggugacggcccacggggacaccccucagcucgaucuuaaggcucggccaaacuauggagccggugaaauuacaguucugguggaggucgcggacauggaguugcauacuaaaaagauagaaaucucuggccuaaaguuugcaagccugaccugcacaggguguuacgccugcucaaguggaauuuccuguaaagugcgcauccacguagaugagcccgacgaacucacuguucaugucaagagcgaugacccugaugugguggcugccucuucaagucugauggcacgaaaacuugaguucggcaccgacagcacauuuaaggcuuucuccgccaugccaaaaaccucucugugcuucuauauagucgaaagagaguacuguaagucgugcagcaaggaggauacucagaaaugugugaacacgaaguuggaacacccccaauccauucucaucgagcacaaagguacaaucauugggaagcagaauaauaccugcacugcgaaaaccucaugcuggcuggaaaguguuaaguccuuuuucuauggcuuaaagaacaugcugagcggaaucuuuggcaacguguucguagggauuuuucuauuccucgccccguuuauacugcuuaucuuguucuuuauguucggauggaggauucuguuuuguuucaaaugcugucggcguacacgcggucucuuuagauacaagcaucuggaggacgacgaggaaaccggcuauaggcggaucaucgagcgacuuaauaacaaaaaggggaaaaauaagcuguuggauggagaacgccucgcagacagaaggauugcugagcuguucuccacuaagacacacauaggc

SEQ ID NO: 10828 - RNA, 1932 nt, Artificial Sequence
  derived and/or modified CDS sequence (opt3) from CCHFV(K168_125)__KX013460.1__Gc
uuccuggacagcaucgugaagggcaaaaagaaccuccuuaauuccaccucucuggagacaucauugaguauugaagcccccuggggugcuauaaacguccagagcacuuacaaaccuacgguuuccgcagccaauaucgcguuaucuuggucgucaguggagcacagaggaaacaagauucugguaagcgguaggagugaauccaucaugaaacuagaggaacggaccggcauuucuugggaucucgggguggaggacgcuagcgaguccaagcugcuuacagucucagugauggaucugagucaaauguauagcccaguuuuugaauacuugucuggagaccgccagguggaggaauggccgaaggccacuugcaccggcgauugucccgagcgaugcgguuguacauccucaaccugccuccauaaagaguggccucacagccguaauuggagauguaacccaacuuggugcuggggagucgggacaggcuguaccugcuguggccuggacgugaaggaucuguucacggacuauauguuuguaaaauggaagguugaauacaucaaaacugaggcaauagugugcgucgaacucaccagucaggagaggcaguguucuuuaaucgaagccgggacacgguucaaucugggacccgugacuauuacccuuuccgagccucgcaacauccaacagaaguugccacccgagauuaucacacugcauccuagaauagaagagggguuuuucgaucuaaugcacgugcagaagguccucagcgcuucgaccguuugcaaacugcagucuugcacgcauggcgugccaggggaccuucaaguauaucacauuggaaaucuguugaagggcgauaaagugaacggucaccucauccauaagauugaaccgcacuuuaauacuuccuggaugucaugggacgggugugaucuggacuacuauugcaacaugggagacuggcccaguuguacauacaccggcgucacucagcauaaucacgcuagcuucaucaacuuacugaauaucgagacagauuacaccaaauccuuucacuuccauucuaagagggugacggcccacggcgacaccccucagcucgaucuuaaagcucggccaaacuauggggccggagaaauuacaguucugguggaggucgcggacauggaguugcauacuaagaagauagaaaucagcggucuaaaauuugcaucacugaccugcacaggcuguuacgccugcaguuccgggauuagcuguaaggugcgcauccacguagaugagcccgacgaacucacuguucaugugaaaucugaugacccugaugucguggcugccucaaguagccugauggcacgaaaacuugaguucggaaccgacuccacauuuaaagcauucucugccaugccaaagaccucgcugugcuucuauauagucgaaagagaguacuguaagagcugcuccaaagaggauacucagaagugugugaacacgaaauuggaacacccccaaucaauucucaucgagcacaagggcacaaucauugguaaacagaauaauaccugcacugcgaagaccaguugcuggcuggaaucuguuaagagcuuuuucuauggguuaaagaacaugcuguccggcaucuuuggaaacguguucguaggcauuuuucuauuccucgccccguuuauacugcuuaucuuguucuuuauguucggguggaggauucuguuuuguuucaagugcugucggcguacacgcggacucuuuagauacaaacaucuggaggacgacgaggaaaccgguuauaggcggaucaucgagcgacuuaauaacaagaaaggcaagaauaagcuguuggauggggaacgccucgcagacagaaggauugcugagcuguucucaacuaaaacacacauagga

SEQ ID NO: 10829 - RNA, 1932 nt, Artificial Sequence
  derived and/or modified CDS sequence (opt3) from CCHFV(K229_194)__KX013463.1__Gc
uuccuggacagcaucgugaagggcaaaaagaaccuccuuaauuccaccucucuggagacaucauugaguauugaagcccccuggggagcuauaaacguccagagcacuuuuaaaccuacgguuuccaccgcaaauaucgccuuaucuuggucgucaguggagcacagagggaacaagauucugguaacagguaggagcgaaaguaucaugaaacuagaggaacggacuggcguguccugggaucucggggucgaggacgcgucugagagcaagcugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaagaguggccucacucacguaauuggagauguaacccaaccuggugcuggggagucgggacgggcuguacuugcuguggcguggacguaaaggaucuguuuaccgaccauauguucaucaaauggaagguugaauacauaaaaacagaggccaucgugugcgucgaacugacuagccaggagaggcaguguagucucauugaagcagggacccgguuuaauuuaggacccgugacaaucacccugucugagccucgcaacauucaacagaaacuuccacccgagaucauaacguugcacccuaagauugaagaggguuucuuugaucugaugcaugugcagaaaguccuauccgccagcacuguuugcaagcuccagucgugcacacacggcaucccaggggaccugcaaauuuaucacaucggaaaucuucugaaaggcgauagauugaacggucaucucauccacaagauugaaccgcauuucaauaccucuuggauguccugggacgggugugaucuggacuacuauugcaacaugggagacuggcccucauguacuuacacaggcgugacccagcacaaucacgcugcauuuguaaacuuacugaauauagagacggauuauaccaaaacauuccauuuucacaguaagagggugacugcccauggcgacaccccucagcucgaucuuaaagcucggccaacauacggggccggagaaaucacuguccugguggagguugcggacauggaguugcacaccaagaagguggaaauuagcggucuaaaauucgcaucccuggccugcacaggcuguuacucuugcagcucagggaucaguuguaagguccgcauacauguggaugagcccgacgaacucaccguacacguuaaauccagcgauccugacguggucgcugccucuacuucacugauggcacgaaaacuugaguuuggaacggauaguacauucaaggcuuucagcgccaugccaaagaccucccugugcuuuuauauuguggaaagagaguacuguaagucuugcucggaggacgauacuaaaaagugugucgacaccaaauuggaacagccccaaagcauccucaucgagcacaagggcacaauuaucgguaaacagaacgauaccugcacugcgaaggccuccugcuggcuggaaucagugaagaguuucuuuuauggguuaaagaacaugcugggcucuguuuucggaaacuuuuucgugggcauucuacucuuucuggcaccguucguacuuuugguccuguuuuucauguuuggguggaagauacucuucuguuuuaaaugcuguaggcggacacguggacuguucaaguaccgccaucuuaaagacgacgaggagacggguuauagaaagaucauugaaaggcugaauagcaagaaaggcaagaaucgguugcucgauggggagcgacuggcugaccgcaaaaucgccgaauuauucuccaccaagacucacaucgga

SEQ ID NO: 10830 - RNA, 1932 nt, Artificial Sequence
  derived and/or modified CDS sequence (opt3) from CCHFV(K229_243)__KX013466.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucguuaaguggaaaguggaauacaucaagacagaggccauagucugcguggaacugacuagccaggagaggcaguguagucucaucgaagcagggacccgguuuaauuuaggacccgugacaauuacccugucugagccucgcaacauccaacagaaacuuccacccgagauuaucacguugcacccuaaggucgaagaggguuucuuugaucugaugcauguucagaaggugcuauccgccagcacuguaugcaaacuccagucgugcacacacggcauaccaggggaccugcaaguguaucacauuggaaaucuucugaagggcgauagagucaacggucauuugauccacaaaauugaaccgcauuucaauaccucuuggauguccugggacgggugugaucucgacuacuauugcaacaugggagacuggcccucauguacuuacacaggcgugacccagcacaaucacgcugcauuuguuaaccuguuaaauaucgagacggauuauaccaagacauuccauuuucacaguaaaagggugacugcccauggcgacaccccucagcuggaucucaaggcucggccaacauacggggccggagaaaucacuguccuuguggagguagcggacauggagcugcacaccaaaaagguugaaauuagcgguuugaaguucgcaucccuagccugcacaggcuguuacgcuugcucuagcgggauaucauguaaagugcgcauccaugucgaugagcccgacgaacugaccgugcacgucaagaguuccgauccugacgugguugccgcaagcacuucucucauggcucgaaaacuggaguuuggaacggauucaacauucaaggccuucagugcgaugccaaaaaccagccuuugcuuuuauauuguggaaaaggaguacuguaaguccugcucugaggaagacacucagaaauguguagauaccaagcuggagcaaccccagucgaucuugauagaacacaaaggcacaauuaucgguaagcagaacgauaccugcacugccaaagcaagcugcuggcucgaguccgucaagucauucuuuuaugggcugaagaacauguuaggcaguguguucggaaacuuuuucaucggcauucugcuauuucucacaccguucguucugcuuguguuguuuuucauguuuggguggaaaauccuguucuguuuuaagugcuguagaaggacgcggggacuccugaaauaccgucaucuuaaggacgacgaggaaaccgguuaucgcagaauuauagagaggcugaauaauaaaaagggcaagaaccgguugcucgacggggaacgacuggcugaucgcaaaaucgccgaguuauucucuacuaagacacacauugga

SEQ ID NO: 10831 - RNA, 1932 nt, Artificial Sequence
  derived and/or modified CDS sequence (opt3) from CCHFV(K315_14)__KX013469.1__Gc
uuccuggacagcaucgugaagggcaugaaaaagcuccuuaacuccaccucucuggagacaucauugaguauugaagcccccuggggagcuauaaauguccagagcacuuuuaaaccuacgguuuccaccgcaaacaucgccuuaucuuggucgucaguggagcacagagggaauaagauucugguaacagguaggagcgaaaguaucaugaaacuagaggaacggacuggcguguccugggaucucggggucgaggacgcgucugagagcaagcugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaagaguggccucacucacguaacuggagauguaauccaaccuggugcuggggagucgggacgggcuguacuugcuguggcguggacguaaaggaucuguuuaccgaccauauguucaucaaauggaagguugaauacauaaaaacagaggccaucgugugcgucgaacugacuagccaggagaggcaguguagucucauugaagcagggacccgguuuaacuuaggacccgugacaaucacccugucugagccucgcaauauucaacagaaacuuccacccgagaucauaacguugcacccuaagauugaagaggguuucuuugaucugaugcaugugcagaaaguccuauccgccagcacuguuugcaagcuccagucgugcacacacggcaucccaggggaccugcaaauuuaucacaucggaaaccuucugaaaggcgauagagugaauggucauuugauccacaagauugaaccgcauuucaacaccucuuggauguccugggacgggugugaucucgacuacuauugcaauaugggagacuggcccucauguacuuacacaggcguaacccagcacaaccacgcugcauuugugaaucuguuaaacauagagacggauuauaccaaaacauuccauuuucacaguaagagggucacugcccauggcgacaccccucagcuggaucucaaagcucggccaacauacggggccggagaaaucacugugcuuguugagguggcggacauggagcugcacaccaagaaggucgaaauuagcgguuugaaauucgcaucccuaacaugcaccggcuguuacgccugcucuagcgggaucucauguaaggugcgcauacauguagaugagcccgacgaacugacuguucacgugaaaaguuccgauccugacgucguggcugccagcacgucucucauggcacgaaagcuggaguuuggaacagauucaaccuucaaggcuuucagugccaugccaaagacuagccuuugcuuuuauauugucgaaagagaguacuguaaguccugcucugaggacgauaccaaaaaguguguggacacaaaacuggaacagccccaaucgaucuugaucgagcacaagggcaccauuaucgguaaacagaaugacacuugcacagcgaaggccagcugcuggcucgaauccguuaagucauucuuuuaugggcugaaaaacauguuaggcaguguguucggaucuuucuuuguaggcauucugcuauuucucgcaccguucguccugcuuguguuguuuuucauguuuggguggaagauacuguucuguuuuaaaugcuguaggcggacgcguggacucuucaaguaccgccaucugaaagaugacgaggagaccgguuauagaaggaucauugaacggcuuaacagcaagaagggcaaaaaucgacuguuggauggggagcgccucgcugacagaaagaucgccgaacuguucuccacuaaaacacacaucgga

SEQ ID NO: 10832 - RNA, 1932 nt, Artificial Sequence
  derived and/or modified CDS sequence (opt3) from CCHFV(K323_27)__KX013472.1__Gc
uuccuggacagcaucgccaagggcaugaaaaaccuccuuaauuccaccucucuggagacaucauugaguauugaagcucccuggggagcaauaaacgugcagagcacuuuuaagccuacggucuccaccgccaauaucgcguuaucuuggucgucaguugagcacagagggaacaaaauucuggugacagguaggagcgaaaguaucaugaagcuagaggaacggacuggcguauccugggaucucgggguggaggacgcuucugagagcaaacugcuuaccgucuccauuauggaucugucacaaauguacaguccaguguucgaauauuugagcggagaccgccagguugaggaauggccgaaggccacaugcaccggcgauugucccgagcgaugcgguuguacuucuuccacaugccuccauaaggaguggccucacucacguaauuggagauguaacccaaccuggugcuggggaguggggacgggcuguacuugcuguggcgucgacgugaaagaucuguuuaccgaccauauguucaucaaguggaaaguagaauacauaaagacagaggcaaucguuugcguggaacugacugggcaggagaggcaguguagccucauugaagccggaacccgguuuaauuuaggucccgucacaaucacccugagugagccucgcaacauucaacagaaacuuccacccgagaucauaacguugcacccuaagauugaagagggcuucuuugaucugaugcaugugcagaaggugcuaucugcuuccacugucugcaaacuccagagcugcacacacgggaucccaggagaccugcaaauuuaucacaucggcaaucuucugaagggugauagaguuaacgggcauuugauccacaaaauugaaccgcauuucaauaccucguggaugucuugggacggaugugaucucgacuacuauugcaacaugggcgacuggcccuccuguacuuacacaggcgugacccagcacaaucacgcagccuuuguaaaccuguuaaauauagagacggauuauaccaagacauuccauuuucacucaaaaagggugacugcucauggggacaccccucagcuggaucucaaggcccggccaacauacggagcgggugaaaucacuguccuuguggagguugcagacauggagcugcacaccaaaaagguggaaauuaguggcuugaaguucgccagccuaacaugcaccggguguuacgcuugcuccucuggaaucagcuguaaaguccgcauacauguggaugagcccgacgaacugacuguacacguuaagucaagugauccugacguggucgccgcauccacgagccucauggcucgaaaacuggaguuuggcacagauucuaccuucaaggccuucucagcgaugccaaaaaccagucuuugcuuuuauauuguggaaagagaguacuguaagagcugcuccgaggacgauacuaagaaaugugucgacacaaagcuggaacagccccaaucuaucuugaucgagcacaaagguaccauuaucgggaagcagaacgacacuugcacagccaaagcaucgugcuggcucgaaagcgugaaguccuucuuuuauggccugaagaacauguuaggaucaguuuucggcaguuucuuuguggggauucugcuauuucucgcuccguucguacugcuugucuuguuuuucauguuuggauggaaaauacuguucuguuuuaagugcuguaggcggacgcguggucucuucaaauaccgccaucugaaugaugacgaggagaccggcuauagaaggaucauugaacggcuuaacucuaagaaagggaagaaucgacuguuggauggagagcgccucgccgacagaaagaucgcugaacuguucagcacuaaaacacacaucggc

SEQ ID NO: 10833 - RNA, 1932 nt, Artificial Sequence
  derived and/or modified CDS sequence (opt3) from CCHFV(K340_6)__KX013475.1__Gc
agccuggacuccaucgugaagggcaugaaaaaccuccuuaauucuaccucacuggagacaaguuugagcauugaagcccccuggggagcuauaaacguccaguccacuuucaagccuacgguuucuaccgcaaauaucgccuuaucguggucaagcguggagcacagaggaaacaaaauucugguaacagguaggagugaauccaucaugaagcuagaggaacggacuggcgugucuugggaucucggggucgaggacgcgagcgaguccaaacugcuuaccgugucaauuauggaucugagucaaauguacagcccaguuuuugaauauuugucuggagaccgccagguggaggaauggccgaaggcuacaugcaccggcgauugucccgagcgaugcgguuguacuuccucaacaugccuccauaaggaguggccucacagccguaauuggagauguaacccaaccuggugcuggggugucggaacgggcuguacuugcuguggcguggacguaaaagaucuguucaccgaccauauguuuaucaaguggaaaguugaauacauaaagacagaggccaucgugugcgucgaacugacaagucaggagaggcaguguucucucauugaagcagggacccgguucaauuuaggacccgugacaaucacccuguccgagccucgcaacauucaacagaaacuuccacccgagaucauaacguugcacccuaagauugaagagggguuuuucgaucugaugcaugugcagaagguccuaagcgccucgacuguuugcaaacuccagucuugcacacacggcaucccaggggaccugcaaauuuaucacaucggaaaucuucugaagggcgauagagugaacggucauuugauccacaaaauugaaccgcauuuuaauaccuccuggaugucaugggacgggugugaucucgacuacuauugcaacaugggagacuggcccaguuguacuuacacaggcguaacccagcacaaucacgcugcauucgugaaccuguuaaauauagagacggauuauaccaagacauuucauuuccacagcaaaagggucacugcccauggcgacaccccucagcuggaucucaaggcucggccaacauacggggccggagaaaucacugugcuuguugaggugaccgacauggagcugcacacuaaaaaggucgaaauuuccgguuugaaguuugcgucucuaaccugcacuggcuguuacgcaugcagcucagggaucaguuguaaagugcgcauacauguagaugagcccgacgaacugacgguucacgugaaguccagcgauccugacgucguggccgcuucuacaucacucauggcccgaaaacuggaguucggaaccgauaguacuuuuaaggcauucagcgcuaugccaaaaaccucccuuugcuucuauauugucgaaagagaguacuguaagucuugcucggaggacgauacaaagaaauguguggacaccaagcuggaacagccccaaagcaucuugaucgagcacaaaggcacuauuaucgguaagcagaacgacacaugcacggccaaagcguccugcuggcucgaaucaguuaaguccuuuuucuaugggcugaagaacauguuaggcucuguguuugggagcuucuuuguaggcauucugcuauuccucgccccguuuguccugcuuguguuguucuuuauguucggguggaaaauacuguuuuguuucaagugcuguaggcggacccguggacucuuuaaauaccgccauuucaaggaugacgaggagacugguuauagaaggaucauugaacggcugaauaguaaaaagggcaagaaccgacuucuggauggggagcgcuuggcagacagaaaaaucgcugaacucuucucaacaaagacccacaucgga

SEQ ID NO: 10834 - RNA, 1932 nt, Artificial Sequence
  derived and/or modified CDS sequence (opt3) from CCHFV(Mamon)__KX013478.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucguuaaguggaaaguggaauacaucaagacagaggccauagucugcguggaacugacuagccaggagaggcaguguagucucaucgaagcagggacccgguuuaauuuaggacccgugacaauuacccugucugagccucgcaacauccaacagaaacuuccacccgagauuaucacguugcacccuaaggucgaagaggguuucuuugaucugaugcauguucagaaggugcuauccgccagcacuguaugcaaacuccagucgugcacacacggcauaccaggggaccugcaaguguaucacauuggaaaucuucugaagggcgauagagucaacggucauuugauccacaaaauugaaccgcauuucaauaccucuuggauguccugggacgggugugaucucgacuacuauugcaacaugggagacuggcccucauguacuuacacaggcgugacccagcacaaucacgcugcauuuguuaaccuguuaaauaucgagacggauuauaccaagacauuccauuuucacaguaaaagggugacugcccauggcgacaccccucagcuggaucucaaggcucggccaacauacggggccggagaaaucacuguccuuguggagguagcggacauggagcugcacaccaaaaagguugaaauuagcgguuugaaguucgcaucccuagccugcacaggcuguuacgcuugcucuagcgggauaucauguaaagugcgcauccaugucgaugagcccgacgaacugaccgugcacgucaagaguuccgauccugacgugguugccgcaagcacuucucucauggcucgaaaacuggaguuuggaacggauucaacauucaaggccuucagugcgaugccaaaaaccagccuuugcuuuuauauuguggaaagagaguacuguaaguccugcucugaggaagacacucagaaguguguagauaccaaacuggagcaaccccagucgaucuugauagaacacaagggcacaauuaucgguaaacagaacgauaccugcacugccaagacaagcugcuggcucgaguccgucaaaucauucuuuuaugggcugaagaacauguuaggcaguguguucggaaacuuuuucaucggcauucugcuauuucucgcaccguucguucugcuuguguuguuuuucauguuuggguggaagauccuguucuguuuuaaaugcuguaggcggacgcguggacuccugaaguaccgccaucuuaaagacgacgaggaaaccgguuauagaaggauuauagagcggcugaauaauaagaaaggcaagaaccgauugcucgacggggaacgccuggcugauagaaagaucgccgaguuauucucuacuaaaacacacauugga

SEQ ID NO: 10835 - RNA, 1932 nt, Artificial Sequence
  derived and/or modified CDS sequence (opt3) from CCHFV(Min)__KX013481.1__Gc
uuccuggacagcaucgugaagggcaccaaaaaccuccuuaauuccacaucucuggagacuucauugaguauugaagcccccuggggagcuauaaacguccagagcacguuuaagccuaccguuuccacagcaaauaucgccuuaucuuggucgucaguggagcacagagggaacaaaauucugguaacugguaggagcgaaaguaucaugaagcuagaggaacggaccggcguguccugggaucucggggucgaggacgcgucugagagcaaacugcuuacaguguccauuauggaucugucacaaauguacaguccaguuuucgaauauuugagcggagaccgccagguggaggaauggccgaaggcuaccugcacuggcgauugucccgagcgaugcgguuguacaucuuccacaugccuccauaaggaguggccucacucacguaauuggagauguaacccaacguggugcuggggagucgggacuggcuguaccugcuguggcguggacguaaaagaucuguuuacagaccauauguucguuaaguggaaaguggaauacaucaagacugaggccauagucugcguggaacugaccagccaggagaggcaguguagucucaucgaagcagggacacgguuuaauuuaggacccgugaccauuacgcugucugagccucgcaacauccaacagaaacuuccacccgagauuaucacuuugcacccuaaggucgaagaggguuucuuugaucugaugcauguucagaaggugcuauccgccagcacaguaugcaaacuccagucgugcacccacggcauaccaggggaccugcaaguguaucacauuggaaaucuucugaagggcgauagaaucaacggucauuugauucacaaaaucgaaccgcauuucaauacuucuuggauguccugggacgggugugaucucgacuacuauugcaacaugggagacuggcccucauguacauacaccggcgucacgcagcacaaucacgcugcauuugugaaccuguuaaauaucgagaccgauuauacaaagacuuuccauuuucacaguaaaaggguuaccgcccauggcgacacaccucagcuggaucucaaggcucggccaacuuacggggccggagaaauuaccgugcuugucgagguggcggacauggagcugcacaccaaaaagguagaaauaagcgguuugaaguucgcaucccuagccugcaccggcuguuacgcuugcucuagcgggaucucauguaaaguucgcauucauguggaugagcccgacgaacugacuguccacgugaagaguuccgauccugacgucguggccgcaagcacgucucucauggcucgaaaacuggaguuuggaacagauucaaccuucaaggccuucagugcgaugccaaaaacuagccuuugcuuuuauaucguugaaagagaguacuguaaguccugcucugaggaagacacccagaaguguguggauacaaaacuggagcaaccccagucgauauugauugaacacaagggcaccaucaucgguaaacagaacgacacuugcacagccaaggcaagcugcuggcucgaguccguaaaaucauucuuuuaugggcugaagaacauguuaggcagugucuucggaaacuuuuucauuggcauccugcuauuucucgcuccguucgugcugcuuguuuuguuuuucauguuuggguggaagauucuguucuguuuuaaaugcuguaggcggacgcguggacuccugaaguaccgccaucuuaaagacgaugaggaaaccgguuauagaaggauaaucgagcggcugaauaauaagaaaggcaagaaccgauugcucgacggggaacgccuggccgauagaaagauugcugaguuauucucuacuaaaacacacaucgga

SEQ ID NO: 10836 - RNA, 1932 nt, Artificial Sequence
  derived and/or modified CDS sequence (opt3) from CCHFV(Nakiwogo)__KX013484.1__Gc
uaccuggacagcaucgccaagggcaugaaaucccuccuuaacucuaccaaucuggagacaucauugaguauugaagcucccuggggagcaauaaacgugcagagcacuuucaagccuacggucuccgccgcgaauaucgcuuuaucuuggucgucaguugagcacagagggaacaaaauucuggugagcgguaggagugaauccaucaugaagcuagaggaacggaccggcauuucuuggagccucgggguagaggaugccuccgagucaaaaacacugacugugagugucauggaccuuagccaaauguauucuccaguguuugaauaccuguccggagaucgccagguugaggaauggccgaaggcaaccugcacaggcgacugucccgagcgaugcgguuguaccucaagcacuugcuugcauaaggaguggccucacagucguaauuggagauguaacccaacauggugcuggggaguggggaccggcuguacgugcuguggccucgaugucagggaccuguucacugauuauaugauggugaaauggaagguagaauacguuaaaaccgaggccaucaugugcguggaacugacaucucaggagcggcaguguucccucauagaagcugggacucgcuuuaauuuaggacccgucaccaucacacugagcgagccuagaaacgugcaacagaggcuuccaucggagauugugaccuugcaucccaagaucgaagaggguuucuuugaccugaugcacguccagaaaguucuauucugcaagcauucucuccaggcaacguccugcacucacggcgugccuggggaucugcaaguauaucacgugggaaaucuucugaagggcgacaaagucaacggucauucaauucacaagaucgaaagucauuuuaauacaagcuggauguccugggaugggugugacuuggauuacuucugcaacaugggagacuggccaucuuguaccuauacuggcgugacacagcacaaucgggccgcuuuuguuaacaugcucaauauagagaccgacuacacgaaaaccuuccacuuucauagcaagcgcgugacagcccacggcgauacuccgcagcuggacuuaaaagcgcgacccaccuacggggcaggagaagucacagugcugguagagguugccgaucucgagcuucauacuaagaaaauugaagugucaggucugaaguucgcuaguuugaccugcuccggcuguuaugccugcagcucugggaucucauguaaggucaggauucacgugaacgagccugacgaauuuacaguccaugugaaaaguaacgauccagacguuguggcagcuggaagcucccuaauggccagaaagaucgagcugggcgcggauucuaccuucaaagccuucucgagcaugcccaaaaauucccucugcuuuuacaucguagaacgggacuauuguucaaguugcacugaugacgauacgcagaagugugucaacacaaagcuggagcacccucaaucuauucuuauagagcacaaggguaccaucauugggaaacagaaugacacuugcccaaccaagacaagcugcuggcuggaauccgugaaaucauucuuuuacggcuugaagaacaugcucggaggcaucuucgggaauguuuuucugggaauauucuuauuucuggcacccuucgcucuacucauucuguuuuucuuuuucgguuggcgucuuuuguuuugucugaaaugcugucgcagaaccaggggccuccugaaguauaagcagcuuaaagacgaggaagaggccggguacaagaaaaucaucgagcggcugaacgauaagaaaggaaagagccgauuguucgacggcgaacgccucgcugauagaaagauugccgagcuguucucuacuaaaacacauaucggu

SEQ ID NO: 10837 - RNA, 1932 nt, Artificial Sequence
  derived and/or modified CDS sequence (opt3) from CCHFV(Saf)__KX013487.1__Gc
uucagcgacuccaucgugaagggcaugaaaaaccugcucaauucuaccucacuugagacaagucugagcauugaagcccccuggggagcuauaaacguccaguccacuuuuaagccuacgguuucuaccgcaaauaucgccuugucguggucaagcguggagcacagagggaacaaaauuuuaguaacagguaggagugaauccaucaugaagcuggaggaacggacuggcgugucuugggaucuaggggucgaggacgcgagcgaguccaaacuccugaccgugucaauuauggaucuuagucaaauguacagcccaguuuucgaauaucugucuggagaccgccagguggaggaauggccgaaggcuacaugcaccggcgauugucccgagcgaugcgguuguacuuccucaacaugcuugcauaaggaguggccucacagccguaauuggagauguaacccaaccuggugcuggggagucgggacgggcuguacuugcuguggcguggacguaaaagaucucuuuaccgaccauauguucguuaaguggaaaguggaauacaucaagacagaggccauagucugcguggaacugaccagucaggagaggcaguguucucugaucgaagcagggacucgguuuaaucucggacccgugacaauuaccuuauccgagccucgcaacauccaacagaaacugccacccgagauuaucacgcuucacccuaaggucgaagaggguuucuuugauuugaugcauguucagaaggugcugagcgccucgacuguaugcaaacuacagucuugcacacacggcauaccaggggaccuccaaguguaucacauuggaaaucugcuuaagggcgauagagucaacggucaucugauccacaaaauugaaccgcauuucaauaccuccuggaugucaugggacgggugugauuuggacuacuauugcaacaugggagacuggcccaguuguacuuacacaggcgugacccagcacaaucacgcugcauuuguuaaccuccugaauaucgagacggauuauaugaagaccuuccauuuucacagcaaaagggugacagcccauggcgacacuccucaguuagaucugaaggcucggccaaccuacggggccggagaaaucacaguccucguggagguagcggacauggagcuucacacuaaaaagguugaaauuuccggucugaaguucgugucuuuggcaugcaccggcuguuacgccugcagcucagggauaaguuguaaaguccgcauccauguggaugagcccgacgaacuaacaguccacgugaaguccagcgauccugacguuguggcugccucuaccucacugauggcacgaaaacucgaguuuggaacugauaguacguucaaggcuuucagcgccaugccaaaaacaucccugugcuuuuauauuguagaaagagaguacuguaagucuugcucggaggaagacacccagaagugugucgauacuaaacuugagcaaccccagagcauccugauagaacacaagggcaccauuaucgguaaacagaacgacacaugcaccgcgaaggccuccugcugguuggagucagugaaaaguuucuuuuaugggcucaagaacaugcugggcucuguuuucggaaacuuuuucaucggcauuuuacuguuucuagcaccguucgugcuccuggucuuguuuuucauguuuggguggaagauccuuuucuguuuuaaaugcuguaggcggacucguggacugcucaaguaccgccaucugaaagacgaugaggaaacagguuauagaaggauuauagagcggcuuaauaauaagaaaggcaagaaccgacuguuggacggggaacgccucgcugauagaaagaucgccgagcuguucagcacgaaaacccacauugga

SEQ ID NO: 10838 - RNA, 1932 nt, Artificial Sequence
  derived and/or modified CDS sequence (opt3) from CCHFV(Ast199)__KX056051.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucaucaaguggaaaguugaauacauaaagacagaggccaucgugugcgucgaacugacuagccaggagaggcaguguagucucauugaagcagggacccgguuuaauuuaggacccgugacaaucacccugucugagccucgcaacauucaacagaaacuuccacccgagaucauaacguugcacccuaagauugaagaggguuucuuugaucugaugcaugugcagaagguccuauccgccagcacuguuugcaaacuccagucgugcacacacggcaucccaggggaccugcaaauuuaucacaucggaaaucuucugaagggcgauagauugaacggucaucucauccacaaaauugaaccgcauuucaauaccucuuggauguccugggacgggugugaucuggacuacuauugcaacaugggagacuggcccucauguacuuacacaggcgugacccagcacaaucacgcugcauuuguaaacuuacugaauauagagacggauuauaccaagacauuccauuuucacaguaaaagggugacugcccauggcgacaccccucagcucgaucuuaaggcucggccaacauacggggccggagaaaucacuguccugguggagguugcggacauggaguugcacaccaaaaagguggaagucagcggucuaaaguucgcaucccuggccugcacaggcuguuacgcuugcucuagcgggauuucauguaaagugcgcauccauguagaugagcccgacgaacucaccguucacgugaagaguuccgauccugacgucguggccgcaagcacuucucugauggcucgaaaacuugaguuuggaacggauucaacauucaaggccuucagugcgaugccaaaaaccagccugugcuuuuauauagucgaaagagaguacuguaaguccugcucugaggacgauacuaagaaauguguggacaccaaguuggaacagccccaaucgauucucaucgagcacaaaggcacaaucauugguaagcagaacgauaccugcacugccaaagcaagcugcuggcuggaauccguuaagucauucuuuuauggguuaaagaacaugcugggcaguguguucggaaauuucuuuguaggcauccuacucuuucuggcuccguucguccuuuuggugcuguuuuucauuuuuggguggaaaauacucuucuguuuuaagugcuguaggcggacacguggacuguucaaauaccgccaucuuaaggacgacgaggagacggguuauagaaaaaucauugaaaggcugaacucuaagaagggcaaaaaucgguugcucgauggggagcgacuggccgaccgcaagaucgcugaauuauucagcaccaaaacucacaucgga

SEQ ID NO: 10839 - RNA, 1932 nt, Artificial Sequence
  derived and/or modified CDS sequence (opt3) from CCHFV(Ast149)__KX056054.1__Gc
uuccuggacagcaucgugaagggcaugaaaaaccuccuuaauuccaccucucuggagacaucauugaguauugaagcccccuggggagcuauaaacguccagagcacuuuuaagccuacgguuuccaccgcaaauaucgccuuaucuuggucgucaguggagcacagagggaacaaaauucugguaacagguaggagcgaaaguaucaugaagcuagaggaacggacuggcguguccugggaucucggggucgaggacgcgucugagagcaaacugcuuaccguguccauuauggaucugucacaaauguacaguccaguuuucgaauauuugagcggagaccgccagguggaggaauggccgaaggcuacaugcaccggcgauugucccgagcgaugcgguuguacuucuuccacaugccuccauaaggaguggccucacucacguaauuggagauguaacccaaccuggugcuggggagucgggacgggcuguacuugcuguggcguggacguaaaagaucuguuuaccgaccauauguucaucaaguggaaaguugaauacauaaagacagaggccaucgugugcgucgaacugacuagccaggagaggcaguguagucucauugaagcagggacccgguuuaauuuaggacccgugacaaucacccugucugagccucgcaacauucaacagaaacuuccacccgagaucauaacguugcacccuaagauugaagaggguuucuuugaucugaugcaugugcagaagguccuauccgccagcacuguuugcaaacuccagucgugcacacacggcaucccaggggaccugcaaauuuaucacaucggaaaucuucugaagggcgauagauugaacggucaucucauccacaaaauugaaccgcauuucaauaccucuuggauguccugggacgggugugaucuggacuacuauugcaacaugggagacuggcccucauguacuuacacaggcgugacccagcacaaucacgcugcauuuguaaacuuacugaauauagagacggauuauaccaagacauuccauuuucacaguaaaagggugacugcccauggcgacaccccucagcucgaucuuaaggcucggccaacauacggggccggagaaaucacuguccugguggagguugcggacauggaguugcacaccaaaaagguggaagucagcggucuaaaguucgcaucccuggccugcacaggcuguuacgcuugcucuagcgggauuucauguaaagugcgcauccauguagaugagcccgacgaacucaccguucacgugaagaguuccgauccugacgucguggccgcaagcacuucucugauggcucgaaaacuugaguuuggaacggauucaacauucaaggccuucagugcgaugccaaaaaccagccugugcuuuuauauagucgaaagagaguacuguaaguccugcucugaggacgauacuaagaaauguguggacaccaaguuggaacagccccaaucgauucucaucgagcacaaaggcacaaucauugguaagcagaacgauaccugcacugccaaagcaagcugcuggcuggaauccguuaagucauucuuuuauggguuaaagaacaugcugggcaguguguucggaaauuucuuuguaggcauccuacucuuucuggcuccguucguccuuuuggcccuguuuuucauuuuuggguggaaaauacucuucuguuuuaagugcuguaggcggacacguggacuguucaaauaccgccaucuuaaggacgacgaggagacggguuauagaaaaaucauugaaaggcugaacucuaagaagggcaaaaaucgguugcucgauggggagcgacuggcugaccgcaagaucgccgaauuauucagcaccaaaacucacaucgga

SEQ ID NO: 10840 - RNA, 1932 nt, Artificial Sequence
  derived and/or modified CDS sequence (opt3) from CCHFV(Ast137)__KX056057.1__Gc
uuccuggacagcaucgugaagggcaccaaaaaccuccuuaauuccacaucucuggagacuucauugaguauugaagcccccuggggagcuauaaacguccagagcacguuuaagccuaccguuuccacagcaaauaucgccuuaucuuggucgucaguggagcacagagggaacaaaauucugguaacugguaggagcgaaaguaucaugaagcuagaggaacggaccggcguguccugggaucucggggucgaggacgcgucugagagcaaacugcuuacaguguccauuauggaucugucacaaauguacaguccaguuuucgaauauuugagcggagaccgccagguggaggaauggccgaaggcuaccugcacuggcgauugucccgagcgaugcgguuguacaucuuccacaugccuccauaaggaguggccucacucacguaauuggagauguaacccaacguggugcuggggagucgggacuggcuguaccugcuguggcguggacguaaaagaucuguuuacagaccauauguucaucaaguggaaaguugaauacauaaagacugaggccaucgugugcgucgaacugaccagccaggagaggcaguguagucucauugaagcagggacacgguuuaauuuaggacccgugaccaucacgcugucugagccucgcaacauucaacagaaacuuccacccgagaucauaacuuugcacccuaagauugaagaggguuucuuugaucugaugcaugugcagaagguccuauccgccagcacaguuugcaaacuccagucgugcacccacggcaucccaggggaccugcaaauuuaucacaucggaaaucuucugaagggcgauagauugaacggucaucucauccacaaaauugaaccgcauuucaauacuucuuggauguccugggacgggugugaucuggacuacuauugcaacaugggagacuggcccucauguacauacaccggcgugacgcagcacaaucacgcugcauuuguaaacuuacugaauauagagaccgauuauacaaagacuuuccauuuucacaguaaaagggugaccgcccauggcgacacaccucagcucgaucuuaaggcucggccaacuuacggggccggagaaaucaccguccugguggagguugcggacauggaguugcacaccaaaaagguggaagucagcggucuaaaguucgcaucccuggccugcaccggcuguuacgcuugcucuagcgggauuucauguaaagugcgcauccauguagaugagcccgacgaacucacuguucacgugaagaguuccgauccugacgucguggccgcaagcacgucucugauggcucgaaaacuugaguuuggaacagauucaaccuucaaggccuucagugcgaugccaaaaacuagccugugcuuuuauauagucgaaagagaguacuguaaguccugcucugaggacgauaccaagaaauguguggacacaaaguuggaacagccccaaucgauucucaucgagcacaaaggcaccaucauugguaagcagaacgacacuugcacagccaaagcaagcugcuggcuggaauccguuaagucauucuuuuauggguuaaagaacaugcugggcaguguguucggaaauuucuuuguaggcauccuacucuuucuggcuccguucguccuuuuggugcuguuuuucauuuuuggguggaaaauacucuucuguuuuaagugcuguaggcggacgcguggacuguucaaauaccgccaucuuaaggaugacgaggagaccgguuauagaaaaaucauugaaaggcugaacucuaagaagggcaaaaaucgguugcucgauggggagcgacuggccgaccgcaagaucgcugaauuauucagcacuaaaacacacaucgga

SEQ ID NO: 10841 - RNA, 1932 nt, Artificial Sequence
  derived and/or modified CDS sequence (opt3) from CCHFV(Ast133)__KX056060.1__Gc
uucagcgacuccaucgugaagggcaugaaaaaccugcucaauucuaccucacuugagacaagucugagcauugaagcccccuggggagcuauaaacguccaguccacuuuuaagccuacgguuucuaccgcaaauaucgccuugucguggucaagcguggagcacagaggaaacaaaauuuuaguaacagguaggagugaauccaucaugaagcuggaggaacggacuggcgugucuugggaucuaggggucgaggacgcgagcgaguccaaacuccugaccgugucaauuauggaucuuagucaaauguacagcccaguuuucgaauaucugucuggagaccgccagguggaggaauggccgaaggcuacaugcaccggcgauugucccgagcgaugcgguuguacuuccucaacaugcuugcauaaggaguggccucacagccguaauuggagauguaacccaaccuggugcuggggagucgggacgggcuguacuugcuguggcguggacguaaaagaucucuuuaccgaccauauguucaucaaguggaaaguugaauacauaaagacagaggccaucgugugcgucgaacugaccagucaggagaggcaguguucucugauugaagcagggacucgguuuaaucucggacccgugacaaucaccuuauccgagccucgcaacauucaacagaaacugccacccgagaucauaacgcuucacccuaagauugaagaggguuucuuugauuugaugcaugugcagaagguccugagcgccucgacuguuugcaaacuacagucuugcacacacggcaucccaggggaccuccaaauuuaucacaucggaaaucugcuuaagggcgauagagugaacggucaucugauccacaaaauugaaccgcauuucaauaccuccuggaugucaugggacgggugugauuuggacuacuauugcaacaugggagacuggcccaguuguacuuacacaggcguaacccagcacaaucacgcugcauuugugaaccuccugaauauagagacggauuauaccaagacauuccauuuucacagcaaaagggucacugcccauggcgacaccccucaguuagaucugaaggcucggccaacauacggggccggagaaaucacugugcucguugagguggcggacauggagcuucacaccaaaaaggucgaaauuuccggucugaaguucgcaucuuugacaugcaccggcuguuacgccugcagcucagggaucaguuguaaagugcgcauacauguagaugagcccgacgaacuaacuguucacgugaaguccagcgauccugacgucguggcugccucuacgucacugauggcacgaaaacucgaguuuggaacagauaguaccuucaaggcuuucagcgccaugccaaaaacuucccugugcuuuuauauugucgaaagagaguacuguaagucuugcucggaggacgauaccaagaaauguguggacacaaaacuugaacagccccaaagcauccugaucgagcacaagggcaccauuaucgguaagcagaacgacacuugcacagcgaaagccuccugcugguuggaaucaguuaagaguuucuuuuaugggcucaagaacaugcugggcucuguguucgggagcuuuuucguaggcauuuuacuguuucuagcaccguucguccuccuggugcuguuuuucauguuuggguggaaaauauuguucuguuuuaagugcuguaggcggacgcguggacuguucaaauaccgccaucucaaggaugacgaggagaccgguuauagaaggaucauugaacggcuuaauuccaaaaagggcaagaaccgacuucuggauggggagcgcuuggcugacagaaaaaucgccgaacucuucucaagcaagacucacaucgga

SEQ ID NO: 10842 - RNA, 1932 nt, Artificial Sequence
  derived and/or modified CDS sequence (opt3) from CCHFV(SK/2015/human)__KX458183.1__Gc
uuccuggacagcaucgugagaggcaugaagaaccuccuuaauuccaccucucuggagacaucauugaguauugaagcccccuggggagcuauaaacguccagagcacuuacaaaccuacgguuuccaccgcaaauaucgccuuaucuuggucgucaguggagcacagggggaacaagauucugguaagcggucggagugaauccaucaugaaacuagaggaacgcacaggcgugucuugggaucucggggucgaggacgcgagcgaguccaagcugcuuacugugucaguuauggaucugagucaaauguauagcccaguguuugaauacuugucuggagaccgacaggucgaggaauggccgaaagcuaccugcacaggcgauugucccgagcguugcgguuguaccacuuccacaugccuccauaaggaguggccucacucaagaaauuggagguguaacccaaccuggugcuggggaguggggacgggcuguacuugcuguggccuggacguaaaggaucuguucaccgacuauauguuuguuaaauggaagguggaauacauuaaaacagaggccaucgucugcguggaacucacuagccaggggcggcaguguaguuuaauagaggcaggaacccgcuucaaucuggguucugugacaaucacccuuuccgaacccagaaacauucaacauaaguugccuccagagaucauuacgcugcaccccaggaucgaggaaggcuuuuucgaucuaaugcauguccagaaaguucucagcgccucgacugugugcaagcugcagucuugcacacacgggguaccuggagaccuucagguguaucacauaggcaaucuguugaagggugauaaagucaacgggcaucucauucacaagaucgagccacauuuuaauaccuccuggaugucaugggacggaugugaucuggacuacuauugcaacaugggcgacuggccgaguuguacuuacacaggcgugacccaacacaaucacgcuagcuucguuaacuuacugaauauugaaacggauuacaccaaaaacuuucauuuccacuccaagcgggugacagcacauggggacacuccccagcucgaucuuaaagcccgcccuaccuauggagcuggugagaucacaguccugguggaaguagccgacauggaguugcacacuaagaaaaucgagauuucuggccuaaaguuugcgagccugaccugcacaggguguuacgcaugcucaaguggaauauccuguaagguucgaauccauguggaugaaccagacgagcucaccguccacgugaaaagcgaugaccccgaugucguggccgcuucuucaagucugauggccagaaaacuugaauuuggcacugacagcacguuuaaagcauucuccgcuaugccuaagacaucucugugcuucuauauuguugagagggaauacuguaaaucgugcagcaaggaggauacccagaagugugugaacacuaaauuggagcagccacaauccauccucauagaacaccgggguaccauuaucgggaagcagaauaacacaugcaucgccaaagcgucaugcuggcuggagaguguaaagucuuucuucuauggcuuaaagaauaugcugagcggaauuuuuggcaaccuauuccucgggaucuuucuguuccuugcccccuuuauuuugcugauacucuucuuuauguucggauggcguauccuguuuuguuucaagugcugucgcagaaccaggggucuuuuuaaguaccggcaucugaaagacgacgaagagacuggcuaucgacgcauuaucgagagauugaauaacaagaaagggaagaauaaacuccuggauggagaaagguuagcagaccggcgcaucgcugagcuguucuccacaaagacgcacauuggc

SEQ ID NO: 10843 - RNA, 1932 nt, Artificial Sequence
  derived and/or modified CDS sequence (opt3) from CCHFV(YL16070)__KY354081.1__Gc
uuccuggacagcaucgccaagggcaugaaaucccuccuuaacucuaccucacuggagacaaguuugagcauugaagcucccuggggagcaauaaaugugcaguccacuuuuaagccuacggucucugccgcgaacaucgcuuuaucguggucaagcguugagcacagagggaauaaaauucuggugagugguagguccgaaucuaucaugaagcuagaggaacggaccggcguaagcuggaaccucgggguggaggaugccuccgagucaaaaacacugacugucagugugauggaccuuagccaaauguacucuccaguuuucgaauaucuguccggagaucgccagguggaggaauggccgaaggcaaccugcacaggcgacugucccgagcgaugcgguuguaccucaagcacuugcuugcauaaggaguggccucacagucguaauuggagauguaacccaacauggugcuggggagucgggaccggcuguacgugcuguggccucgaugugaaagacuuuuucacugauuacaugcugguaaaguggaaaguugaauauauuaagaccgaggccaucgugugcgucgaacugacaucucaggagaggcaguguucccucauagaagcugggacucgguuuaauuuaggacccgugaccaucacacugagcgagccucgcaacgugcaacagagacuuccacccgagauugucaccuugcauccuaaaaucgaagaggguuucuuugaccugaugcacguucagaagauucuaucggcaucuacggugugcaagcuccaguccugcacucauggcguaccaggggauuuccaaguguaccacgucggaaaucugcuuaggggcgacaaagugaacggucacucaauccauaagauagaaccgcacuuuaauacaaguuggaugagcugggaugggugugaccuggauuauuucugcaacaugggagacuggcccuccuguaccuacacuggcguuacacagcauaaucgggccgcuuuuauuaacauguugaauaucgagaccgacuauacgaaaaccuuccacuuucacucuaagcgcgugacagcccauggcgauacuccucagcucgaccugaaagcgcgaccagcauacggggccggagaagucaccguguuaguagagguugcugaucuggagcuccacacaaagaaacuugaagugagcggucugaagauugccucauugacuugcaguggcuguuacgcaugcuccagcgggaucucuuguaaggucagaauccaugugaacgagcccgacgaauuuaccguccacgugaggucaagugauccugacguuguggcugccggaagcucccuaauggcgcggaaaauugaguucggcgccgauucuacauuuaaggcauucucgagcaugccaaaagacucccugugcuuuuauauaguagaaaaggauuacuguucaaguugcaccgacgaugacacucagaaaugugucaacacgaagcucgaccauccccaaucuauccugauugagcacaaggguacaaucauagggaaacagaaugauaccugcagcacuaagaccuccugcuggcuuaaaucauucaagggcuuuuucuauggacugaaaaacauguugagcggcauuuuugggaauguguuccucggaauccuguuauuucuggcuccguucguucuacucaucuuuuucuuuuucuucgguuggcgucugcuuuucuguuugaagugcuguaagaaaacaaagggccugcucaaauacaagcaccugaaagacaaggaggaagccggguauaagaaaauuaucgagcgccuuaacggaaagaaaggcaagucucagcuguucgauggugaaagauuggcuaauaggaaaauugccgagcucuuuuccaccaagauacauaucggg

SEQ ID NO: 10844 - RNA, 1932 nt, Artificial Sequence
  derived and/or modified CDS sequence (opt3) from CCHFV(Oman_812956)__KY362518.1__Gc
uucuuugacagcaucgccaagggcaugaaaaaccugcucaauuccaccucucuugagacaucacugaguauugaagcucccuggggugcaauaaacgugcagagcacuuucaagccuacggucuccaccgccaauaucgcguugucuuggucgucaguugagcacagaggaaacaaaauuuuagugagcgguaggagugaauccaucaugaagcuggaggaacggacaggcauuucuugggaucuagggguagaggacgcuagcgaguccaaacuccugacugugucagucauggaucuuagucaaauguacagcccaguguuugaauaucugucuggagaccgccagguugaggaauggccgaaggcuaccugcacaggcgauugucccgagcgaugcgguuguaccuccucaacuugcuugcauaaggaguggccucacagccguaauuggagauguaacccaacauggugcuggggaguggggaccggcuguacgugcuguggccucgacgucaaagaucuguucacugacuacauguuugugaaguggaaaguagaauauaucaagaccgaggcaauaguuugcguggaacugacaagucaggagaggcaguguucucucaucgaagccgggacucgguucaauuuaggacccgucaccauuacacuguccgagccucgcaacauccaacagaaacuuccacccgagauugugaccuugcauccuagaaucgaagagggguuuuucgaucugaugcacgugcagaagguccuaagcgcuucgacgguuugcaagcuccagucuugcacucauggcgugccaggggaccugcaaguauaccacauaggaaaucuucugaaaggcgauaaggugaacggucacuugauucauaaagucgaaccgcacuuuaauacauccuggaugucaugggacgggugugaucucgacuauuacugcaacaugggagacuggcccaguuguaccuauacuggcgugacacagcauaaucacgcagccuucguuaaccuguuaaauaucgagaccgauuacacgaagaacuuucacuuccauagcaaaagggugaccgcucacggcgacacaccucagcuggaucucaaggcccggccaaacuacggggcgggagaaauuacuguccuuguggagguagcagacauggagcugcauaccaaaaagaucgaaaucuccgguuugaaguuugccucucuaacaugcacuggcuguuaugcuugcagcucagggauuaguuguaaaguucgcauacacguggaugagcccgacgaacugaccguccaugugaaguccgaggauccugacaucgucgccgcaucuagcucacucauggcucgaaaacuggaauuuggaacagauaguaccuucaaggccuuuagcgcgaugccaaaaacuucccuuugcuucuacauuguggagagagaguauuguaagucuugcucgaaggaagacacgcagaaauguguuaaugccaagcuggagaggccccaaagcaucuugauagaacacaaaggcacaauuaucgguaagcagaacgauaccugcacugcaaaagccuccugcuggcucgagucagugaagaguuucuucuacgggcugaagaauauguuaucuggcaucuuuggaaacguauucauuggcaucuuucuguuccuagccccguuuauucuccugauacuuuucuuuauguucggguggcggaucuuguuuuguuucaaaugcugucgucgcaccagaggacuguucaaguauaggcaccucaaagacgacgaggaaacagguuaccggaagauuaucgagcgacugaauaacaaaaagggcaagaauaaacuucuggauggggaacgcuuggcugacagaaagaucgccgagcucuuuagcaccaaaacucauauugga

SEQ ID NO: 10845 - RNA, 1932 nt, Artificial Sequence
  derived and/or modified CDS sequence (opt3) from CCHFV(UCCR4405)__KY484029.1__Gc
uuccuggacagcaccgugaagggcaugaaaaaccuccuuaauuccacaucucuggagacuucauugaguaucgaagcccccuggggagcuauuaacguccagagcacguuuaagccuaccguuuccacagcaaauauagccuuaucuuggucgucaguggagcacagagggaacaaaauccugguaacugguaggagcgaaaguauuaugaagcuagaggaacggaccggcguguccugggaucucggggucgaggacgcgucugagagcaaacugcuuacaguguccaucauggaucugucacaaauguacaguccaguuuucgaauauuugagcggagaccgccagguggaggaauggccgaaggcuaccugcacuggcgauugucccgagcgaugcgguuguacaucuuccacaugccuccauaaggaguggccucacucacguaauuggagauguaacccaacguggugcuggggagucgggacuggcuguaccugcuguggcguggacguaaaagaucuguuuacagaccauauguucguuaaguggaaaguggaauacauuaagacugaggccaucgucugcguggaacugaccagccaggagaggcaguguagucucauagaagcagggacacgguuuaauuuaggacccgugaccaucacgcugucugagccucgcaacauucaacagaaacuuccacccgagaucauuacuuugcacccuaagaucgaagaggguuucuuugaucugaugcauguccagaagguucuauccgccagcacagugugcaaacuccagucgugcacccacggcauaccaggggaccugcaaauuuaucacaucggaaaucuucugaagggcgauagaguaaacggucauuugauucacaaaaucgaaccgcauuucaauacuucuuggauguccugggacgggugugaucucgacuacuauugcaacaugggaaauuggcccucauguacauacaccggcgugacgcagcacaaccacgcugcauuugucaaucuguuaaacaucgagaccgacuauacaaagacuuuccauuuucacaguaaaagggugaccgcccauggcgauacaccucagcuggaccucaaggcucggccaacuuacggggccggagaaauuaccguucuuguggaggucgcggauauggagcugcacaccaaaaagguggaaauaagcgguuugaaguucgcaucccuaguaugcaccggcuguuacgccugcucuagcgggaucucauguaaaguucgcauucauguggacgagcccgaugaacugacuguccacgugaagaguuccgacccugaugucguggcugccagcacgucucucauggcacgaaaacuggaguuuggaacagacucaaucuucaaggcuuucagugccaugccaaaaaccagccuuugcuuuuauauaguugaaagagaguacuguaaguccugcucugaggaugacacuaagaaauguguggauaccaagcuggaacagccccaaucgauuuugaucgagcacaaaggcacaaucauugguaagcagaacgauaccugcacugcgaaagccagcugcuggcucgaauccguaaagucauucuuuuaugggcugaagaauauguuaggcagugucuucggaaacuuuuucgugggcauccugcuauuucucgcaccguucguucugcuuguguuguuuuucauguuuggguggaaaauucuguucuguuuuaagugcuguaggcggacacguggacucuucaaauaccgccaucugaaggacgacgaggagacggguuauagaaggauaaucgaacggcuuaauucuaaaaagggcaagaaccgacuguuggacggggagcgccucgcugauagaaaaauugccgaacuguucagcaccaagacucacaucgga

SEQ ID NO: 10846 - RNA, 1932 nt, Artificial Sequence
  derived and/or modified CDS sequence (opt3) from CCHFV(UCCR4401)__KY484035.1__Gc
uuccuggacagcaccgccaagggcaugaaaaaccuccuuaauuccacaucucuggagacuucauugaguaucgaagcucccuggggugcaauuaacgugcagagcacguacaagccuaccgucuccacagccaauauagcguuaucuuggucgucaguugagcacagaggaaacaaaauccuggugagcgguaggagugaauccauuaugaagcuagaggaacggacuggcaucucuugggaucucgggguagaggacgcuagcgaguccaaacugcuuaccgugucagucauggaucugagucagauguauagcccaguguuugaauacuugucuggagaccgccagguugaggaauggccgaaggccacaugcaccggcgauugucccgagcgaugcgguuguacuuccucaacaugccuccauaaggaguggccucacagccguaauuggagauguaacccaaccuggugcuggggaguggggacgggcuguacuugcuguggccuggacgucaaagaucuguucaccgacuauauguuugugaaguggaaaguagaauacauuaagacagaggcaaucguuugcguggaacucacuagccaggagaggcaguguucuuuaauagaagccgggacccgguucaaucugggacccgucacaaucacccuuuccgagccucgcaacauucaacagaaauugccacccgagaucauuacgcugcauccuagaaucgaagagggguuuuucgaucuaaugcacgugcagaaggugcucagcgcuucgacugucugcaagcugcagucuugcacacauggcguuccaggggaccuucaaguguaucacauaggaaaucuguugaaaggcgauaagguaaacggucaccucauucauaaaaucgaaccgcacuuuaauaccuccuggaugucaugggacgggugugaucuggacuacuauugcaacaugggagacuggcccaguuguacuuacacaggcgugacccagcauaaucacgcaaguuucgucaacuuacugaauauugagacggauuacaccaagaacuuucacuuccauuccaaaagggugacagcccacggcgacacuccucagcucgaucuuaaggcucggccaaccuauggggccggagaaaucacaguucugguggaggucgcggacauggaguugcauacuaaaaagaucgaaauuucuggucuaaaguuugcaagccuggccugcaccggcuguuacgcuugcucaagugggauauccuguaaagugcgcauccacguagaugagcccgacgaacucacaguucaugucaagagcgaugacccugaugugguggccgcaucuucaagucugauggcucgaaaacuugaguucggaaccgacagcacuuuuaaggccuucuccgcgaugccaaaaacgucucugugcuucuauauugucgaaagagagcacuguaagucgugcagcgaggaagauacaaagaaaugugugaacaccaaguuggagcagccccaauccauccucauagaacacaaaggcacuauuaucgguaagcaaaauucaaccugcacagccaaagcaaguugcuggcuggagucuguuaagagcuuuuucuacggguuaaagaacaugcuguccggcaucuuuggaaauguguucaugggcauuuuucuauuccucgcuccguuuauccugcuuauuuuguucuuuauguucggguggaggauacuguuuuguuucaaaugcugucggcguacccgcggacucuuuaaguauagacaucugaaagacgacgaggaaacugguuacaggcggaucauugagaaacuuaacaauaagaagggcaagaacaaacuguuggauggggaacgacucgccgaccgcagaaucgcugagcuguucucaacaaagacgcacaucgga

SEQ ID NO: 10847 - RNA, 1932 nt, Artificial Sequence
  derived and/or modified CDS sequence (opt3) from CCHFV(UCCR4448)__KY484042.1__Gc
uuccuggacagcaucgugaagggcaugaaaaaccuccuuaauuccaccucucuggagacaucauugaguauugaagcccccuggggugcuauaaacguccagagcacuuacaagccuacgguuuccaccgcaaauaucgccuuaucuuggucgucaguggagcacagaggaaacaaaauucugguaagcgguaggagugaauccaucaugaagcuagaggaaaagacaggcauuucuugggaucucgggguggaggacgcgagcgaguccaagcugcuuacugucucagugauggaucugagucagauguauagcccaguuuuugaauacuugucuggagaccgccagguggaggaauggccgaaggcuaccugcacaggcgauugucccgagcggugcgguuguaccuccucaacuugccuccauaaagaguggccucacagccgaaauuggcguuguaacccaacauggugcuggggagucgggaccggcuguacgugcuguggccuggacgugaaggaucuguucacugacuauauguuuguaaaauggaagguugaauacaucaaaaccgaggccauagugugcgucgaacucacaagucaggagagacaguguucuuuaaucgaagcagggacuagguucaaucugggacccgugaccauuacacuuuccgagccucggaacauccaacagaaguugccacccgagauuaucacccugcauccucgcauagaagagggguuuuucgaucuaaugcacgugcagaagguccucagcgccucgacgguuugcaaacugcagucuugcacucauggcgugccaggggaccuucaaguauaucacauuggaaaucuguugaagggcgauaaagugaacggucaccucauccauaagauugaaccgcacuuuaauacauccuggaugucaugggacgggugugaucuggacuacuauugcaacaugggagacuggcccaguuguaccuacacuggcgucacacagcauaaucacgcuagcuucgugaacuuacugaauaucgagaccgauuacacgaaaaacuuucacuuccauuccaagagaguuaccgcacacggcgacacaccucagcucgaucuuaaagccaggccaacuuauggggcuggagaaaucaccgugcuggucgagguggccgacauggaguugcauacaaagaagauugaaauaucuggucuaaaauuugcgagccugacuugcaccggcuguuacgcaugcucaagugggaucuccuguaagguacggauucacguugaugagcccgacgaacucacagugcaugucaaaagcgaugacccugauguggucgccgcuucuucaagucugauggcccgcaaacuugaguucggaaccgacagcacuuuuaaagcauucuccgcuaugccaaagacgucucugugcuucuauaucguggaacgagagcacuguaagucgugcagcgaggaagauaccaaaaaguguguuaacacaaaauuggagcagccccaauccauacucauugaacacaagggcacuaucaucgguaaacaaaauucaaccugcacagccaaggcgaguugcuggcuggagucuguaaagagcuuuuucuacgggcugaaaaacauguuauccggcauuuuuggaaauguguucaucggcauuuuucuauuccucgccccguuuauacugcuuaucuuguucuuuauguucggguggaagauucuguuuuguuucaaaugcuguagaaggacccggggacucuuuaaguaucgucaucugaaagacgacgaggaaacugguuaccgcagaaucaucgagaggcuuaacaauaagaagggcaaaaacaagcuguuggauggggaaauucucgcagaccggcgaauagcugagcuguucucaacaaaaacgcacaucgga

SEQ ID NO: 10848 - RNA, 1932 nt, Artificial Sequence
  derived and/or modified CDS sequence (opt3) from CCHFV(U2-2-002/U-6415)__AY900144.1__Gc
uuccaggacagcaucgugaagggcaugaaaaaccugcucaauuccaccucucuugagacaucacugaguauugaagcccccuggggugcuauaaacguccaaagcacuuacaagccuacgguuuccgcagccaauaucgcguugucuuggucgucaguggagcacagaggaaacaaaauuuuaguaagcgguaggagugaauccaucaugaagcuggaggaacggaccggcauuucuugggaucuagggguggaggacgcuagcgaguccaaacuccugacagucucagugauggaucuuagucagauguauagcccaguuuuugaauaccugucuggagaccgccagguggaggaauggccgaaggccacuugcaccggcgauugucccgagcgaugcgguuguacauccucaaccugcuugcauaaggaguggccucacagccguaauuggagauguaacccaacuuggugcuggggagucgggacaggcuguaccugcuguggccucgacgugaaagaucuguucacggacuauauguuuguaaaguggaaaguugaauacaucaagacugaggcaauagugugcgucgaacugaccagucaggagaggcaauguucucucaucgaagccgggacacgguucaauuuaggacccgugacuauuacccuguccgagccucgcaacauccagcagaaacuuccacccgagauuaucacauugcauccuagaauagaagagggguuuuucgaucugaugcacgugcagaagguccuaagcgcuucgaccguuugcaagcuccaaucuugcacgcauggcgugccaggggaccugcagguauaucacauuggaaaucuucugaaaggcgauaaggugaacggucacuugauccauaaaauugaaccgcacuuuaauacuuccuggaugucaugggacgggugugaucucgacuacuauugcaacaugggagacuggcccaguuguacauacaccggcgucacucagcauaaucacgccagcuucgugaaccuguuaaauaucgagacagauuacaccaaguccuuucacuuccauucuaaaaggguuacggcacacggcgacaccccucagcuggaucucaaggcucggccaagcuauggggccggagaaaucacagugcuugucgagguggcggacauggagcugcauacuaaaaagauugaaauaucagguuugaaguuugcaagucuaaccugcacaggcuguuacgccugcuccagcgggaucucuuguaaaguacgcauucacguugaugagcccgacgaguucacugugcaugucaagucagaugacccugauguggucgcugccaguagcucccugauggcacgaaaacucgaauuuggaaccgacucuacauucaaggcuuucucggccaugccaaaaaccagccugugcuuuuauaucguggaaagagaguacuguaaguccugcucagaggaagauacucaaaaguguguuaacacgaaacuugagcagccccagaguauacugauugaacacaagggcacaaucaucgguaaacaaaacaauaccugcacugcgaaggccucuugcugguuggagagcgugaaauccuucuuuuaugggcucaagaacaugcugucaggcauuuucggaaauguauuugucggcaucuucuuauuucuggcaccguucauucuacucauacuguuuuucauguuuggguggaggauccuuuucuguuuuaagugcugucggcguacccgcggauuguucagauacaaacaccuggagaacgacgaagagacagguuauaggcggauuaucgaacgacucaauaacaagaaaggcaagaauaaacugcuugacggggagcgccuggcugauagaaggaucgccgaauuguucagcaccaagacucauauugga

SEQ ID NO: 10849 - RNA, 1932 nt, Artificial Sequence
  derived and/or modified CDS sequence (opt3) from CCHFV(SPU 45/88)__KJ682809.1__Gc
uuccuggacagcaucgugaagggcaaaaagaaccuccuuaauuccaccucucuggagacaucauugaguauugaagcccccuggggagcuauaaacguccagagcacuuuuaaaccuacgguuuccgcagccaauaucgcguuaucuuggucgucaguggagcacagagggaacaagauucugguaagcgguaggagugaauccaucaugaaacuagaggaacggaccggcauuucuugggaucucgggguggaggacgcuagcgaguccaagcugcuuacagucucagugauggaucugagucaaauguacagcccaguuuucgaauauuugucuggagaccgccagguggaggaauggccgaaggccacuugcaccggcgauugucccgagcgaugcgguuguacauccucaaccugccuccauaaagaguggccucacagccguaauuggagauguaacccaacuuggugcuggggagucgggacaggcuguaccugcuguggccuggacgugaaggaucuguuuacggacuacauguucguaaaauggaagguugauuauaucaaaacugaagcaauagugugcgucgagcucaccagucaggaaaggcaguguucuuuaaucgaggccgggacacgguuuaaucugggacccgugacuauuacccuuuccgaaccucgcaacauccaacagaaguugccacccgagauugugacacugcauccuagaaucgaggaagguuucuuugaccuaaugcacguccagaauguucucagcgcuucgaccgugugcaagcugcagucuugcacgcauggcguaccaggggaucuucaaauauaccacauuggaaaccuguugaaaggcgacaaggugaauggucaccucauccauaaaauugagccgcacuucaacacuuccuggaugucaugggaugggugugaccuggacuauuacugcaauaugggagauuggcccaguuguagcuauacaggcgucacccagcauaaccacgcagccuuugugaauauguuaaacaucgaaacugacuacacaaagaacuuccacuuucauuccaaaaggguuaccgcucacggcgauacgccucagcuggaccucaaggcccggccaaccuacggggcgggagagaucacagugcuugucgaaguggcagauauggagcugcauacuaaaaagauugagauaucugguuugaaguucgccagccuaaccugcacaggcuguuaugcuugcucaagugggaucuccuguaaaguacgcauucacguugacgaacccgaugagcugacugugcaugucaagagcgaagacccugauaucguggccgcaucuucaagucucauggcucgaaaacuggaguuuggaaccgacagcacauucaaggccuucuccgcgaugccaaaaaccucucuuugcuuuuacauagucgaaagagaguauuguaagucgugcagcaaggaggauacucagaaaugugugaauacgaagcuggaacaaccccaguccauuuugaucgagcacaaaggcacaaucauugguaagcagaacgauaccugcacugccaaagcaucaugcuggcucgaaaguguuaagucuuucuuuuacgggcugaagaauauguuaagcggcaucuucggaaacguguuuauuggcauacugcuauuccucgcuccguuuaucaugcugauucuuuucuuuauguucggguggaggaucuuguuuuguuucaaaugcugucggcguacccgcggacuguuuaaguauagacaccucaaagacgacgaggagaucgguuacaggaagauuauagaacggcugaauaacaaaaagggcaagaauaaacuucuggacggggagcgauuggccgaucgcaagaucgcugaacucuucuccacaaaaacccauauugga

SEQ ID NO: 10850 - RNA, 1932 nt, Artificial Sequence
  derived and/or modified CDS sequence (opt3) from CCHFV(SR3)__AJ538199.1__Gc
uuccuggacagcaucgugaagggcaugaaaaaccuccuuaauuccaccucucuggagacaucauugaguauugaagcccccuggggugcuauaaacguccagagcacuuacaagccuacgguuuccaccgcaaauaucgccuuaucuuggucgucaguggagcacagaggaaacaaaguacuggugagcgguaggagugaauccauuaugaagcuagaggaacggacaggcaucucuugggaucucggggucgaggacgcgagcgaguccaaacugcuuacugugucaguuauggaucugagucaaauguauagcccaguguuugaauacuugucuggagaccgccaggucgaggaauggccgaaggcuaccugcacaggcgauugucccgagcgaugcgguuguaccuccucaacuugccuccauaaggaguggccucacagccguaauuggagauguaacccaacauggugcuggggaguggggaccggcuguacgugcuguggccuggacguaaaagaucuguucacugacuauauguuuguuaaguggaaaguggaauacauuaagaccgaggccaucgucugcguggaacucacaagucaggagaggcaguguucuuuaauagaagcagggacucgguucaaucugggauccgugaccaucacacuuagcgagccccgcaacauucaacagaaauugccuccagagaucauuacccugcaucccaagaucgaagagggguuuuucgaucuaaugcacguccagaagguucucucggccucuacggugugcaaacugcaguccugcacucauggcguaccuggggaccuucaaguguaucacauaggaaaucuguugaagggcgauagagucaacggucaccucauucauaaaaucgaacagcacuuuaauacaucauggaugaguugggacgggugugaucuggacuacuauugcaacaugggagacuggccaagcuguaccuacacuggcgugacacagcauaaucacgcuuccuucguuaacuuacugaauauugagaccgauuacacgaagaccuuucacuuccauucuaaaagggugacagcacacggcgacacuccgcagcucgaucuuaaggcccggcccaccuauggggcuggagaaaucacaguccugguggagguagccgacauggaguugcauacuaaaaagaucgaaauuagcggucuaaaguuugcgggccugaccugcacaggguguuacgcaugcucaaguggaauauccuguaaaguucgcauccacguggaugagccugacgaacucaccguccaugugaagagugaugacccagaugucguggccgcuucuucaagucugauggcccgaaaacuugaguucggcacugacagcacguuuaaggcauucuccgcuaugcccaaaacaucucugugcuucuauauuguugaaagagaguacuguaagucgugcaacaaggaggauacccaaaaaugugugaacacuaaguuggaacagccucagagcauccucauagagcacaaagguaccauuaucgggaagcaaaauaacacaugcaccgccaaagcguccugcuggcuggaaucaguaaagagcuuuuucuauggcuuaaagaauaugcugggaggcaucuuugggaacgucuucauuggaaucuuuacuuuccuaacaccauuuauucuccugauacuuuucuuuauguucgguuggaggaucuuguuuuguuucaaaugcugucggcguacgcgcggccuguuuaaguacagacaccucaaagacgacgaggagaccggguauaggaagauuaucgaacggcugaauaacaaaaagggaaagaaucgacuucuggauggcgagcgcuuggccgacagaaaaaucgcagaacucuucucuacuaagacacauauuggu

SEQ ID NO: 10851 - RNA, 4656 nt, Artificial Sequence
  derived and/or modified CDS sequence (opt3) from DUGV(ArD44313)__NC_004158.1__GP
augagcaagagagugcugaucauugccgucguuguguaccucguauucaccacacagaaccaaauaacuggcaaucacacgaccaucaacuccucuucacccaguacaacugaggcuagcuccaccccuacagugucuaggaccccacagacuacaaccacgucgacugcagucucaaccacaauuacugccaccacaaccccgacggcgagcuggacuacacagagucaguauuuuaauaaaaccacucaacaucacuggcgggaagagacaaugaucucccgcaaccccaccgugcuugaccgacagucucgugcuagcuccguuagagaacuguugaauacgaaguucuuaaugcugcuaggguuuauuccuaaaggagaggugaaccaucucgaaaaugccugcaacagggaggguaagaauuguaccgagcugauccuuaaagaacggauagcacgcuucuuuucagagacagaaaaggagaguugcuacaacacuuaucuggagaagcacuugagaagcgucucuccagaagugucccucacccccuacaggguacugggccugcgggaggauauccucuuaaaagaaauugaccgccgaaucauuagauucgagacagauucacagaggguuacuugucugagcgccagucuuuugaagccugacguguuuauccgggaacagcguauagaugcuaaaccaucuaaugggcccaagauugucccuguggacuccguggcaugcaugaaccuggaggccaaugucgauguucgcagcaacaagcuagugauccaaucgcucaugaccacaguaaagauuucucugaagaauuguaaaguggucgugaacuccagacagugcauccaucagcagaccggaucaggcguuaucaaggugccaaaauucgagaagcaacagggugggacuuggaguagcuauauugcuggagucuacacggccacaauagaccuucuggaugaaaacaaucagaacuguaaauuguuuaccgagugcaucgugaagggcagggaacucguaaaaggccaauccgagcugaagucuuucaauauugaaguuuuacugccgcgggugaugaagacucgacgcaaacuccuugcggucaccgacgggagcacagaguguaacucaggaacccagcugaucgaggguaagaguauagaagugcacaaacaggauauuggcgggcccggaaagaaauugacuaucugcaauggcacauccguccuagacgugccucuggaugagggucacggguguuauacgaucaacguuauuaccagcaagagagcaugcaggccaaagaacucuaaacuccagugcucaaucgacaaggaacugaaacccugugacaguggaaagugccuuagcauuucccaaaaaggcgccggccauauaaaggugucucgggggaagacuauccugauuacagaguguaaagaacacugccagaucccuguaccaaccggaaagggugauaucauggucgacuguucgggcgggcgccagcauuacuuggaggugaauauuguugauauacacugccccaauacaaaauuucucggaggcaucaugcuguacuucuguagaaugagcuccaggccgacuguggcuuuacugcuagguauuuggaucgggugcggcuauauucucaccuguaucuuuucauuccugcuuuaccacuugauacuguucuuugccaacugcaucaagcagugucguaaaaagggagagcggcucggcgaaauuugcgucaagugcgagcaacagacggugaaucugauggaccaggaacuucaugaucugaacuguaauuucaacuugugcccuuauuguugcaaucgaaugagugacgaggggaugucuagacacguaggaaaaugucccaagaggcucgagcgccugaacgaaaucgaguuauaccugaccacaagcgaaugccuaugucucuccgugugcuaucagcugcuuauuucaguugguaucuuuuugaaacggacuaccuggcuggucgugcuccugguguuacugggccuugcaauaagcccaguccaaggggcuccuacagagguuucuaacgugaagcaggauggagacuacuccauuuguuauuucaucuuuggcugcuuggugacugccgcgcuccugcuaaaaguaaagagaaccaauaguaacgguauugucgugguuguggauagcuucgggaggugucccuacugcaaugaauuuacggacucucuguucgaggagguccuccaugauacacugugcucccuuugugugugcccauuuugugaaaaacaggccuuggaccugguuaccuuagaggaacacgugaaggagugcuacaagguagcaacucgcaaagacaucuucaagauacucggccgaaaauuuacaaacgcucugguccggcgugaaaaacuuuucaccacuggacugcaguuguuuaucaauaaaaccaacgugguggucuucgcccucauuauguguuuccugcuacugcucacaggccauaaugcuucagccuuugauaguggggaccugcccgauggaguuugggaggagagcucgcaacuugugaaguccugcacgcaguucuguuauaucgaagaggacguaugcuacuguccugcagaagauggugugggcagaaaguugcuguuuuucaacggguuacaaaauucugucaaaaggcucagcgacucacacaagcugcuuaccaguguguccauugaugccccauggggacgcaucaacguugagucuacuuggaaaccgacacuggcugcgagcaauauagcaauguccuggucaagcaccgacauuaagggcgaaaaagugauccuaaguggucggucuacauccaucauuaagcucaaggagaaaacuggggucauguggaagcuggugggcagcggauuggccucggagaaaaagaaacccuuuagauucccuaucauggauuuugcucagguuuauaacucaguguuccaguacauuaccggcgacaggcuguuaucugaauggccaaaggccgucugcacgggggauuguccccaccgaugcggaugccagacaaguaccuguauggcaaaggagugccauacucaggaauguguauccacccacauggugcucggcauagguacagggugcacuuguugcggaauggacguugagcgcccuuuuaauaaauaucugggcgugaaguggagcaccgaguaccuucggacagaaguccugguguguguagaggugacggaagaggaaagacauugcgagaucgucgaggccgguaccagguucaacauuggcccaaucacuauuacaaucucugauccccaaaauauagggagcaaauugccggaaucccucaugaccguucaggagaucgacgacucaaacuuuguggauauuaugcacgugggaaacgucaucagugcugacaauagcugucgucugcagucuugcacucacggcuccgccgugacaacccgcuucacggcacuaacugcgcugauuaaggaugaccauucaagugggcuuaaccucgcuguucuggauccuaaaguaaauagcuccugguugucuugggaaggaugugacauggauuauuacugcaacgugggcgacuggccaaccugcacauacaccggugucgugacucagaagcugcgggaguuuuuaaaacucgaucaacacagaaagaggcugcauacaacccuuucguucagccugaagaaaaauuugucaaagcgaucccacacaaguguucggcucgaagggaaaacugugacccgcauggaggucaaggugacggcccugaucgagguagacggaauggaacuacauucuaaaacaauaagacugagcggcauuaggcuuaccggucucaaguguuccggcugcuucucauguacuucugggaucagcugcagugucaacgcaaagcugaccucccccgaugaguuuacauugcacuuacggagcacuucuccuaaugugguuguggccgaaaccucaaucauugcucgaaaaggacccuccgccacgacaaguagauucaaggucuuuagcgugcgcgacaccaaaaagauauguuucgagguuguggaaagggaguauugcaaagauuguacuccagacgagcugacaaccugcacuggcgucgaacucgagccuacaaaggacauccugcuugaacaccgugggaccauugugcagcaucagaacgauacguguaagucgaaaaucgacugcuggucuaauuccauuagcucauuugcaaguggaaucggcgauuucuuuaagcacuacauagguucuaucgcuguaggggugcugggaacuguuuugcccuucgcccuacugauucucuuuuucaucuauggcgacaaaaugcuguggccauuuaaggucuucugucggccgugcagaaggugcugucgcaaaaacgaggguuacaauaaacuugcggaggaagaggaauuacgagauauuaucagaaaguucuccaaaagcggcgagcugauaaacaaggacgccaaagauaagcggacccucgcuagguuguuuaugucagacaauccuaaacugaagaaggaaaagaagcucagugagauugcauga

SEQ ID NO: 10852 - RNA, 4656 nt, Artificial Sequence
  derived and/or modified CDS sequence (opt3) from DUGV(IbAr1792)__KU925456.1__GP
augagcaagagagugcugaucauugccgucguugugugccucguauucaccacacagaaccaaauagcuggcaaucacacuacggcaaacuccgggucucccucaaccaaagaggccaguagcaugccuacaguguccgacacuccacagaccacaaccacuucuacagcggucucgaccacgaucacugcuaccacaacuccgaccgccucauggacaacccagagccaguacuuuaauaagacgacucaacaucacuggagggaagagacaauggugagucggaaccccaccguucuuaaucgccagcgacgugcauccucugugaaagaacuguugaacacuaaguucuuaaugcugcuaggauuuauuccuaaaggugaggucaaucaucucgaaaacgccuguaauagagagggcaagaacugcacagagcugauccuuaaggaaaggauugcucgguucuuuagcgagaccgaaaaagaguccuguuauaauacguaccuggagaagcacuugugcucagugaguccagaaguaagccucacccccuaucgcguucuggggcugagagaggauauccuccuuaaaaagauagacaggcggaucauucgcuucgaagcagauucucagcgagugacaugucuguccgccucacuuuugaaaccugacgucuuuaucagagagcagaggauugaugcuaagccaagcaacggacccaagaucgugccuguggacaguguccggugcauaaaucuggaagccaacguugaugugcguucuaauaagcuaguaauucaaucccucaugacuaccgugaagaucagccugaaaaacuguaaggucgugguuaacucgcgccagugcauucaucagcagacaggcucuggugugaucaaagucccaaaguucgagaaacaacaagggggaacuugguccucauacaucgcgggcguguauaccgcaacaauugaccuucuggaugagaagaaucagaacuguaaguuguuuaccgaaugcauaguaaaaggcagagagcucguuaaggggcagagugaacugaaauccuucaauaucgagguguuacugccgagggucaugaagacucggcgaaaacuccuugccgugacggacggauccacagaauguaacucugguacccagcugauugagggcaagagcaucgagguccacaagcaggauauagggggacccggcaaaaaguugacuauuugcaaugguaccucagugcuagacguuccucuggaugaagggcacggaugcuacacaaucaacgugaucaccaguaaacgcgcuuguagaccaaagaauagcaaacuccagugcagcauugacaaggagcugaagcccugugacucuggcaaaugccuuucaaucagucaaaagggcgccgggcauauuaaaguaagcaggggaaagacuauacugaucacagaauguaaagagcacugccagauuccugucccaacggguaagggcgauaucaugguggacuguuccgggggacggcagcauuauuuggaaguuaacaucguggauauucacugccccaauaccaaguuucucggcgguauaaugcuguacuucugucgcaugucuucgagaccgacugucgcauuacugcuagggaucuggauuggcugcggauacauccucacauguauuuuuagcuuccugcuuuaucacuugauccuguucuuugcuaacugcauaaaacagugcaggaagaaaggcgagcgucucggggagaucugugugaagugcgaacaacagaccguaaaucugauggaccaggagcuucaugaucugaacuguaauuucaacuugugcccuuacuguugcaaucggauguccgacgaaggaaugucacgacacguggguaaaugucccaagagacucgagaggcugaacgagauugaauuauaucugaacuacaaacgcguuccaaguugccuacgguguaugcucucuacaagcaucuccgucggcauuuuucugaagagaacuaccuggcuugugguguugcugguccuccugggguuagccaucucaccuguucagggagcgcccgccgaggugagcaaugugaagcaagauggcgacuauucuauaugcuacuucauuuuugguugucugguaacggcagcucuuuugcucaaagucaagaggaccaacuccaaugggaucgugguuguggucgauaguuucggccgcugcccauauugcaacgaauuuacagacagccuguucgaggaagugcuacaugauacucuguguucucucugcguuugucccuuuugcgagaaacaggcccuggaccuugugaccuuggaggaacacguaaaggaguguuacaaagucacaacucgaaaggacauuuucaagauccugggacggaaauuuaccaaugcuuuagugcguagagaaaaacucuucacgacaggccugcagcuuuuuauaaacaaaaccaauguggucguuuucgcccugaucaugugcuucuugcuccugcuaacugggcauaacgcauccgccuuugauucaggagaccugccugaugguauuugggaggaaaguagccagcucgugaagucguguacacaauucugcuacaucgaggaggacguauguuauugcccagcugaaaauggcguggggaggaaacuguuauuuuucaacggauugcaaaauuccgucaagcgccugucugauagccacaaguuacucaccucagugaguauugacgcgccguggggcgcaaucaacguugaguccacuuggaaacccacccuggccgcuucuaauauagccaugagcugguccucaacagauauuaagggugaaaaagugauccuuagcgggcggaguacgucuaucauuaagcugaaagagaagaccggcgucaugugggaacuaggauccgagcucgcaagcgagaagaaaaagcuguuggugucgaucauggacuuugcccagguuuacaacucaguguuccaguauauuacuggcgauagacuguuaucugaauggccuaaagcugucuguacaggggacugcccacacaggugcggaugucagaccaguacaugcauggccaaggaguggccccauacucgaaauuggcgcuguaacccuaccuggugcuggggcauagguacgggguguacaugcuguggaauggauguagaacggccauuuaacaaauaccucggcgugaagugguccaccgaguaucugagaacugagguucuugugugcgucgaagugaccgacgaggaaaggcacugugagaucguagaagcagguacacguuucaauauuggccccaucacuauuaccaucagcgauccgcagaacauagggucuaaacugccugagagcuugaugacagugcaggagaucgacgacuccaauuuugucgauauuaugcauguuggaaacgugaucucagcggacaauaguugccgccuccaaagcuguacgcacggcucugcuggggauuaccagauuuauuccaccgacucacugaucaaggaugaccacaguagcggacuaaaccuggccgugcuugauccaaaggucaauuccucuuggcucucgugggaaggcugcgacauggauuacuacugcaacgugggugacuggcccacuuguacauauaccgggguuguaacucagaauagcgagucauucuccaaccugauaaauauugaaaaagauuacacacagcgguuucauuuccacaguaagagaaucucugcaaaaggacauaccuugcaacuggacuuaaaggccaggccuaaccaggauggcggugaggugacggcucucaucgaagucgacggcauggagcugcacagcaaaacuauucgacuuuccgggauacggcugaccggauugaagugcucaggcuguuuuucuugcacaagcgggaucaguuguuccgugaaugccaagcucaccagccccgacgaguucacucugcaucuacgcucuacaucaccaaacguuguggucgcagaaaccuccauuaucgcuagaaaaggaccuagugccacaacuagcaaguucaaaguguuuucgguaagggauaccaagaaaauuugcuucgaggucguggaacgggaguauuguaaggacugcucucccgaugaacugacgacauguaccggcguugagcuugagccaccgaaggacauccuccuggaacaccgagguacuauagugcagcaccagaaugauaccugcaaauccaagaucgacuguuggagcaacucaauuaguucuuuugcguccgggaucggagauuucuuuaaacauuacauuggcagcaucgccgucgguauauugggcacaguguuaccuuucgcucugcucauucuguuuuucaucuauggggacaagaugcuuuggcccuuuaaaguuuucugcagaccaugcaggcgcuguugccguaagaacgagggauacaauaagcuggcagaagaggaggaauugcgggauaucauuagaaaauuuucaaagaguggcgagcuaaucaacaaagacgccaaggauaaaaggacucuggcucgccucuucaugagcgacaaucccaagcugaagaaagaaaagaaacuuuccgagauagccuga

SEQ ID NO: 10853 - RNA, 4884 nt, Artificial Sequence
  derived and/or modified CDS sequence (opt3) from NSDV(Jilin)__NC_034391.1__GP
auggugagccuggagaagggccucauccuucuguuguuaaugcacauugccauagcuuccaccgggggaucucugggucuacccggccucaacggggaagaccauacagaugacccugaggucggaggcgaugguccaacugaagaguacacggaagacgauccggagucaaccacaguuaguauccccacuaccccuccagugcuggggcagggaacagaggaaguacccgcaaccagcggcgaggccgaagcgggcuauuccacuacagacgugccugauaccgucucugagaaaguggaggacgaacaagauacgacuccaucgacccagguuacacccgaccagccugagcagucaacuaccagccuuccagauccguggacagcuauuaguaccagaaucgggagggaacuguuguccguggagucugacacgacuaagagcucccucgucacagugggacacccccaacagccuauuuuccuggauggucagccaguagaagagguuacccaucccgugaaugagcgggacgucacugaagcccugcgcaaauacgacaagaugaaaaagcucuuaucacagcgaauccugaguaagaugggcauggcacgugauuuuacagacgaggaacuugauguguggugccacgagagauucgacaacuguagcucuaaugauauagaaaacaggauccgggacuuuuucuugauuuccgaucaaaccgagugcuuugacgaggugcuggucaaacgccuaugugaaucaacgaauccuaucguuggggagccauggcaaguggccggaauuaaggaagagaucguaagaagggaaaugggccggcgcauauuccgauuuuucacccccacacucaaagugacuugcgucagcgguagucugaacccgucugaucaguuugugagauucuaugacccuguuauugagaggaccuccgggcccacaauccagaauuacgauagcaugcauugucuuaacauugagaauggacuggcuaagccaucgaaaaugguggucuugaacgugcucaugacuaccguagaaguucggcuggagucuugccgugcauuuaucaaugcccaccaguguaucuauacacagcacgcugacggccaggugauggucccuaccuucguggaccauuccggcacucgcagaacgauuggggccuacacaaugucauuuaacuuaaccgaugaaaggaaucgggcgugcauaauccgaacuaccugugucgugaagggaaaggagguuaaaaagggucaaagucagcugcgcggcuuccccacaagcauuagacucuucaaauccgugaccgggaagaggcggcuuauggcagaggaaggagacuggacugauugcggcucugguacacagcuggacaugacgauggccguaagcguccacaacgauaaaaagggaggcccagggaaaaaguugaccaucuguaauggcacuacagugucagacaguacccuaaacgaggggcugggaugcuauacaauaaacaagguuauuacugguaaggcuugcaaagugggcaauuccaccgggagcugugaaguccagacggagcuccaaaaaugcgaaaccggaaaguguauccuggugaaacagaagucuaagggcguagugaaacuuaagcgcgguaaaacaguuaucauuacugagugccaggggucaugucuguuugccaucccccaggauaccggcgacauuacaauagauugcaguggaggcagacaacauuacuuggagaucaacauugucgacauccacuguccugggaaggauaaauggaagggauucaugcucuacaucugcagggugagcucccguccacugauugcauuaacuuuuggucuguggcuagcugccggcuaucucauaaccugucuggugucuuucaucauuuacaaugcgguccuuuugcugucgaucgccauuaagaaaguucggcaggggcgagaaaagaaaggagaccucugcaucaagugugagcagcacugcaugaaccuguaugaucaggaacuucaugagcugaauugcagcuuuaacuuguguccguacugcgcaaauagacucuccgacgaaggccugcccaggcacgugccucgcugucccaaaaagucagagcgguuagaggaaauagagcuguauaucaacuacacgagagugcccugcauucuaagguggauccucaguacaucuguacaagucgguaccgcugugaagcgccugagcugguucuccguucuugugacuuuguuuauucugacaaucucaccuguccagggguucccacucgaaagcccaccgauaggcgccgcuaccgacucucgaauuauguauggagugguuggcuuuauguucgcccugaucaugauguuaaaucugaaaaagucccauuacgggaguauuuuucacgugaucgauggauucggccgguguaaccuuugcgacacucguauagauagcuugauggaggaaaccgcacaugaccucuguugcauguuugauuguugcccuuacugucacagaguaucugaguccaaugguucacacugcuuccaugucaggaucugcguggccaaagagauuaguaagaaaaugcugaaggcugggggacgccuauucacaaacaaacuggugagccgggaaggcacguuugcgaauagaauccagcuccuguauaggcgaucgaaggucguuuccacccuugugguaacuguguugcuguuacucguccugcuuaagccaacaaccgcauucgacucugguccccugccugauggcacaugggaggaagaggagaaauuggugcgcaacugugggcaggaaugcauucucgaccaaggagagugucugugccccggcgaacaccgggccgggagaaagcuacuguuucucaauggacugcaggaugcugccaggcguaugacugagagccaucgccuuuugaccucaguuaguaucgacgcaccauggggcgccauaaacauugaauccacguucaaaccugugcuggcugccucuaacaucgauuuaagcuggaacuccgcagaggagcagggugacaagaucauucucucagggcggagcacaggaaucauuaaacugcaagaaagaaccggccuuauguggaagaugaguucugagaaggcguccgaaagcaaaaaucugcuagucucggugauggauuuuucacagcucuacaauucuauauuccaguauaucacuggugacaggagucuguccgaguggcccaaggcuguuuguaccggcgacugcccagaucgaugugggugccagacaagcacuuguuaccacaaagaauggccgcacacccggaacuggcgcugcaauccuacaugguguuggggaauuggcacgggguguaccugcugcggaauggacguggagagauauuuuaacaaguacuucggcgucaaaugggccuuggaguauguaaggacugaugugguugugugcgucgaacugacaaaugaggaacggcauugugacuuagugcaagcagguucucgauuuagcaucgggcccguauccgugacccucucagauccacagaacgucguuaauagacugaguagcaacauuaugacuauccaggagauagccgacaauggaauccuugaucugaugcacgugucuaaggugauuuccgcugaaaacgccugcaaguugcagucauguacacauggcagucccggugaccuccaaauccugcacaccgauaaucuaauuaaaggcgacaugagcgggggaaucaaccuggcacaucuugauccucaggucaauacguccuggaugucuugggagggcugcgaccucgacuacuacuguacugugggggauuggccaucgugcaccuauacaggaguuaacagcauaaacaccgacucauucacuaaucugauuaacacagagaccgauuacacaggcaaguuucacuuccacuccaaacgcaucagugcuagggacgauacuuugcagauggaccugaaggcccgucccaauucuggugggggagaaaugaccguauuaguggaggucaacggccucgaacugcauagcaaacggaucucccuuaagggccugagauugacgaaucucaagugugaugggugcuuugcguguucacagggacugacaugcaccauuacugccaaacuagagucuccugacgaguucaccauacaccugaggagcacaagucgcgaugugguuguggcugaaacuuccgucaccgcacgaaagguggagacgggugccagaagcggcuuccgggcuuuugccguaagggacgucaaaaagcucugccuugaagugguugagaaagauuauuguccgucuugcacaguggaagaccugaagaucugugucgaugugucauuggagccacccaaagacauuuuaaucgagcauaaggggaccauuauccaacacuacaacaaguccugcgacgaaggauauaauuguuggguuggcagugugagcgguuucuuugucggggugaaagauuucuuugagaagaaccugggaggcguacucauaggccuggugucgacuauccuuccucugguuuugacaguccuauucuuuauuuacgggaaaaagcuguucugccucugucgccugugccauaaaaaguguugccguggaucugguagaggccgggacggguauuccaggcuuagccaggaagaggaaaucaaggagauuaucaaaaaguuuucacgcaauggagaguuacugggcaaaggugaaaacgauaagcgaaccguggcaagaauguucauggacgggcagaguacuaaaaaggcgauaaaggagguggccuga

SEQ ID NO: 10854 - RNA, 4884 nt, Artificial Sequence
  derived and/or modified CDS sequence (opt3) from NSDV(708)__EU697952.1__GP
auggugagccuggagaagggcuucuuuuuccuccuucuguugcacaucgucaccgccuccacagggggacccccugguuuaccaggcccgaacgggaaagaccagacugauggacccgaaggcgguggggacggaccuacggaggaauacaccgaggaugacuuugaaucuacaacuuucucaauuccaaccacacccccuguuagugagcaagaugcuaaggaggugagcgcaaccuccgaagaggccgaaguagaggacucuacucugauagugccaaaaacaaugucggagaaggucggcgaugaacagucaaccacgagcaauaugcaagugacuaccagucagcccgagcaguccacaacuggcaugccugggccauggauggcgucuagcaucaaaauuggaagagaacuacucuccguugagucagacaccacaaagaguagccuggugaccgucgguuauccgcagcagcccaucuuucuugauggccagccuguggaagagguaacgcauccaguuucugagagggacguggcugaagcccugcggaaguacgauaaaaugaagaaauugcucucccaacgcauucugucaaagauggggauggcacgagacuucacugaugacgagcuggacgccuggugccacgaacguuuugauaacuguagcaguaaugacaucgagaacagaauaaaagauuucuuucucaucucugaccagacagaaugcuucgaugaggucuuagugaagaggcugugugaguccaccaaucccauuaucggagaaccuuggcaaguggcuggcauuaaggaggaagucguucggcgcgagauggguagaaggaucuuucgguucuuuacuccaacacuuaaagugaccugcguaagcgggucguugaaccccucugaccaguucgugcgcuucuauaauccggucauagaacgaacguccggaccuaccauucagaacuacgauucaaugcauugucugaauaucgagaacggccuaauuaagcccaguaaagugguuauccucaaugugcugaugacaacugucgaggugagacuugaaagcugcagggcauuuguaaacgcccaccaguguaucuauacccagcaugcugacggccaaguucgggugccaacauucgucgaucacuccgggacuaagcguaccauuggagccuacacaaugucuuuuaaucugaccgacgagcgcaacaaagcgugcauaaucagaacuacguguguggucaaggguaaagaagugaagaagggccagagccaguugaggggguucccuacaucaauucggcucuuuaaaaguguuaccggaaagcgacgccugauggcagaggagggcgauuggacugacugcgguuccgggacccaguuagacaugacaaccgccgugagcguacacaaugauagaaaaggcggacccggcaagaaacugacuaucuguaacgggacaacggucucugacucaacccucaacgaaggacuugguugcuauacuauaaauaaggugaugacaggcaaggcuugcaaaguugggaacaguaccggaagcugugaggugcaaccagaacugcagaagugcgagacaggcaaauguauuuuggucaagcagaaaaauaagggugugguaaagcuaaaaagggggaagacugugaucaucaccgaaugccagggcuccugucuguucgccauuccccaagauacgggagacaucaccauugauugcucuggcgggcggcagcauuaccucgagguuaacauagucgacauccacuguccuggaaaagauaaguggaaagguuuuaugcuguacaugugccgcgugucgagcagaccacuuauugcacugacauucggcuuguggcucgcugccggguaucugaucacuuguuuaguguccuuuaucauuuacaaugcgguccugcuacucucaauagccaucaagaagguuaggcagggacgugagcggaaaggcgaccugugcauuaagugugaacagcauugcaugaaccuuuaugaucaagaguugcacgaacugaauugcaguuucaaccucuguccguacugcgcaaaucgacugucugacgagggucuucccagacacgugccuaggugucccaaaaagaccgaacgccuggaggagaucgaauuguauauuaacuacacacgggugccaugcauccucagauggauacugagcacuuccguacaggucgggaccgcugugaaaagguuaucaugguuuagcguucuggugauccuauucguccucacgauuucuccugugcagggcuuuccacuggagaauacacccaucggauccaccacugauagucgcauuaucuauggcguugugggguucauauucgcccuuauuaugauguugaaccugaagaaaagccauuacggaucuaucuuucacguaauugacggcuucggucgauguaaucucugcgauacacggaucgacucccugauggaagagaccgcucaugacuuauguugcauauuugauuguugcccguacugucaccgugucucagaaaguaacgggagccauugcuuccacgugagaaugugcguggccaaggagaucucgaagaaaaugcugaaggcagccggaaggcuuuuuacuaauaaauuggucucccgcgagggcauuuucgcuaaccggguucagcuccuguauagaaggucuaaggugguaagcaccuuuguggucacagugcuacugcuccugguuuuccuucgaccugcgacggcauuugacucagguccauugcccgauggcaccugggaagaggaagaacgccuggugcggaacugugggcaagagugcgucuuagaccaggaugaaugucucugcccuggagagaauagagccggcaggcgucugcuuuuccugaacggguugcaggacgcugugcgccggaugacugaaagucacagacuccugacauccguuucuaucgaugcccccuggggagcaauuaauaucgagagcaccuuuaaaccagugcuagccgcuuccaacauagaccugucauggaauagcgccgaggagcaaggcgauaagauuauccucagugguaggucuacagggaucauuaagcugcaggagcgaacuggacuuauguggcggauguccagcgaaaaagcaucggagucaaagaacuugcuggucucuguaauggacuucagucaguuauacaauuccaucuuucaguauauuaccggcgaucgcagccucucugaauggccuaaagcgguguguacgggugacugccccgauagauguggcugccaaacaagcaccuguuaccauaaggaguggccacacacuaggaacuggcggugcaauccgaccugguguugggggauaggaacaggcugcacuugcugugggauggacguugaaaaauauuucaacaaguacuucggagugaagugggcucuggaguauguccgaaccgacgugguagugugcgucgagcuuacaaaugaagagagacauugugaucugguucaggccggcucccgcuuuucaaucgguccugugagugugacgcuaagcgacccccagaacgucgugaauaggcucucuuccaacauuaugaccauccaggaaauugcagauaaugggauccuggacuugaugcacguuucaaaaguaauaagugccgagaacgcuugcaagcugcaaagcuguacucacggauccccaggcgauuuacagauccuccauacagacaaccugauuaaaggugauaugucuggcgggaucaaucuugcccaccuggacccccaggugaacaccucguggaugagcugggaaggaugcgauuuggacuacuacuguacugucggcgauuggccuucaugcacauauaccgggguuaauuccauuaacacggacaguuucacuaaucucaucaacaccgagacagacuacaccucuaaguuucauuuccacagcaaacguauauccgcacgggaugacacucugcagauggaucuaaaggcuagaccaaauacaggaggcggugagaugaccgugcugguggaagucaacgggcuugagcuccauucaaagaggauuaaucugaaaggauugcgccugacaaacuuaaagugugacggcugcuuugccuguucucaaggccucacuugcaccgugaucgcgaaacugguaagccccgaugaguucacgauccaccuucgaaguacauccagagacgucgugguugccgaaaccagcauuacugcucggaagguggauaccggggcaaggucuucauuucgcgccuucgcuguccgugacgugaaaaagcugugcuuggagguuguggaaaaagauuauuguccuuccugcacagucgacgaucucaagauguguguggacguaagucuggagccgccaaaggauauacuaaucgaacacaaaggaacuauuauccagcauuacaauaagagcugcgacgaggguuauaacuguugggugggcucgguuucuggguuuuucgucggagugaaagacuuuuucgaaaagaaucugggcggugugcuuauugggcucgucggaaccauccugcccuugguauuaacgauacuguucuuuaucuacggcaaaaagcuguucuaucucugcagacuuugucacaagaaaugcuguaagggcuccgggcggggaagggaugguuacagccgcauuucacgagaggaggaaaucaaagagauuaucaagaaauuuaguagaaacggcgaacuguuggggaagggagagaaugacaagcggacaguggccaggauguucauggauggccagucuaccaaaaaggcaauaaaagaaguugcguga

SEQ ID NO: 10855 - RNA, 4875 nt, Artificial Sequence
  derived and/or modified CDS sequence (opt3) from NSDV(779)__HQ286599.1__GP
auggcccugguggcuaagggccucauccuuaugcuguuguuauacauguucaaagcaagcgaggucaaccuggaacuacccuccuggaacucuaccgaggggacagaauaugccgacgagcucccuacugaaccaccgucagaggaggaacccaagcuggcggcuguuaguacggugaccacuccugccccacccaaagagagcacugaagauaccauugaguccccugacggaggugagacaauggcaccaaccacucccgccccuguaacagauucugcuucgaaacuugaagaggaaccaggcaccacgcagcaagcacagucaacucagaugcagaauagccaagccccgauagggaugcccgaggcuuggaguaccuccccuucuagagugggaaggaaaccacugagcgccucccccgacgucucagaaccugaucagaauacagaggcgcagacucacccacccguguuuuuggacggccggccgguugaggaagaggaacauaguguggguacccgcgaugucgcaagcgaccuccgagaguacaaccagaugaagcaacugcugucucagcguauccucgccaagauggggauggcuguggauuucacagacgaugaauuagacaccuggugcuauagaagguacuccaauuguucaagcaacgauauugagagucggauccgcgacuuuuuccugauuacggacagaucugagugcuuugaugaaguacuuguuaaaagguugugugagacuacauccccuaucauagaccgggccuggaagaucgcaggacugaaagaagaggugguccuacgcgaaaugggccgaagaauuuucagguuuuucacccccgcucucaaggugacuugcaugagcggcucgcugaauccaucuaaccaguuugugcgguucuauaauccuacacuugagcguaccuccgggcccacgauccagaacuacgauggaaugcacugucugaauauugagaacgguuugaucaaaccaucaaaggucguugugauaaauguacucaugaccacaguggacauucgccuggaaaguugcagagccuuuaucaacgcgcaacaguguacuuauacccagcaugccgauggcuuagucagggugcccacauucguugggccucacggagagaagcggauuaucggcgcauacacuaugagcuuuaaucugaccgacgaaaagaacaaggcuugcacaaucaaaaccacuuguguggucaaggguaaagaggugaagaaagggcaaucccagcuccgaggauucccaacgacaauucgccuuuucaagucuguaaccggcaagagaaggcugaugagcaacgaggaagaguggacugaaugcggcucagggacccaguugaauauggccacagcuguuagugugcauaacgauaaacuaggagguccgggcaagaaacugaccauauguaaugggacuacagucuccgacaucgcccucaacgagggacugggcugcuacacgauuaauaagaucauaaccgguaaagugugcaagacugggaacacaaccggcagcugugaaguccagcccgagcuucaaaagugcgagacaggaaaauguauucugaucaagcagaaaaauaagggcgugguuaaauugaagcgggggaagacugugaucauuaccgaaugccagggaucuugucucuuugcaaucccucaggauacgggugacauuaccauagauugcucaggcgggcgccaacacuaucuggagaucaacauuguagacauccacuguccaggaaaagacaaguggaaaggcuucauguuauacaucugcagagucaguagcaggccccugguggcccuaacauuugguauuuggcucacugcuggguaucugauaaccugucuugcguccuucaucuuguacaaugcaauucugcucaucucuauugccaucaagaaacugaagcagaagcgugagaaaaagggcgaucuuugcauaaaaugugaacagcauugcaugaaccuguaugaccaggaauugcacgagcucaauugcucguuuaaccuguguccuuacugcgcuaaucgguuaagcgaugacggacugccacgacauguucccagauguccgaagaggggcgagcgccuagaagagaucgaacucuauauuaacuacacacgggugccuugccugcuuagaugggccuuguccacuucaguccaaguggggaccguaaucaaaaggcugaguugguucggagugcuccugacguuauuuuuccugacaauuucuccaguucaggguuuuccccuugagaauccucccaucggcaccgcaacugauagcaacauaauuuacggguuggccggauucaucuuugcucucguccugaugcuaaaccugaagaaaacacacuauggcuccguguuccacgugauugacggucucgggcuguguucacuuugcgauacccgcaucgacagcuugauggaagagacugcccaugagcuguguugcgcauuugauuguugcccauacugucaccaggucucugaauccaauggcagucauugcuuccacaugcgaauaugcguuagcaaggagaucucuaagaaaauguuaaaggcggcuggaaaacucuucaccaacaagcuggugucccgggaaggcuuuuucgccaauaaaauucagcuucuguaucaacguucaaaggugguaaguacauugauccucacgguccugcuacugcucauuauccugaagccugcagccgcuuuugacagcgggccccuuccagauggaaccugggaggaggaagagucguugauaagauccugugaccaggaaugcgugcuggagcaggaugaauguuuaugcccgggcgagcauagggccggucgccggcuccuguuccuuucugggcugcaagacgcagcuagaaggaugacugagagccaccgacuacucacaucaguuaguauugacgccccuuggggagcgaucaacaucgaauccaccuuuaaaccccuguuggccgcuucuaauauugaucugagcuggaacuccgcagaggaacagggcgacaagaucguguuaucaggucgcagcacaggcauuauaaaacuccaggagcggacugggcugauguggaagaugaguucugaaaaagccuccgagagcaagaaucuucuggucucgaucauggauuucucacaguuguacaacucuauuuuucaauauaucaccggagacagaagucucuccgaguggccaaaggcuguguguacgggcgaaugccccgauaggugugggugccagacaagcaccuguuaccacaaagaguggccucauacucguaauuggcgcugcaacccaaccugguguuggggaauuggcacagguugcacuugcugugggauggacguugaacgguauuucaauaaguacuuuggagugaaaugggcccuggaguacguaagaaccgaugucguggugugcgucgaacuaacaaacgaggagaggcacugugaccugguucaggcaggcucucgauucagcaucggucccguguccguaacgcuuucagauccucagaauguggucaaccggcucaguagcucuauaaugaccauccaagaaauuuccgacaauggcauccuggaugugaugcauguuucaaaggugauuagugcggagaacgccugcaaauugcagagcuguacucacggguccccgggagaccugcagaucuuacacacagauaaccucauaaagggcgaaaugucuucggggauuaaucuggcucaucuugacccacaggucaacaccagcuggaugucaugggagggaugcgaccuggauuauuuuuguacugugggcgacuggcccuccugcacauacaccgguguuaauaguaucaacacggauucuuucacuaauuugaucaacaccgagacagacuauaccagcaaguuucacuuccauuccaaacgcauuucagccagaggggauacucuccaaauggaccugaaggcaaggccuaaugugggaggcggugaaaugacaguccuaguagaggugaacggccuggaacuucacucuaaaaagauaagccucaaagggcugaaguugaguaauuuaaaauguuccggaugcuucgcuuguagcccaggccugucuugcaccguuaucgcccggcucgagucacccgaugaauuuacaauucaucugcgauccacaaguagagacguggucguggcagagaccagcguaacggcccgcaaggcugagacaggggcgaagucgucuuucagggccuuugcagugaaagaugucaaggaaaucugccuugagguuguggaaaaagaguacuguccuuccugcagcauugaagaccugaagaucuguauaucagugaccuuggagccgcccaaagauauccuaauugagcacaagggaacuaucguccagcacuauaacaagaguugcgacgaaggcuacaauuguuggauugguucuguguccggguucuuuguuggaguaaaagacuucuuugagaagaacuucggcagcgugaucauaggcauugucucaaccgugcugccacucauccugacaguucuuuucuuuguguaugggcgucgguuauuuugccuguguagacucugccauaaaaaguguugcaggggaaguagccgcggucgagauggcuacuccagauugucucaggaagaggaaaucaaagagauuaucaagaaguucaaucggaacggggagcugcucggaaggggcgaaaaugacaaacgcacugucgcucguauguucauggauagccaauccgccagaaaggccgugaaagagguagcuuga

SEQ ID NO: 10856 - RNA, 4302 nt, Artificial Sequence
  derived and/or modified CDS sequence (opt3) from BUNV__NC_001926.1__GP
augagaauccugauucuccuucuggccgugacccaguuggcugucagcucccccguuauaacaaggugcuuccacggcgggcaauuaaucgcagagcggaagucucagacuucaauuagugaauuuuguaucaaagacgaugugagcaugcugaaguccgagauuguauacacgaaaaacgacaccggaaucuucggucauucuaagguguuucgccacuggacaauaacugauuggaaagccugcaauccugucgugaccgcgggcgggucgaucaacguuauugaaguggacaagaaucuaaaccucgucacacgaaauuauguguguaccggagauugcacuaucacaguagaccguaagaacgcucagauuaucuuccagaccgauaaacugaaucauuuugagguuacgggcacuaccauaucaacagguugguucaagagcaaagccagugugacucuugacagaaccugugaacacauuaaggucuccugcgggaaaaagacacugcaauuucaugcauguuucaagcagcacaugucuugcgugagguuuuugcaccggagcauccucccaggauccauggccauuucaaucugucagaacaucgagcugauuauaaucaccauucuggcucucugcaucuucauaauuaugaucaucuuaacgaaaacuuacauuuguuaugugcugaucccggucuuuaugcccauugcauucgccuacggcugggcuuauaaucgcaguugcaagaaaugcacauguugcggccuugccuaccauccuuuuaccaacugugggagcuauugcguuuguggaucuaaguucgagacuuccgauagaaugaggaugcaccgggaaucagguuugugccagggcuucaaaagccugcgcguggcgcgaagacuauguaagaguaaagggucuucccucauaaucagcauucugcuuucgguacugaucuugucuuuugugacaccaaucgagggaacccucacgaauuaccccaccgaccaaaaguacacacuggaugaaauugcagacgucuuacaggccaagacucaugaggauuccaccaaauauuacauaauccuguauacaucacucuucggcgcuggucuuacuauuaucuuugccgggguggcacugggauugaccauuauccuagagguucugacaaagauaaacgugaucuucugcaaugaauguaacauguaccacaguaaaaagagcauuaaauaugucggcgacuuuaccaauaagugcggcuucuguacuugcgggcuccuggaggacccugaaggagugguaguucacaaggcuaaaaaguccugcacguacucuuaucagaucaacugggugagggguauuaugaucuuugucgccuuccuuuuugugauacagaacacaauuaucauggucgcggccgaggaagauuguuggaaaaaugaggagcugaaggaagacugcgugggcccauugauugcacccaaagauuguaccgacaaggaucauaagacuuaccucagcgaggcuucacuguuagccaccgcuaaaaagaucacacaaguugacgccgaaaacguggagauacuggggaaaaccauggaaagugcaauccggguaauugagcgucagaagacuuaccaccgcaugcaucuacucgaggccgucuuccugaauaaacacugcgauuauuacaagauguuugaacauaacuccggauauagccaggugaaguggagaaugaugaucaaaacacaacacuucgacauuugugcgcuucaggcuaauucuccuuuuugcgcacaguguaucgccgauaacucaugcgcucagggcaguugggaguucgacacgcacaugaauagcaccuacuccucuaagguugauaacuucaaacaugacuuuucguuguuccugaggauauuugaagccgcauucccagguacugccuaugugcaccuccugacaaauauuaaggagaaaaagccguaccaagcugucagcaugaucgaaaagaucaagaagaaauuucccaacaauaaguugcugauuggguauuuggacuucggcaaauaccuccugggauuaucccaugccucaaccuacgagcugcagcagcggcagcuagauaagcucuaucaaccuacagagcugacucgaaguggcgggcagcagaccucucuugcaaacagcgugguaggacaggcgacgaaagaauguaagaaguacaaagacguguccugcuugucaccacgcuuugguaucccccuggaggaucucauuagcuguugcgaccaaccuaauuauaacauauacaagaaaccaaagaaaguuuauaaggcucacgauaaggaagagaccuggugcaucaaugaccagcacugucuggucgauuucgugcccgccgaggcagacacaguggaaaaauuaaagccgaugaaaugcuggcuggucgauccuggcaagaacgacgauguuuacucuauugccaucaaaacuuguagagugguggacaaggggguaugcaccgucaacucccagaaguggaauauuaucaaaugugauaguggaccccuuuauuacagcgaccauauaccaggcgaggacacagguaacgauaucgggcacuacugcgugucugcuggcuguaagacugacagguauccuauuaaucccgauguugugaccgacugcgucugggaauuuacgucccggaaaucacaguacaucggaaagauuaguaugcaaagccuugaggauuaugaaaaagcccucacagaccgccugacccauacucuagagacauacucguucgcaccacuggagaaccucccccacaucaagccuguguauaaauacauaaccgcucagggcguugaaaauuccgaugggauugagggagccuuuaucacugcgucuaucccagccgcugguggcaccagcauuggguauaacgugagaucaaaggacggauucccgcugcuugauuugauaguauuugucaagagugcagugaucaaauccacauacaaucauauuuacgacacgggccccaccaucucuauuaacacuaagcacgaugaacacuguacaggucagugcccuagcaauaucgagcaugaagccaacuggcugaccuucucccaagagaggacaucacguugggggugugaggaguucggcugcuuagcugugaauacuggaugcgucuuuggcagcugucaggacguuauacggccagaaaccaaaguguaucgaaaggccguagaugaaguggucauccucacggugugcauuacauaccccgggcacaccuucuguacugagaucaacgcaauugaaccuaaaaucaccgaggagauagaacugcaguuuaagacaguugacacuaagacccuuccauauauuguggcggucaauaaccauaaacuguacaguggacagaucaaugacuugggcacauucggucaaaugugcgggaacgugcagaagacgaacucuuccauccucggaaccggcacucccaaauuugauuauacaugucacggugccagcagaaaggacauuaucguuaggcgcugcuacaauaacaauuucgauucguguaaacugcuaaaggaggaaacccagcugauauuuaacgacgaucaugacacuauuacaguguauaauaccaaccaccucaucggcgagcuggcuauuaaacuuaucuugggggauauacaguacaaacuguucacggagacuuuagaccuccaaauugaugccaagugcgucggauguccggacugcuuugaaucauacucuuguaauuuccagaucguaaguaacaucgauaccauuugcucccuggagggcccuugcgacacauuucacaaucggaucagcauuaaagcaaugcagcagaacuaugcugugaaacuuucuugucaaaaggacccaagacccagcgggaccuucaagauaugcaauagggaauacacuguuguguuccauacagucgccaaggaugacaaaaucgagauuaacgugggagaucagaccuccuuuaucaaggaaaaagacgaucgcuguaagacauggcugugccgaguacgggacgagggcaucucagugauuuucgagccuauaaaagcauuuuucgguaguuauuuuagcaucuucuuuuacauuaucgucguugugguggucggguuccuaauuaucuauauauuuaugcccauguucaugaagcucaaggaagugcugaaagccaaugagaaguuguaccugcaggaaaucaaacaaaaguga

SEQ ID NO: 10857 - RNA, 4311 nt, Artificial Sequence
  derived and/or modified CDS sequence (opt3) from BUNV(SFCrEq231)__KP063893.1__GP
augaagaugauccugcucauuauaauccuuugcgugaaccuggccgcugcaaaucccgucgccaccagauguuuccacggcgggcaguugauugcggagacaaggagcgcuacuuccaucucugaauuuugcuuaaaagacgauguuucaaugauuaagagugagaucacguacaccaaaaacgacacaggaauauucggucauagcaagaucuauaaauccuggcugauuaaggauuggaagcuauguaauccugugccaacugccggcgggucuaucaacguaauugaaguuaauucggaccucucacugaccacaaaagcauacgucugcagccgggauuguaccaucacuauagacaaggaggaagcccaaauuaucuuucagacagauaaacuuaaccacuucgaggugaguggaaccacgcuguccucuggcugguuuaagacuaaagcuagcguuaccuuggaccgcacaugcgagcauauuaaggugacuugugguaagaaaacccuccaguuccacgcaugcuuucgacaucacauguccuguguccguuucuuucacaauacaauccugccggggaccauggugaacucaaugugccagaauaucgaacugauuauaauccucggauuaacgcugauuaucuucacucuuaugguaauauugacaaagaccuauauuuguuacauccugaugccccuauuuaugccuaucgccuaugcuuacggcugggccuauaacaaaaguugcaagaaaugcaauuguugcggccucgcguaccauccauucacuaacugugggagccacugcguuuguggacugaaguuugaggcaucugauagaaugaggauucaucgggaauccggucuuugccaaggcuacaaaucacugcgcaucgccagauugcucuguaagagcaaggggaguucucugauuauauccacauuacugagcaugcuccuucugucguucaucacccccauugagggaacgaugaccaauuauccugagacaaggcaguacucuuuggaagagaucgcugacguggucgaaggccuacuguccgagcagaacaucaaagaauaugugguguucuacacuucacucuuugguagucugauucuucuguuggccuucauacucagcaucacccugacaaaggucacuaaugcauuagcucggaccaacguuauuuauugcgaggaguguuccauguaccacgccaaaaaggggaucaaauauaacggagauuuuacaaauaagugcggcuucuguaccugcgacgaacaggaggaugaagagggcauuaucauacacaaggugucuaaaaagugcacuuaccgcuaccaacugcagugggcgaaaaucauuaugaucauucuaguaaugcuccugaugaugcagaacacgauccuuauaguggccgcagaaacagacuguuggaccaagaauagcuuggagcuggacugcauugggccacuccugacuaucucagauuguaguaacaaagaguccaagaauuaugaagaggaagcugccaaacuugucagccagucuaaaauuacccaagcugacgccgaacaggugacaauccugggaaacaccauagauacugcauugaaggccauccgaucacagaaaacauaccaaacgaugcaucuccuggaaaguguguuuuuaaugaagaauugcgacuauuacagcuccuucgagcccaacucugguuauucgcaggcuaaauggagacugauugcgaagaccagccacuuugauaucuguuccaggcauucaaugcaccauuucugccgguguguggcagacggcacuaagugccagaauggggauugggacuuugccggagagaugaacaauauuuacaguacaaagaacgauuucuaucuacacgaccucaaucuguuuuucacccuucacgaaacagcuuuuccuggcacuaccgagucuuuguucuaccagcugaucgccaagaaaaacacgaccggugcaagcaagcuccuggggaaauuaauaacaaaguacggcaauaacaaacuguucgucggaauuuggaaguuuggccaauaucuuuugacucucccauacgugaacaccacagaacuguccaagacucgucgcgagaccauccuaaaaacgcaucagauccugacaagaucacaagggggaaggagcgagucuauguccagugccgaaguaggucagauugcuaaggagugugccaaugcaaagaacguuggcugcaucagcccgcgguucgggauucccauaggaaaucucaccgcguguggcaacucuccuaauuauaagaucuacaaaacuccaaacaagauuuauaaguccaauaaccgaggugaaguguggugcucagaggauguccacugccuggcugacuuugaacccgccgacacagagguggucaauaaagugaagaaaaugaccuguuuccuuagugauguuaacacucgcgcagacaucuuuagcauugccaucucggcuugcagaaugguggauaaggggguauguaccgucaauggcgccaaauggaacauauugaagugcgaguccggacuguacuauuucacagaccauagggaaggccaggauacggggaaugacuuuggagaguacuguaucucucacagcugcaacaccgaacgguacccuauuaauccagauaucuuaaaggaguguauuugggaauaucacucacgcaaaaguaaguacaucuccacuauaaaccucgagucucuggaggaguucaaaagagcaaugagcgacaaacuuucccauacacugaugguguauaacuuuaaacccaccgcuaauuugccgcacauuaagccuucauacaaguucaucacagccaacgguaucgagaauagcgauggccucgaaagugcguauauucugucuuccauacccgccaucgggggaaugagcauuggcuacaacauccagacuaaagacaauuuuccacuacuggaucucauuguuuucgugaagucggcugucaucaaaaccacguauaaccauauauacgacacagguccuaccaucgggauuaauacuaaccacgaugagcauugcaccggccccuguccaacaaucauuccccacaaggaaaauuggcugacuuuuucacaggagaggaccucucguuggggaugcgaggaguucggcugucuugcaaucaacacagggugcguguucggaaguugccaggacguaauacacccugaaacgaaaauuuaccggaaggccguggaagaggagguugucuugaccguguguaucaauuuuccaggcaacacuuucugcacagaaaucaaugcuauugagccgaaaaucaccgacgaaauagagcugcaauuuaagacuguggauacaaagaccuuacccaaccuccuggccguccagaaucauaaacuuuauuccggucagauuaacgaccuggggagcuucucucagggauguggcaacguucaaaagacgaaucagagcauccuaggugcaggcacugugaaauuugauuacgugugccacggggcgucccgaaaggacauuaucguaagaagguguuauaccaacaauuacgauucaugcaaacuccugaaggaggaacgcaguuugauauucgccgacaaccaugagacacuggaagucgcuaauacccggcacuuaauuggagagcuccaguuuaagaucaugcugggcgauaucagauauaaagccuucgcagaaaagccugagcuugaaauugacgcuaaauguguggggugcccaagcuguuuugagucuuacuccugcaacuuccaaaucguuacuucaauugauacaguguguagugucgagggacccugcacccuguuucauaauaggauaaucauuacagccgcaaagcagagcuauggcgugaaaauguccugcaagacuaagccugguccaguugaagaguucaccaucuguaaccgcaauuaccgagugucuuucgccacgaucgacaaaaacgauaagauugaaauaaauacaggggaccagaccucguacaucguagagaaagauagccggugcaagacuugguugugucgugucagagacgaaggaauuucagugaucuuugagccccucaaggcuuucuuuggcuccuauuucaguauugcguuuuacaucauaaucgguauugccgcacuguuccuaaucauuuauaucuuucugccgauguucuuuaaacuuagggacgugcucaagaaaaacgaguaccuguauuugcaggaacugaagcacaaauga

SEQ ID NO: 10858 - RNA, 4302 nt, Artificial Sequence
  derived and/or modified CDS sequence (opt3) from BUNV(GSA/S4/11232/WT)__KM507339.1__GP
augagaauccugauucuccuucuggccgugaccaaguuggcugucggcagccccguugugacaaggugcuuccacgggggacaguuaauagcagagcggaaaucccaaacuucuaucucagaauuuuguauuaaggacgauguaaguaugcugaaaagcgagaucguguacacgaagaacgacaccgguauuuucggccauuccaaagucuuucgccacuggacaaucacugauuggaaggccugcaauccugugguuaccgcugggggaucuauaaacgugaucgaagucgacaagaaucuaaaccucgugacacgaaauuauguauguaccggcgauugcacuauuacaguugacaaagagaacgcucagaucauuuuccagaccgaucgucugaaucauuuugaagugacggguacuaccaucucgacagggugguucaagucaaaagccagcgucacucuugacagaaccugugagcacauaaaggugaguugcggcaaaaagacacugcaguuucaugcauguuucaagcaacacauguccugcgugagguuuuugcaccggucuauucucccaggaagcauggccaucuccauuugucagaacaucgagcugaucauuauaaccauccuggcucucugcauuuucaucauaaugauuaucuuaacgaaaacuuacaucuguuauguccugauuccgguuuuuaugcccaucgcauucgccuacggcugggcuuauaaucgcucaugcaagaaaugcacauguugcgggcuugccuaccauccuuuuaccaacuguggaaguuauugcgugugugguagcaaguucgaaacuucugauagaaugaggaugcaccgggaguccggcuugugccagggguucaaaucacugcgcguagcgcgaagacuauguaagagcaaaggaaguucucucauuauauccauccugcuuagcgugcugauuuugucguuugucacaccaaucgaaggcacccucacgaauuaccccaccgaccagaaguacacacuggaugagaucgcagacguguuacaagccaagacucaugaggauucuaccaaauauuacauuauacuguauacaucccucuucggugcugggcuuacuaucauuuuugccggaguugcacugggcuugaccaucauucuagaagugcugacaaagaucaacgucauauucugcaaugaguguaacauguaccacaguaaaaagucaaucaaauaugugggcgacuuuaccaauaagugcggguucuguacuugcggacuccuggaagacccugaggguguaguugugcacaaggcuaaaaagagcugcacguacuccuaucagauuucuugggucaaaggcaucaugauuuuuguggccuuccuuuuugucauccagaacacaauaauuaugguggcggccgaagaggauuguuggaagaacgaggaacugaaagaggacugcguugggccauugaucgcacccaaggauuguaccgacaaggauaggaaaacuuaccucagcgaggcuucacuguuagccaccgcuaagaaaauuacacagguggacgccgaaaauguagaaauccugggaaagaccauggagagugcaauacgggucaucgagcgucagaaaacuuaccaucgcaugcaccuacucgaagccguguuccugaacaagcauugcgauuauuacaagauguuugagcacaauuccggcuauagccaaguuaaauggagaaugaugauuaagacacagcauuucgacaucugugcgcuucaagcgucuucaccuuuuugcgcacaguguauugccgauaacaguugcgcucaggguagcugggaguucgacacgcacaugaacuccaccuacucuucgaaaguggauaauuucaagcacgacuuuagcuuguuccugaggaucuuugaagccgcauucccagggacugccuauguccaucuccugacaaauauaaaagaaaagaaaccguaccaggcuguguccaugauugagaagaucaagaaaaaguuucccaacaauaaacuucugaucggcuauuuggacuucggaaaguaccuccugggcuuaucacacgccaguaccuacgagcugcaacagucucagcuagauaaacucuaucagccuacagaacugacucggagcgggggacaacagaccucccuugcaucaagcguagugggucaggcgacgaaggaguguaagaaauacaaggacguuucuugcuuguccccacgauuuggcauuccccuggaagaucucaucaguuguggggaccagccuaacuauaauauuuacaaaaagcccaaaaaggucuauaaggcucauaacaaagaggagaccuggugcauaaaugaucaacacugccugguggacuucgugccagccgaagcagauacagucgagaaguuaaaaccgaugaaguguuggcugguugacccuggcaaaaacgaugacguguacagcaucgccauuaagacuugccgcgugaucgauaagggaguauguaccgucaauucucagaaauggaacauuaucaagugcgacuccgaucuuuuguauuacucagaccacgugcccggugaagacacagggaacgauauaggccauuacuguguuagugcuggaugcaaaacugacagauauccaaucaauccugauguggucaccgacugugugugggaguuuacgagcaggcggucgcaguacauuggcaagaucuccaugcagucucucgaagauuauaaaaaggcccugacagaccgccuaacccacacucuggagacauacagcuucgcaccccucgagaaccugccacauauuaaacccguuuauaaguacaucaccgcucaagggguggaaaauucagauggaauagagggugccuuuauuacugcgaguaucccugccgcuggcgggaccuccaucggauauaacguaagaucuaaggacggcuucccacuuuuggaucugauugucuuugugaaaagcgcagugauaaaguccacauacaaucacaucuacgacacggguccgaccauuucaaucaacacuaaacaugaugaacacugcacagggcagugucccagcaauauugagcacgaagccaacugguuaaccuucagucaggagaggacaucucguuggggcugcgaggaguucggaugucucgcugucaauacuggcugcguuuuuggguccugccaagacgugauccggccugaaaccaagguauaucgaaaagccguggaugaaauagucauccugacgguguguauuacauacccaggacauaccuucugcacugagaucaacgcaauugaacccaagaucaccgaggagauagaacuucaguuuaagacaguugacacuaaaacccugccuuauauuguggcggucaauaaccacaaguuguacagcggccagaucaaugaccucgguacauucgggcagauguguggaaacgugcagaaaaccaauucgucaauccugggcacggguacuccaaaguuugauuauacaugccauggcgccucuagaaaagacauuaucguuaggcgcuguuacaacaacaauuucgauaguugcaagcuacugaaggaggaaacccaacucauauuuaacgacgaucacgacacuauuacaguguauaauaccaaccaucugaucggggagcuugcuauuaaauugauccugggagauauacaguacaaguuauucacggagacucucgaccugcagauugaugccaaaugugucggcugccccgacuguuuugaauccuacagcugcaauuuccaaaucguaucuaacaucgauaccauuuguaaucuugaggggccgugcgacacauuucacaaccggaucagcauuaaggcaaugcagcagaauuaugcugugaaacuguccugccagaaggacccuggaccaucaggcaccuucaagauauguaacagagaauacacuguuguguuccacacagucgccaaagaugacaagaucgagauuaaugugggugaucaaaccaguuuuaucaaagaaaaggacgauaggugcaaaacauggcuaugucgcguacgagacgaggggaucagcgugauuuucgagcccauaaaggcauuuuucggaucuuauuuuuccaucuucuuuuacauuaucauuaucgucguugugggcuuccucauaaucuauauuuuuaugccuauguucaugaagcugaaagaaguguugaaggccaacgagaaacuguacuuacaggaaaucaagcagaaauga

SEQ ID NO: 10859 - RNA, 4302 nt, Artificial Sequence
  derived and/or modified CDS sequence (opt3) from BUNV(MGD/S1/12060/WT)__KM507340.1__GP
augagaauccugauucuccuucuggccgugaccaaguuggcugucggcagccccguugugacaaggugcuuccacgggggacaguuaauagcagagcggaaaucccaaacuucuaucucagaauuuuguauuaaggacgauguaaguaugcugaaaagcgagaucguguacacgaagaacgacaccgguauuuucggccauuccaaagucuuucgccacuggacaaucacugauuggaaggccugcaauccugugguuaccgcugggggaucuauaaacgugaucgaagucgacaagaaucuaaaccucgugacacgaaauuauguauguaccggcgauugcacuauuacaguugacaaagagaacgcucagaucauuuuccagaccgaucgucugaaucauuuugaagugacggguacuaccaucucgacagggugguucaagucaaaagccagcgucacucuugacagaaccugugagcacauaaaggugaguugcggaaagaagacacugcaguuucaugcauguuucaagcaacacauguccugcgugagguuuuugcaccggucuauucucccaggcagcauggccaucuccauuugucagaacaucgagcugaucauuauaaccauccuggcucucugcauuuucaucauaaugauuaucuuaacgaaaacuuacaucuguuauguccugauuccgguuuuuaugcccaucgcauucgccuacggcugggcuuauaaucgcucaugcaagaaaugcacauguugcgggcuugccuaccauccuuuuaccaacuguggaaguuauugcgugugugguagcaaguucgaaacuucugauagaaugaggaugcaccgggaguccggcuugugccagggguucaaaucacugcgcguagcgcgaagacuauguaagagcaaaggaaguucucucauuauauccauccugcuuagcgugcugauuuugucguuugucacaccaaucgaaggcacccucacgaauuaccccaccgaccagaaguacacacuggaugagaucgcagacguguuacaagccaagacucaugaggauucuaccaaauauuacauuauacuguauacaucccucuucggugcugggcuuacuaucauuuuugccggaguugcacugggcuugaccaucauucuagaagugcugacaaagaucaacgucauauucugcaaugaguguaacauguaccacaguaaaaagucaaucaaauaugugggcgacuuuaccaauaagugcggguucuguacuugcggacuccuggaagacccugaggguguaguugugcacaaggcuaaaaagagcugcacguacuccuaucagauuucuugggucaaaggcaucaugauuuuuguggccuuccuuuuugucauccagaacacaauaauuaugguggcggccgaagaggauuguugggagaacgaggagcugaaggaagacugcguugggccauugaucgcacccaaagauuguaccgacaaggauaggaagacuuaccucagcgaggcuucacuguuagccaccgcuaaaaagauuacacagguggacgccgaaaauguagagauccugggaaaaaccauggagagugcaauacgggucaucgaacgucaaaagacuuaccaucgcaugcaccuacucgaggccguguuccugaacaaacauugcgauuauuacaagauguuugaacacaauuccggcuauagccagguuaaguggagaaugaugauuaaaacacagcauuucgacaucugugcgcuucaagcgucuucaccuuuuugcgcacaguguauugccgauaacaguugcgcucaggguagcugggaguucgacacgcacaugaacuccaccuacucuucgaagguggauaauuucaaacacgacuuuagcuuguuccugaggaucuuugaagccgcauucccagggacugccuauguccaucuccugacaaauauaaaggagaaaaagccguaccaggcuguguccaugauugagaaaaucaagaagaaauuucccaacaauaaacuucugaucggcuauuuggacuucggaaaauaccuccugggcuuaucacacgccaguaccuacgaacugcaacagucucagcuagauaagcucuaucagccuacagagcugacucggagcgggggacaacagaccucccuugcaucaagcguagugggucaggcgacgaaagaauguaagaaguacaaagacguuucuugcuuguccccacgauuuggcauuccccuggaggaucucaucaguuguggggaccagccuaacuauaauauuuacaagaaaccaaagaaagucuauaaggcucauaacaaggaggaaaccuggugcauaaaugaucaacacugccugguggacuucgugcccgccgaggcagauacagucgaaaaauuaaagccgaugaaauguuggcugguugacccuggaaagaacgaugacguguacagcaucgccauuaaaacuugccgcgugaucgauaagggcguauguaccgucaauucucagaaguggaacauuaucaaaugcgacuccgaucuuuuguauuacucagaccacgugcccggugaggacacagggaacgauauaggccauuacuguguuagugcuggaugcaagacugacagauauccaaucaauccugauguggucaccgacugugugugggaauuuacgagcaggcggucgcaguacauuggcaaaaucuccaugcagucucucgaggauuauaagaaagcccugacagaccgccuaacccacacucuggagacauacagcuucgcaccccucgaaaaccugccacauauuaagcccguuuauaaauacaucaccgcucaagggguggaaaauucagauggaauagaaggugccuuuauuacugcgaguaucccugccgcuggcgggaccuccaucggauauaacguaagaucuaaggacggcuucccacuuuuggaucugauugucuuugucaagagcgcagugauaaaauccacauacaaucacaucuacgacacggguccgaccauuucaaucaacacuaagcaugaugagcacugcacagggcagugucccagcaauauugaacacgaggccaacugguuaaccuucagucaggagaggacaucucguuggggcugcgaagaguucggaugucucgcugugaauacuggcugcguuuuuggguccugccaagacgugauccggccugaaaccaaaguauaucgaaaggccguggaugagauagucauccugacgguguguauuacauacccaggacauaccuucugcacugaaaucaacgcaauugagcccaaaaucaccgaggaaauagagcuucaguuuaagacaguugacacuaagacccugccuuauauuguggcggucaauaaccacaaauuguacagcggccagaucaaugaccucgguacauucgggcagauguguggaaacgugcaaaagaccaauucgucaauccugggcacggguacuccaaaauuugauuauacaugccauggcgccucuagaaaggacauuaucguuaggcgcuguuacaacaacaauuucgauaguugcaaacuacugaaggaagagacccagcucauauuuaacgacgaucacgacacuauuacaguguauaauaccaaccaucugaucggggagcuugcuauuaaguugauccugggagauauacaguacaaauuauucacggaaacucucgaccugcagauugaugccaagugugucggcugccccgacuguuuugaguccuacagcugcaauuuccaaaucguaucuaacaucgauaccauuuguaaucuugaagggccgugcgacacauuucacaaccggaucagcauuaaagcaaugcagcagaauuaugcugugaagcuguccugccagaaagacccuggaccaucaggcaccuucaagauauguaacagagaguacacuguuguguuccacacagucgccaaggaugacaaaaucgaaauuaaugugggugaucaaaccaguuuuaucaaggagaaagacgauaggugcaagacauggcuaugucgcguacgagacgaggggaucagcgugauuuucgaacccauaaaagcauuuuucggaucuuauuuuuccaucuucuuuuacauuaucauuaucgucguugugggcuuccucauaaucuauauuuuuaugccuauguucaugaagcugaaggagguguugaaagccaacgaaaagcuguacuuacaggagaucaaacagaaguga

SEQ ID NO: 10860 - RNA, 4308 nt, Artificial Sequence
  derived and/or modified CDS sequence (opt3) from Ab-BUNV(Cu20-XJ)__KJ710423.1__GP
auggccaucagcauugugcugaugauaaucuucuccaccacaucuugccucgcuagagcagcccccucaauuaguaaguguuuucaggacggcguccuuaucgcggagaaaaagagcuccucugggauuucggaguucugcaucaaagaugacauaucaauccuaaagagcgaaauuaacuacaguaaaaaugauacuggaaucuuuaugcacuccaagguuuucaggcauuggacgguggcugacuggaagcaaugucagccuauuccaucugccgguggcagcaucaacguauuggaaguggauaaaaauuuaaaccuggucgcaaagaauuauaugugcacccggccgugugugauaacaauugacaaagagaacgcccagcuacucuuucagacugaacaacugaaucaguucgagguuaccgggacaaccaucuccacuggaugguuuaagucaaaaacaagugugagccuugauaauaccugcgagcacauuaaggucacguguggcaagaaaucucugcaguuccaugcuugcuuuaagcagcacauguccugugugcgcuucuugcaucgaucaguacuccccgguuacauggcaaacagcaucugccaaaacaucgaacugauuauaaucauuacucugacccucgccaucuuuauauucauguguauuaucacacguacuuauaucugcuacauuauguuaccucuguuugcuccaaucgccuauauuuacggguggcuuuauaauagaaguugcaaaaaguguauaugcuguggauuggcguaccaccccuucaccaacugcggcucuuacuguguuugcggcuccagguucgagacaagcgaccggaugcgccugcacagagaaucggggcuaugucagggauuuaaaucucucaggguggcacggacccugugcaaguccaaagguucaagucuugucaucagcgugcugacggccauguugauucucuccuucgugacuccucuggaggcuaucucuacaaauuauccaaccgaucgcaaguacacuuuaaacgaggucaaugacaucguucugggcaaggggacagaaaacgagcucaaaaccagcauucuugcccuggugucaauauguggaaucggcauuaucauuaucuuuauagcauugacgaugcuacuggauaucguacucgaagcuauugccaagcgaaguaccaucuucugcacagaguguaaccugauucaugacaaaaaggcgaugaaauuugugggugauuucacuaauaagugcggguuuugccccuguggagaacuugaggacccugagggccuggucauccacaccacaagaaaguccugcacuuauuacauaaaaauuaggaacuugaagcucaucaugcugguguucagcauugccaucuuaaugcagaauaccgcaaugcugguuguggcugacgaaaacuguuggacaaauaccgagauaaaagccgauugcgucggcccacuaaucgggccgacuacguguacaaacaagggaucuaaaaccuauaaggcuguggcccaggaacucguaacuucaaauaagauuacccaacuggacgcagauaaauacacacuuuugggugacaccaucgagagugcccugagcgcuauuacugaacagaagcauuauuccgcgauccaccuccuggagacaauauuucuuaugaaacacugcgauuacuacaagguuuaugagcauaacucuggcuacucgcagacgaaauggcggcugauugcaaagaccaauagcuucgacaucuguuccauccccucaacuccuaacuuuugcaaguguuugagugauucuagcugcuccacaucaacccucaauuucgccacaagcaugaacucuacuuauaccuccaaagcugaauacuuuaaucacgacuucacgcuguucuuaaacauuuuugaggccgcauucccagggagugccaccgcuuuucuguucaagaaaaucaaggaaaaagcccccuaucaagcauuugagaugaugggaaagauugcgaauaaauacccuaacaacaagcuacucgugguccugcuuaaguauggccaguacaugguggguuugagccaugcuucuacauaccagcugaaacaggaauggauagccaagucccucucacugguccguaguacuaaaaccggguuaaagauggcaaugacaaaugccgagccaggccccgcuacuaaagaguguagcgaugccaagaccaucgcaugccugacgccgaaguuccaaguggaaguuaacaaucuuaugucgugcggagcuuccccuaacuuuaaaauuuauaugaagucuggcgaguuguacaaagcccacgaccgcaauagcguguggugucucaacgauaugcauugccugacacccuauaccccagcgaaugccgaacugguagcuacuaugaagaaaauggaguguuggcaggacaacccuaagcagcccacaaaugacuacgcaaccccaagaaggucaugccagaugaaggaucgggggcuguguaacgucggagccgacaaauggaaggugaucaaaugcgaugacgaucucauguucuauacugacgcucuggagagucccgauccugccgcagacauuggucaauacuguuuuuccgaaaagugccagaucgagcgauauccaauaaauccgaccucucuuacaaacugugaaugguuguaccgcgcgguuaaaccccaguacaucaagagacugagcuuacagacgauugaggaauauaagaaagccaucaccgauaagcucacucacacacugcaacuuuaccacuucgcuccucuggagaauuugccacauauuaggcccaccuaugaguacaucacagcccagggcacuuauaccgcagacgggauagaaggagcuuccauuaucacgucaaucccugcccucagcggcacaaguguggguuuuaaaauuaacgcaaaggaugggaccgcccugcuagacauagucguguacaucaaaucuuccguaguuaagagcguguauaaucacauuuacgauacuggcccaaccaucaacauuaacucgaaacaugacgagcugugcacaggacagugucccaagcggaucccggcugacccuaauuggcucacuuucucacaggaacgcaccucuagauggggcugcgaggaauuugggugccuggcgauaaacacaggaugugucuacgguaguugccaagaugugaucaggacggagaccaagguguaucguaaagccaaugaggaaacugucaugcuuacaguuuguauuaccuacccaggccacacuuucugcacagacgugaacgcauuggagcccaagaucaccgaugaacuggaguuacaguucaaaacgauugacaucaagucccucccuaaucugguggcuauaacuaaccacaaacuuuauaccgggcagauuaaugaucugggaacauuuggccaaaugugugguaacguacagaagaccaauacuagcauccuaggggccggcacacccaaguucgacuauaccugcuacucugccagccggaaagauaucauuauccgaagauguuacaacaauaacuaugacuccugcaggcuccugaagcaggaaggagauuugcuguuugacgauaaucaugagacauuaauagucuacaacaauaaacgccucaacggcgagcugacuaugaaguugcuguugggggacauucaguacaaacucuauaccgaaaacauggagcuggaacuagaggcuaagugugugggaugcguuggcuguuucgagucauaccaaugcaaucugcagaucacgaguagccuugaugguaacugcgcaauuucugggccaugugaaacauuucacgaccggauccagauaaagaccacuaaaaaggacuaugcccucaaacuggcgugcaccaaggauccuggagacaaagcuacauucagaguguguggcaaggauuacgacuuuaauuuccauacugucgugaagaacgauaaaauugagguuaaugugggugacgaaaccuccuauaucaaggagaaagaugccaggugcggcacgugguugugucgcguacgagacgaagggcugucagucaucuuugagcccuuaaagaacuucuuuggaaauuaccucaacauguuccuguauauucuuggcggggugcugcuucucuuccugagucuauacaucauuaugccagugugcgcacggcugcgugaugagcuuaaaaagaaugaaaagcuccaccagauggagaugaaaaagagauga

SEQ ID NO: 10861 - RNA, 4305 nt, Artificial Sequence
  derived and/or modified CDS sequence (opt3) from ANADV(EIV-13128Kam)__KT313718.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucacuuaucucaaaaacgacaccggaauuuucgcccauagcaagguacuaaggaauuggaucauaaaagauuggaagaacugcaauccagugccgacagcggguggcuccaucaacgucauugaagugaauaccgaccugucucuuucgacuaagacauacguuuguucacgggauugcaccaucacgguggacaaagaggaugcucaaauuaucuuucagacugacaagcugaaccacuucgaagucagcgggaccacauugaguuccggaugguuuaaaacuaaggccucugugacccucgaucgcacaugugagcauauaaaaguaaccugcggcaagaagacgcugcaguuccacgcauguuuuaaacaucacaugagcugcauucgauucuuucacaauacuauccugcccgguacaauggccguuuccauuugucagaacaucgagcucaucauuauaaccucauuaacucugaucauuuucauccuuauggugauauugacaaagaccuauauuugcuacguccugaugccucuauuuaugccaguggcuuaucucuacgggugggcauauaaucguaguuguaaaaagugcagcugcuguggacuggccuaccaucccuucacgaacugcggcucucacugugugugcggccuuaaauucgaggcuuccgacagaaugaggauccaucgggagucagggcugugucaaggauacaagagcuugcgcgucgccagacuccugugcaaaaguaaggguucuuccuuaaucauuagcauccugcucucgguucuuauucugucuuuugugaccccuauagaaggcacauugacuaauuauccagaguccaagaaauacucacuagaggaaaucgcggauguaauugagggguucaucgcagaaaagggaaucaaagaguauauugugcuguacaccaguauauuuggcgcccuccugcuucugaucgcuuugauuaucacagucagccucaacaggauuacugaauaucugaccaauuuaaacgugaucuacugucacgagugcuccauguaucacucuaagaaaaauauaaaguacaucggugacuucacaaacaaguguggguuuugcaccuguggagagcuggaagaucaggagggccuaaacaugcauaaaguuagcaagaaaugcauuuaccgguaucagcucacuuggucaaaggugaucaugacgauucuggucugccuuuugaucgcccagaauacagugcugauaguagcagcuaacgacgacuguugggccaaacaaagucucgaaauugagugcguuggcccccugcaacagguggaugcgugugaagacaaguccagccgcucuuacaauggggaggccaagaaacuugucggaaccucaaaggugacugagcuggaugcaggucaggucaacuugcucggccagaccaucgaaagugcuauuaucgccauacgaaaacagagaacauaugcuaccaugcacuuccuggagagcguguuuuuagggaggcauugcgacuacuauaagguuuucgaacacaauuccggauacucucaggccaaauggcggcugcuagcaaagacuaaccauuuugauaucuguucgcgucacagcacacaccauuucugccgcuguauguccgacggcacgaagugcgagaaugguaacugggauuuugccggggaaaugaauaccacuuaucacucaaaaagagacuucuuuaagcaugauuucaaccucuucuguacacugcuugagaaugcuuuuccuggcaccacagagaguuuguacuaccaacugcucucuaaaaggaacacuaccggagcgagcaagcuguuaggcaaacugauuacgaaguucgggaauaacaaucuuuuugugggaaucuggaaauucggucaguuuuugcucucccugccauauguaaacaacaccgaacuaucagcacugcagagcucuaagauucucgaguccccggaaccccugcuucggagugccagcggccgacaggagucuuuguccucaacaacuccuggggaggcuaguaaggaaugccgcaaugccaaaaagaucagcuguauaucgccaagauucggaguccccauggagaaccugaccgcaugcggcgaauccccuaauuacaaaauuuauaagacaccaacuaggaucuacaaaucuaacaauaagggugagaucuggugcgccggggacgugcacuguuuucaagaauuuacccccguuuuacaggagguggucgauaagcucaaaaagaugacgugcuuucugacagagccggaagcugaggaagacgccuucagcauugcaaucgcgauguguaaaauucuugacaagggcgugugcaccauaaacucagagcgguggaauaucauuaaaugugauaguggacugauguauuacacugaccagcgcgauggccaggacacagggaacgauuuuggagaauauugcaucucccacaauuguaagaccgagagauucccuauuaaccccucuaucauaagcgacugcaucugggaguaccauuccaggaagucacguuacauuagcacuuugaaucucgaaagucuggaggaauuuaaacgggcuaucucugagaagcuaucccacacccugguaguguaucaauucaaaccaacaagcaaccucccucauaugaagcccguuuacaaauauauuacggcccagggugucgaaaauucggauggcaucgacucagcauucauaaccgccucuaugccagcucugagugggacuuccauuggauacaacgugaugagcaaggauaauuuuccccuuuucgacaucaucauuuuuauaaagucugccgugaucaaaacaaccuauaaccacauuuacgauacaggcccuacuaucgguauuaacgucaugcaugacgagcacuguaccgggcagugcccaaucgagauaccgcacaaggaaaauugguugacguucagccaggagcgaacauccagauggggcugugaagaguuuggaugccuggcaaucaacaccggcugcguuuucgggucaugucaagauauuaucaggcccgagacuaaaguguaucgcaaggcuauugaagagaguguguuacucaccguaugcgucacauacccuggaaauacuuuuuguaccgaaaucaacgccauagagccaaaaauuacagacgaacuggagcuucaguucaagacgguggacaccaaaacucugcccaaucuacucgcgguucagaaccauaagcuguacagcggccagaucaaugauuuggguucuuuugcccaagggugcggaaacauccagaagacaaaucuguccgugauuggcaccgguacugcuaaauucgacuauaucugucacggcgcaucacggaaggauauagucgugagaaggugcuacaacaauaacuaugagaguuguaaauuacucaaggaagaaccuagccugauuuucuccgacaaucaugaaacaaucgagguugccaacauucgccaccuucugggggaauugcaguucaaacucaugcugggagaucuacgauacaagucuuucgcugagaauccagagcuggaaaucgaggccaagugcgugggcugucccucgugcuuuagcucauauuccuguaacuuccggauaaguucuagcauugacaccguaugcgcaaucgaugggccgugcacgaucuuucauaaccgucuuauuaucuccucaacuaaacaagacuacggaauuaagaugucuuguaaagaaaagccuaauccagucgagaaauucaacauaugcaagagaaucuauagcgugcucuuuaccacaauugauaagagugacaaaaucgaaaucaauaccggcgaucagacuuccuucauucaggagaaggacgauagguguaaaacauggcugugccgcgugcgggacgaggguauaagcgucaucuuugaacccauuaaggcguucuuugggucuuacuucucaaucgccuuuuacguugugauuggaaucauagcuuuguucaucaccauuuauaucuuucugccuaugguauucaaauuaaaggacauucucaagaaaaacgagcugcuuuaccugcaggaaaugaaguauaaauga

SEQ ID NO: 10862 - RNA, 4305 nt, Artificial Sequence
  derived and/or modified CDS sequence (opt3) from ANADV(EIV-13130Kam)__KT313721.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucacuuaucucaaaaacgacaccggaauuuucgcccauagcaagguacuaaggaauuggaucauaaaagauuggaagaacugcaauccagugccgacagcggguggcuccaucaacgucauugaagugaaugcugaccugucucuuucgaccaagacuuacguuuguucacgggauugcacaaucaccguggacaaagaggaugcccaaauuaucuuucagacggacaagcugaaccacuucgaagucagcgggacuaccuugaguuccggaugguuuaaaacaaaggcaucugugacucucgaucgcaccugugagcauauaaaaguaacaugcggcaagaagacccugcaguuccacgccuguuuuaaacaucacaugagcugcauucgauucuuucacaauacgauccugcccgguacuauggcuguuuccauuugucagaacaucgagcucaucauuauaacaucauuaacccugaucauuuucauccuuauggugauauugacuaagacauauauuugcuacguccugaugccucuauuuaugccaguggcauaucucuacgggugggccuauaaucguaguuguaaaaagugcagcugcuguggacuggcuuaccaucccuucaccaacugcggcucucacugugugugcggccuuaaauucgaagccuccgacagaaugaggauccaucgggagucagggcugugucaaggauacaagagcuugcgcgucgcgagacuccugugcaaaaguaaggguucuuccuuaaucauuagcauccugcucucgguucuuauucugucuuuugugacgccuauagaaggcaccuugacaaauuauccagaguccaagaaauacucacuagaggaaaucgcagauguaauugagggguucaucgccgaaaagggaaucaaagaguauauugugcuguacaccaguauauuuggcgcucuccugcuucugaucgccuugauuaucacugucagccucaacaggauuacagaauaucugacuaauuuaaacgugaucuacugucacgagugcuccauguaucacucuaagaaaaauauaaaguacaucggugacuucaccaacaaguguggguuuugcacauguggagagcuggaagaucaggagggccuaaacaugcauaaaguuagcaagaaaugcauuuaccgguaucagcucaccuggucaaaggugaucaugacuauucuggucugccuuuugaucgcacagaauacggugcugauaguagcugccaacgacgacuguugggcgaaacaaagucucgaaauugagugcguuggcccccugcaacagguggaugccugugaagacaaguccagccgcucuuacaauggggaggcaaagaaacuugucggaacaucaaaggugaccgagcuggaugcuggucaggucaacuugcucggccagacuaucgaaagugccauuaucgcuauacgaaaacagagaaccuaugccacaaugcacuuccuggagagcguguuuuuagggaggcauugcgacuacuauaagguuuucgaacacaauuccggauacucucaggcaaaauggcggcugcuagccaagaccaaccauuuugauaucuguucgcgucacagcacucaccauuucugccgcuguauguccgacggcacaaagugcgagaaugguaacugggauuuugcuggggaaaugaauacgaccuaucacucaaaaagagacuucuuuaagcaugauuucaaccucuucuguacucugcuugagaaugcguuuccuggcacaaccgagaguuuguacuaccaacugcucucuaaaaggaacacaacuggagcaagcaagcuguuaggcaaacugauuaccaaguucgggaauaacaaucuuuuugugggaaucuggaaauucggucaguuuuugcucucccugccauauguaaacaacacggaacuaucagcccugcagagcucuaagauucucgaguccccggaaccccugcuucggagugcuagcggccgacaggagucuuuguccucagccaccccuggggaggcaaguaaggaaugccgcaaugccaaaaagaucagcuguauaucgccaagauucggaguccccauggagaaccugacagcuugcggcgaauccccuaauuacaaaauuuauaagacuccaaccaggaucuacaaaucuaacaauaagggugagaucuggugcgccggggacgugcacuguuuucaagaguucacacccguuuuacaggagguggucgauaagcucaaaaagaugacuugcuuucugaccgagccggaagcagaggaagacgcguucagcauugcuaucgccauguguaaaauucuugacaagggcgugugcacgauaaacucagagcgguggaauaucauuaaaugugauaguggacugauguauuacacagaccagcgcgauggccaggacaccgggaacgauuuuggagaauauugcaucucccacaauuguaagacugagagauucccuauuaaccccucuaucauaagcgacugcaucugggaguaccauuccaggaagucacguuacauuagcacauugaaucucgaaagucuggaggaauuuaaacgggcaaucucugagaagcuaucccacacccugauuguauaucaauucaaaccaacuagcaaccucccucauaugaagcccguguacaaauauaucaccgcccaggguguugaaaauucggauggcauagacucagcuuucauuacagccucuaugccagcacugagugggacguccaucggauacaacgucaugagcaaggauaauuuuccccuuuucgacaucauuauauuuaucaagucugcugugauuaaaaccacuuauaaccacaucuacgauacaggcccuaccauugguaucaacgugaugcaugacgagcacuguacagggcagugcccaauagagaucccgcacaaggaaaauugguugacuuucagccaggagcgaaccuccagauggggcugugaagaguuuggaugccuggccauuaacacgggcugcgucuucgggucaugucaagauaucauuaggcccgagacaaaaguuuaucgcaaggcgaucgaagagaguguguuacucaccgugugcguaacuuacccuggaaauaccuuuuguacagaaauaaacgccauugagccaaaaaucacugacgaacuggagcuucaguucaagaccgucgacacaaaaacgcugcccaaucuacucgcugugcagaaccauaagcuguacagcggccagaucaaugauuuggguucuuuugcacaagggugcggaaacauucagaagaccaaucuguccguuaucggcacugguacagccaaauucgacuauauaugucacggcgcuucacggaaggauauuguggucagaaggugcuacaacaauaacuaugagaguuguaaauuacucaaggaagaaccuagccugaucuuuuccgacaaucaugaaaccauugagguggccaacauccgccaccuucugggggaauugcaguucaaacucaugcugggagaucuacgauacaagucuuucgcagagaauccagagcuggaaauagaggcgaagugcguuggcugucccucgugcuuuagcucauauuccuguaacuuccggauuaguucuagcaucgacacugugugcgccaucgaugggccgugcacaauuuuucauaaccgucuuaucauuuccucaaccaaacaagacuacggaauaaagaugucuuguaaagaaaagccuaauccaguagagaaauucaacaucugcaagagagucuauagcgugcucuuuacgacuauugauaagaaugacaaaaucgaaaucaacaccggcgaucagacaaguuucauucaggagaaggacgauagguguaaaaccuggcugugccgcgugcgggacgaggguauauccgucaucuuugaacccauuaaggcuuucuuugggagcuacuucucuaucgccuuuuacguugugauuggaaucauagcauuguucaucacuauuuauaucuuucugccuaugguauucaaauuaaaggacauucucaagaaaaaugagcugcuuuaccugcaggaaaugaaguauaaauga

SEQ ID NO: 10863 - RNA, 4305 nt, Artificial Sequence
  derived and/or modified CDS sequence (opt3) from ANADV(EIV-13395Mg)__KU159765.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucacuuaucucaaaaacgacaccggaauuuucgcccauagcaagguacuaaggaauuggaucauaaaagauuggaagaacugcaauccagugccgacagcggguggcuccaucaacgucauugaagugaaugcugaccugucucuuucgaccaagacuuacguuuguucacgggauugcacaaucaccguggacaaagaggaugcccaaauuaucuuucagacggacaagcugaaccacuucgaagucagcgggacuaccuugaguuccggaugguuuaaaacaaaggcaucugugacucucgaucgcaccugugagcauauaaaaguaacaugcggcaagaagacccugcaguuccacgccuguuuuaaacaucacaugagcugcauucgauucuuucacaauacgauccugcccgguacuauggcuguuuccauuugucagaacaucgagcucaucauuauaacaucauuaacccugaucauuuucauccuuauggugauauugacuaagacauauauuugcuacguccugaugccucuauuuaugccaguggcauaucucuacgggugggccuauaaucguaguuguaaaaagugcagcugcuguggacuggcuuaccaucccuucaccaacugcggcucucacugugugugcggccuuaaauucgaagccuccgacagaaugaggauccaucgggagucagggcugugucaaggauacaagagcuugcgcgucgcgagacuccugugcaaaaguaaggguucuuccuuaaucauuagcauccugcucucgguucuuauucugucuuuugugacgccuauagaaggcaccuugacaaauuauccagaguccaagaaauacucacuagaggaaaucgcagauguaauugagggguucaucgccgaaaagggaaucaaagaguauauugugcuguacacuuccauauuuggcgcucuccugcuucugaucgccuugauuaucaccgucagccucaacaggauuacagaauaucugacuaauuuaaacgugaucuacugucacgagugcuccauguaucacucuaagaaaaauauaaaguacaucggugacuucaccaacaaguguggguuuugcacauguggagagcuggaagaucaggagggccuaaacaugcauaaaguuagcaagaaaugcauuuaccgguaucagcucaccuggucaaaggugaucaugacuauucuggucugccuuuugaucgcacagaauacggugcugauaguagcugccaacgacgacuguugggcgaaacaaagucucgaaauugagugcguuggcccccugcaacagguggaugccugugaagacaaguccagccgcucuuacaauggggaggcaaagaaacuugucggaacaucaaaggugaccgagcuggaugcuggucaggucaacuugcucggccagacuaucgaaagugccauuaucgcuauacgaaaacagagaaccuaugccacaaugcacuuccuggagagcguguuuuuagggaggcauugcgacuacuauaagguuuucgaacacaauuccggauacucucaggcaaaauggcggcugcuagccaagaccaaccauuuugauaucuguucgcgucacagcacucaccauuucugccgcuguauguccgacggcacaaagugcgagaaugguaacagagauuuugcuggggaaaugaauacgaccuaucacucaaaaagggacuucuuuaagcaugauuucaaccucuucuguacucugcuugagaaugcguuuccuggcacaaccgagaguuuguacuaccaacugcucucuaaacggaacacaacuggagcaagcaagcuguuaggcaaacugauuaccaaguucgggaauaacaaucuuuuugugggaaucuggaaauucggucaguuuuugcucucccugccauauguaaacaacacggaacuaucagcccugcagagcucuaagauucucgaguccccggaaccccugcuucgaagugcuagcggccgccaggagucuuuguccucagccaccccuggggaggcaaguaaggaaugcagaaaugccaaaaagaucagcuguauaucgccaagguucggaguccccauggagaaccugacagcuugcggcgaauccccuaauuacaaaauuuauaagacuccaacccggaucuacaaaucuaacaauaagggugagaucuggugcgccggggacgugcacuguuuucaagaguucacacccguuuuacaggagguggucgauaagcucaaaaagaugacuugcuuucugaccgagccggaagcagaggaagacgcguucagcauugcuaucgccauguguaaaauucuugacaagggcgugugcacgauaaacucagagcgcuggaauaucauuaaaugugauaguggacugauguauuacacagaccagagagauggccaggacaccgggaacgauuuuggagaauauugcaucucccacaauuguaagacugagagguucccuauuaaccccucuaucauaagcgacugcaucugggaguaccauucccguaagucacgguacauuagcacauugaaucucgaaagucuggaggaauuuaaacgagcaaucucugagaagcuaucccacacccugguaguguaucaauucaaaccaacuagcaaccucccucauaugaagcccguuuacaaauauauuaccgcccagggugucgaaaauucggauggcaucgacucagcuuucauaacagccucuaugccagcacugagugggacguccauuggauacaacgugaugagcaaggauaauuuuccccuuuucgacaucaucauuuuuauaaagucugcugugaucaaaaccacuuauaaccacauuuacgauacaggcccuaccaucgguauuaacgucaugcaugacgagcacuguacagggcagugcccaaucgagauaccgcacaaggaaaauugguugacuuucagccaggagagaaccuccagguggggcugugaagaguuuggaugccuggccaucaacacgggcugcguuuucgggucaugucaagauauuauccgccccgagacaaaaguguaucggaaggcgauugaagagaguguguuacucaccguaugcgucacuuacccuggaaauaccuuuuguacagaaaucaacgccauagagccaaaaauuacugacgaacuggagcuucaguucaagaccguggacacaaaaacgcugcccaaucuacucgcuguucagaaccauaagcuguacagcggccagaucaaugauuuggguucuuuugcacaagggugcggaaacauccagaagaccaaucuguccgugauuggcacugguacagccaaauucgacuauaucugucacggcgcuucaagaaaggauauagucgugaggcgcugcuacaacaauaacuaugagaguuguaaauuacucaaggaagaaccuagccugauuuuuagugacaaucaugaaaccaucgagguugccaacauucgacaccuucugggggaauugcaguucaaacucaugcugggagaucuacgguacaagucuuucgcagagaauccagagcuggaaaucgaggcgaagugcgugggcugucccucgugcuuuagcucauauuccuguaacuuccguauaaguucuagcauugacacuguaugcgccaucgaugggccgugcacaaucuuucauaacagacuuauuaucuccucaaccaaacaagacuacggaauuaagaugucuuguaaagaaaagccuaauccagucgagaaauucaacauaugcaagaggguguauagcgugcucuuuacgacuaucgauaagaaugacaaaauugaaaucaacaccggcgaucagacaaguuucauccaggagaaggacgaucgcuguaaaaccuggcugugccgggucagagacgaggguauuuccguuauauuugaacccaucaaggcuuucuuugggagcuacuucucuauugccuuuuacgugguaaucggaauuaucgcauuguucauaacuaucuauauuuuucugccuaugguguucaaauuaaaggacauccucaagaaaaaugagcugcuuuaccugcaggaaaugaaguauaaauga

SEQ ID NO: 10864 - RNA, 4305 nt, Artificial Sequence
  derived and/or modified CDS sequence (opt3) from ANADV(EIV-16002Mg)__KT313724.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucacuuaucucaaaaacgacaccggaauuuucgcccauagcaagguacuaaggaauuggaucauaaaagauuggaagaacugcaauccagugccgacagcggguggcuccaucaacgucauugaagugaaugcugaccugucucuuucgaccaagacuuacguuuguucacgggauugcacaaucaccguggacaaagaggaugcccaaauuaucuuucagacggacaagcugaaccacuucgaagucagcgggacuaccuugaguuccggaugguuuaaaacaaaggcaucugugacucucgaucgcaccugugagcauauaaaaguaacaugcggcaagaagacccugcaguuccacgccuguuuuaaacaucacaugagcugcauucgauucuuucacaauacgauccugcccgguacuauggcuguuuccauuugucagaacaucgagcucaucauuauaacaucauuaacccugaucauuuucauccuuauggugauauugacuaagacauauauuugcuacguccugaugccucuauuuaugccaguggcauaucucuacgggugggccuauaaucguaguuguaaaaagugcagcugcuguggacuggcuuaccaucccuucaccaacugcggcucucacugugugugcggccuuaaauucgaagccuccgacagaaugaggauccaucgggagucagggcugugucaaggauacaagagcuugcgcgucgcgagacuccugugcaaaaguaaggguucuuccuuaaucauuagcauccugcucucgguucuuauucugucuuuugugacgccuauagaaggcaccuugacaaauuauccagaguccaagaaauacucacuagaggaaaucgcagauguaauugagggguucaucgccgaaaagggaaucaaagaguauauugugcuguacaccaguauauuuggcgcucuccugcuucugaucgccuugauuaucacugucagccucaacaggauuacagaauaucugacuaauuuaaacgugaucuacugucacgagugcuccauguaucacucuaagaaaaauauaaaguacguuggugacuucaccaacaaguguggguuuugcacauguggagagcuggaagaucaggagggccuaaacaugcauaaagugagcaagaaaugcaucuaccgguaucagcucaccuggucaaaggucauuaugacuauccuggugugccuuuugauugcacagaauacgguacugaucguugcugccaacgacgacuguugggcgaaacaaagucucgaaauagagugcgugggcccccugcagcaggucgaugccugugaagacaaguccagccgcucuuacaauggggaggcaaagaaacuugugggaacaucaaaggucaccgagcuggaugcuggucaggugaacuugcucggccaaacuauugaaagugccaucauugcuauccgaaaacagagaaccuaugccacaaugcacuuccuggagagcguuuucuuagggaggcauugcgacuacuauaagguguucgaacacaauuccggauacucucaggcaaaauggcggcugcuagccaagaccaaccauuuugauauauguucgcgucacagcacucaccauuucugccgcuguauguccgacggcacaaagugcgagaaugguaacugggauuuugcuggggaaaugaauacgaccuaucacucaaaaagagacuucuuuaagcaugauuucaaacucuucuguacucugcuugagaacgcguuuccuggcacaaccgagaguuuguacuaccaacugcucucuaagaggaauacaacuggagcaagcaaacuguuaggcaagcugaucaccaaauucgggaacaauaaccuuuuuguaggaauuuggaaguucggucaguuuuugcucucccugccauaugucaauaacacggaacuaucagcccugcagagcucuaagauccucgaguccccggaaccccugcuucggagugcuagcggccgacaggagucuuuguccucagccaccccuggggaggcaagucgcgaaugcagaaacgccaaaaagauuagcuguaucucgccaagguucggagugcccauggagaaucugacagcuugcggcgaauccccuaacuacaaaauauauaagacuccagcccggauuuacaaaucuaauaacaagggugagaucuggugcgcaggggacguucacuguuuucaagaauuuacccccguguuacaggaggucguggauaagcucaaaaagaugacaugcuuucugacugagccggaagcggaggaagacgcuuucagcaucgccauugcaauguguaaaauccuugacaagggcguaugcaccauuaauucagagcgcuggaacauaaucaaaugugauaguggacugauguauuacacggaccagagagauggccaggacacagggaaugauuuuggagaauauugcauuucccacaacuguaagaccgagagguucccuaucaaucccucuauuaucagcgacugcauaugggaguaccauucccguaagucacgguacaucagcacuuugaaccucgaaagucuggaggaauuuaaacgagccauuucugagaagcuaucccacacacuggugguuuaucaauucaaaccaaccagcaaucucccucauaugaagcccgucuacaaauauaucacugcucaggguguggaaaacucggauggcauugacucagccuucaucaccgcaucuaugccagcucugagugggacauccauaggauacaaugugaugagcaaggauaacuuuccccuuuucgacauuaucaucuuuauuaagucugccgucauaaaaacgaccuauaaucacaucuacgauacuggcccuacaauugguaucaacguuaugcaugacgagcacuguaccgggcagugcccaauugagaucccgcacaaggaaaacugguugacauucagccaggagagaacuuccagguggggcugugaagaguuuggaugccuggcgauaaauaccggcugcguguucgggucaugucaagauaucauucgccccgagacgaaaguguaucggaaggccaucgaagagaguguauuacucacagucugcgugaccuacccuggaaacacuuuuuguaccgaaauuaaugcuaucgagccaaaaauaacagacgaacuggagcuucaguucaagacuguugacaccaaaacacugcccaaccuacucgcagugcagaaucauaagcuguacagcggccagauuaacgauuuggguucuuuugcccaagggugcggaaauauccagaagacgaaccuguccgucaucggcaccgguacugcuaaauucgacuauauuugucacggcgccucaagaaaggauaucgugguuaggcgcugcuacaauaacaauuaugagaguuguaaauuacucaaggaggaaccuagccugauauuuuccgacaaccaugaaacaauugagguggcaaauauccgacaccuucugggggaauugcaguucaaacucaugcugggagaucuacgguacaagucuuucgcggagaacccagagcuggaaauugaggccaagugcguaggcugucccucgugcuuuagcucauauuccuguaauuuccguaucaguucuagcauagacaccgucugcgcuauugaugggccgugcacuguguuucauaacagacuuaucaucuccucaacaaaacaagacuacggaauuaagaugucuuguaaagaaaagccuaacccaguggagaaauucaauaucugcaagagggucuauagcguucucuuuaccacgauugauaagaacgacaaaauagaaaucaauacuggcgaucagaccaguuucauucaggagaaggacgaucgcuguaaaacauggcugugccgggugagagacgaggguaucuccguaaucuuugaacccauuaaggccuucuuugggagcuacuucucuauagcauuuuacguggucaucggaauuaucgcuuuguucauuaccaucuauauauuucugccuaugguguucaaauuaaaggacauccucaagaaaaacgagcugcuuuaccugcaggaaaugaaguauaaauga

SEQ ID NO: 10865 - RNA, 4305 nt, Artificial Sequence
  derived and/or modified CDS sequence (opt3) from ANADV(EIV-16199Mg)__KT313730.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucacuuaucucaaaaacgacaccggaauuuucgcccauagcaagguacuaaggaauuggaucauaaaagauuggaagaacugcaauccagugccgacagcggguggcuccaucaacgucauugaagugaaugcugaccugucucuuucgaccaagacuuacguuuguucacgggauugcacaaucaccguggacaaagaggaugcccaaauuaucuuucagacggacaagcugaaccacuucgaagucagcgggacuaccuugaguuccggaugguuuaaaacaaaggcaucugugacucucgaucgcaccugugagcauauaaaaguaacaugcggcaagaagacccugcaguuccacgccuguuuuaaacaucacaugagcugcauucgauucuuucacaauacgauccugcccgguacuauggcuguuuccauuugucagaacaucgagcucaucauuauaacaucauuaacccugaucauuuucauccuuauggugauauugacuaagacauauauuugcuacguccugaugccucuauuuaugccaguggcauaucucuacgggugggccuauaaucguaguuguaaaaagugcagcugcuguggacuggcuuaccaucccuucaccaacugcggcucucacugugugugcggccuuaaauucgaagccuccgacagaaugaggauccaucgggagucagggcugugucaaggauacaagagcuugcgcgucgcgagacuccugugcaaaaguaaggguucuuccuuaaucauuagcauccugcucucgguucuuauucugucuuuugugacgccuauagaaggcaccuugacaaauuauccagaguccaagaaauacucacuagaggaaaucgcagauguaauugagggguucaucgccgaaaagggaaucaaagaguauauugugcuguacacuucgauauuuggcgcucuccugcuucugaucgccuugauuaucaccgucagccucaacaggauuacagaauaucugacuaauuuaaacgugaucuacugucacgagugcuccauguaucacucuaagaaaaauauaaaguacaucggugacuucaccaacaaguguggguuuugcacauguggagagcuggaagaucaggagggccuaaacaugcauaaaguuagcaagaaaugcauuuaccgguaucagcucaccuggucaaaggugaucaugacuauucuggucugccuuuugaucgcacagaauacggugcugauaguagcugccaacgacgacuguugggcgaaacaaagucucgaaauugagugcguuggcccccugcaacagguggaugccugugaagacaaguccagccgcucuuacaaugaggaggcaaagaaacuugucgggacaucaaaggugaccgaacuggaugcuggacaggucaacuugcucggucagacuaucgagagugccauuaucgcuauacgaaaacagagaaccuaugccacaaugcacuuccuggaaagcguguuuuuaggcaggcauugcgacuacuauaagguuuucgagcacaauuccggguacucucaggcaaaauggcggcugcuagccaagaccaaccauuuugauaucuguucgcgucacagcacucaccauuucugccgcuguauguccgacggaacaaagugcgaaaauggcaacugggauuuugcuggugagaugaauacgaccuaucacucaaaaagagacuucuuuaagcaugauuucaaccucuucuguacucugcuugagaaugcguuuccugggacaaccgaaaguuuguacuaccaacugcucucuaaaaggaacacaacuggcgcaagcaagcuguuaggaaaacugauuaccaaguucggcaauaacaaucuuuuuguggggaucuggaaauucggacaguuuuugcucucccugccauauguaaacaacacggagcuaucagcccugcagagcucuaagauucucgaauccccggagccccugcuucggagugcuagcggucgacaggagucuuuguccucagccaccccuggcgaagcaaguaaggagugccgcaaugccaaaaagaucagcuguauaucgccaagauucgggguccccauggaaaaccugacagcuugcggagaguccccuaauuacaaaauuuauaagacuccaaccaggaucuacaaaucuaacaauaagggcgaaaucuggugcgccggugacgugcacuguuuucaagaguucacacccguuuuacaggagguggucgauaagcucaaaaagaugacuugcuuucugaccgaaccggaggcagaagaggacgcguucagcauugcuaucgccauguguaaaauucuugacaagggggugugcacgauaaacucagaacgguggaauaucauuaaaugugauaguggccugauguauuacacagaccagcgcgauggacaggacaccggcaacgauuuuggggaguauugcaucucccacaauuguaagacugagagauucccuauuaaccccucuaucauaagcgacugcaucugggaauaccauuccaggaagucacguuacauuagcacauugaaucucgagagucuggaagaguuuaaacgggcaaucucugaaaagcuaucccacacccugauuguauaucaauucaaaccaacuagcaaccucccucauaugaagcccguguacaaauauaucaccgcccagggaguugagaauagugaugguauagacucagcuuucauuacagccucuaugccagcacugaguggcacguccaucggguacaacgucaugagcaaggauaauuuuccccuuuucgacaucauuauauuuaucaagucugcugugauuaaaaccacuuauaaccacaucuacgauacaggaccuaccauuggcaucaacgugaugcaugacgagcacuguacaggucagugcccaauagaaaucccgcacaaggagaauugguugacuuucagccaggaacgaaccuccagaugggggugugaggaguuuggcugccuggccauuaacacgggaugcgucuucggcucaugucaagauaucauuaggcccgaaacaaaaguuuaucgcaaggcgaucgaggaaaguguguuacucaccgugugcguaacuuacccugggaauaccuuuuguacagagauaaacgccauugaaccaaaaaucacugacgagcuggagcuucaguucaagaccgucgacacaaaaacgcugcccaaucuacucgcugugcagaaccauaagcuguacagcggacagaucaaugauuugggcucuuuugcacaagguugcgggaacauucagaagaccaaucuguccguuaucggaacuggcacagccaaauucgacuauauaugucacggugcuucacggaaggauauuguggucagaaggugcuacaacaauaacuaugaaaguuguaaauuacucaaggaggaaccuagccugaucuuuuccgacaaucaugagaccauugaaguggccaacauccgccaccuucugggcgaguugcaguucaaacucaugcugggggaucuacgauacaagucuuucgcagagaauccagaacuggagauagaagcgcggugcguuggaugucccucgugcuuuagcucauauuccuguaacuuccguauuaguucuagcaucgacacugugugcgccaucgauggcccgugcacaauuuuucauaacagacuuaucauuuccucaaccaagcaagacuacgggauaaaaaugucuuguaaggagaaaccuaauccaguagaaaaguucaacaucugcaaaagggucuauagcgugcucuuuacgacuauugauaagaaugacaagaucgagaucaacaccggagaucagacaaguuucauucaggagaaagacgaucgcuguaagaccuggcugugccgggugagagacgaaggcauauccgucaucuuugagcccauuaaggcuuucuuugguagcuacuucucuaucgccuuuuacguugugauugggaucauagcauuguucaucauuaucuauauuuuucugccuaugguauucaaauuaaaagacauccucaagaagaaugaacugcuuuaccugcaggagaugaaauauaaguga

SEQ ID NO: 10866 - RNA, 4305 nt, Artificial Sequence
  derived and/or modified CDS sequence (opt3) from ANADV(EIV-16208Mg)__KT313733.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucacuuaucuaaagaacgacaccggaauuuucgcccauagcaagguacucaggaauuggaucauaaaagauuggaagaacugcaauccagugccgacagcggguggcuccaucaacgucauugaagugaaugcugaccugucucuuucgaccaagacuuacguuuguucacgggauugcacaaucaccguggacaaagaggaugcccaaauuaucuuucagacggacaagcugaaccacuucgaagucagcgggacuaccuugaguuccggaugguuuaaaacaaaggcaucugugacucucgaucgcaccugugagcauauaaaaguaacaugcggcaagaagacccugcaguuccacgccuguuuuaaacaucacaugagcugcauucgauucuuucacaauacgauccugcccgguacuauggcuguuuccauuugucagaacaucgagcucaucauuauaacaucauuaacccugaucauuuucauccuuauggugauauugacuaagacauauauuugcuacguccugaugccucuauuuaugccaguggcauaucucuacgggugggccuauaaucguaguuguagaaaaugcagcugcuguggacuggcuuaccaucccuucaccaacugcggcucucacugugugugcggccuuaaguucgaagccuccgacaggaugcggauccaucgcgagucagggcugugucaaggauacaagagcuugagagucgcgaggcuccugugcaagaguaaagguucuuccuuaaucauuagcauccugcucucgguucuuauucugucuuuugugacgccuauagaaggcaccuugacaaauuauccagaguccaagaaguacucacuagaggaaaucgcagauguaauugagggguucaucgccgaaaaaggaaucaaggaguauauugugcuguacacuuccauauuuggcgcucuccugcuucugaucgccuugauuaucaccgucagccucaaccggauuacagaauaucugacuaauuuaaacgugaucuacugucacgagugcuccauguaucacucuaaaaagaauauaaaauacaucggugacuucaccaacaaguguggguuuugcacauguggagagcuggaagaucaggagggccuaaacaugcauaagguuagcaaaaagugcauuuaccgcuaucagcucaccuggucaaaagugaucaugacuauucugaucugccuuuugauagcacagaaugcuguccugauuguggccgcgaacgacgacuguugggccaagcaaagucucgaaaucgagugcguaggcccccugcagcagguugaugcaugugaagacaaauccagccgaucuuacaauggggaggcuaagaaacuugugggaacgucaaaagucacagagcuggaugccggucaggugaacuugcucggccaaaccauugaaagugcuaucauagccaucagaaagcagaggacuuaugcaaccaugcacuuccuggagagcgucuuuuuagggcggcauugcgacuacuauaaaguguucgaacacaauuccggauacucucaggccaaguggcgucugcuagcuaaaacaaaccauuuugauauuuguucgcgccacagcacccaccauuucugcagauguauguccgacggcacuaagugcgagaaugguaacugggauuuugcgggggaaaugaauacaacguaucacucaaagagggacuucuuuaaacaugauuucaaacucuucuguacccugcuugagaacgcauuuccuggcacuacagagaguuuguacuaccaacugcucucuaaacggaauaccacaggagccagcaagcuguuaggcaaacugaucacuaaguucgggaacaauaaccuuuuuguuggaauuuggaaauucggucaguuuuugcucucccugccauaugugaauaacaccgaacuaucagcucugcagagcucuaagauccucgaguccccggaaccccugcuucgaagugccagcggccgccaggagucuuuguccucagcaacgccuggggaggccaguaaggaaugcagaaacgcuaaaaagauaagcuguauuucgccaagguucggaguacccauggagaaucugaccgccugcggcgaauccccuaacuacaaaaucuauaagacaccaacucggaucuacaaaucuaauaacaagggugagauuuggugcgcaggggacguccacuguuuucaagaguucacccccguguuacaggaaguuguggauaagcucaaaaagaugacaugcuuucugacugagccggaagcggaggaagacgcuuucagcaucgccauugcaauguguaaaauacuugacaagggcgucugcaccaucaauucagagcgcuggaacauuaucaaaugugauaguggacugauguauuacacggaccagagagauggccaggacacagggaaugauuuuggagaauauugcauuucccacaacuguaagaccgagagguucccuaucaaucccucuauaaucagcgacugcauuugggaguaccauucccguaagucaaaauacaucagcacuuugaaccucgaaagucuggaggaauuuaagcgggccauuucugagaaacuaucccacacacuggugguauaucaauucaagccaaccagcaaucucccucauaugaaacccguguacaaguauaucacugcucaggguguugaaaacucggauggcauagacucagccuucauuaccgcaucuaugccagcucugagugggacauccaucggauacaaugucaugagcaaggauaacuuuccccuuuucgacaucauuauauuuaucaaaucugccgugauuaagacgaccuauaaucacaucuacgauacuggcccuacaauugguaucaacgugaugcaugacgagcacuguaccgggcagugcccaauagagaucccgcacaaagaaaacugguugacauucagccaggagcgaacuuccagauggggcugugaagaguuuggaugccuggcgauuaauaccggcugcgucuucgggucaugucaagauaucauuaggcccgagacgaagguuuaucgcaaagccaucgaagagaguguguuacucacagugugcguaaccuacccuggaaacacuuuuuguaccgaaauaaaugcuauugagccaaagaucacagacgaacuggagcuucaguucaaaacugucgacaccaagacacugcccaaccuacucgcagugcagaaucauaagcuguacagcggccagaucaacgauuuggguucuuuugcccaagggugcggaaauauucagaaaacgaaccuguccguuaucggcaccgguacugcuaaguucgacuauauaugucacggcgccucacggaaagauauuaucgugagaaggugcuacaauaacaauuaugagaguuguaaguuacucaaagaggaaccuagccugauuuuuagugacaaccaugaaacaaucgaggucgcaaauauacgccaccuucugggggaauugcaguucaagcucaugcugggagaucuacgauacaagucuuucgcggagaacccagagcuggaaauugaggccaaaugcgugggcugucccucgugcuuuagcucauauuccuguaauuuccggaucaguucuagcaucgacaccguuugcgcuauugaugggccgugcacuaucuuucauaaccgucuuauuauauccucaacaaagcaagacuacggaaucaaaaugucuuguaaggaaaaaccuaacagcguggagaaguucaauauuugcaagagaguauauaguguccucuuuaccacgaucgauaaaaacgacaagaucgaaauuaauacuggcgaucagaccuccuucauacaggagaaagacgauagguguaagacauggcugugccgcgugcgggacgaggguaucagcgugauuuuugaaccaaucaaagccuucuuugggucuuacuucucaauugcauuuuacgucguuaucggaauaaucgcuuuguucauuaucauuuauaucuuucugcccaugguguucaaguuaaaggacauacucaaaaagaacgagcugcuuuaccugcaggaaaugaaauauaaguga

SEQ ID NO: 10867 - RNA, 4305 nt, Artificial Sequence
  derived and/or modified CDS sequence (opt3) from ANADV(EIV-16356Mg)__KT313736.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucacuuaucucaaaaacgacaccggaauuuucgcccauagcaagguacuaaggaauuggaucauaaaagauuggaagaacugcaauccagugccgacagcggguggcuccaucaacgucauugaagugaaugcugaccugucucuuucgaccaagacuuacguuuguucacgggauugcacaaucaccguggacaaagaggaugcccaaauuaucuuucagacggacaagcugaaccacuucgaagucagcgggacuaccuugaguuccggaugguuuaaaacaaaggcaucugugacucucgaucgcaccugugagcauauaaaaguaacaugcggcaagaagacccugcaguuccacgccuguuuuaaacaucacaugagcugcauucgauucuuucacaauacgauccugcccgguacuauggcuguuuccauuugucagaacaucgagcucaucauuauaacaucauuaacccugaucauuuucauccuuauggugauauugacuaagacauauauuugcuacguccugaugccucuauuuaugccaguggcauaucucuacgggugggccuauaaucguaguuguaaaaagugcagcugcuguggacuggcuuaccaucccuucaccaacugcggcucucacugugugugcggccuuaaauucgaagccuccgacagaaugaggauccaucgggagucagggcugugucaaggauacaagagcuugcgcgucgcgagacuccugugcaaaaguaaggguucuuccuuaaucauuagcauccugcucucgguucuuauucugucuuuugugacgccuauagaaggcaccuugacaaauuauccagaguccaagaaauacucacuagaggaaaucgcagauguaauugagggguucaucgccgaaaagggaaucaaagaguauauugugcuguacacuuccauauuuggcgcucuccugcuucugaucgccuugauuaucaccgucagccucaacaggauuacagaauaucugacuaauuuaaacgugaucuacugucacgagugcuccauguaucacucuaagaaaaauauaaaguacaucggugacuucaccaacaaguguggguuuugcacauguggagagcuggaagaucaggagggccuaaacaugcauaaaguuagcaagaaaugcauuuaccgguaucagcucaccuggucaaaggugaucaugacuauucuggucugccuuuugaucgcacagaauacggugcugauaguagcugccaacgacgacuguugggcgaaacaaagucucgaaauugagugcguuggcccccugcaacagguggaugccugugaagacaaguccagccgcucuuacaauggggaggcaaagaaacuugucggaacaucaaaggugaccgagcuggaugcuggucaggucaacuugcucggccagacuaucgaaagugccauuaucgcuauacgaaaacagagaaccuaugccacaaugcacuuccuggagagcguguuuuuagggaggcauugcgacuacuauaagguuuucgaacacaauuccggauacucucaggcaaaauggcggcugcuagccaagaccaaccauuuugauaucuguucgcgucacagcacucaccauuucugccgcuguauguccgacggcacaaagugcgagaaugguaacugggauuuugcuggggaaaugaauacgaccuaucacucaaaaagagacuucuuuaagcaugauuucaaacucuucuguacucugcuugagaacgcguuuccuggcacaaccgagaguuuguacuaccaacugcucucuaagaggaauacaacuggagcaagcaaacuguuaggcaagcugauuaccaaauucgggaacaauaaccuuuuugugggaaucuggaaguucggucaguuuuugcucucccugccauauguaaauaacacggaacuaucagcccugcagagcucuaagauucucgaguccccggaaccccugcuucggagugcuagcggccgacaggagucuuuguccucagccaccccuggggaggcaaguaaagaaugccgcaacgccaagaaaaucagcuguauaucgccaagauucggaguccccauggagaaucugacagcuugcggcgaauccccuaacuacaagauuuauaaaacuccaaccaggaucuacaagucuaauaacaagggugagaucuggugcgccggggacgugcacuguuuucaagaauuuacacccuuacuccaggagguuguggauaaacugaagaaaaugacuugcuuucuuaccgagccggaagcagaggaagacgcguucagcauugcuaucgccauguguaagauucuggacaaaggcgucugcacgauaaauucagagcgguggaacaucauuaagugugauaguggauugauguauuacacagaccagcgcgauggccaggacaccgggaaugauuuuggagaauauugcaucucccacaacuguaagacugagagauucccuauuaaucccucuaucauaagcgacugcaucugggaguaccauuccaggaaaucacguuacauuagcacacucaaccuggaaagucuagaggaauuuaagcgggcaaucucugagaaacugucccacacccucgugguauaucaauucaagccaacuagcaaucugccucauaugaaacccguguacaaguauauuaccgcccaggguguugaaaacucggauggcaucgacucagcuuucauaacagccucuaugccagcacuuagugggacguccauuggauacaaugucaugagcaaggauaacuuucccuuguucgacaucaucauuuuuauaaaaucugcugugaucaagaccacuuauaaucacauuuacgauacaggcccuaccaucgguauuaacgugaugcaugacgagcacuguacagggcagugcccaaucgagauaccgcacaaagaaaacuggcugacuuucagccaggagcgaaccuccagauggggcugugaagaguuuggaugcuuagccaucaauacgggcugcgucuucgggucaugucaagauauuaucaggcccgagacaaagguuuaucgcaaagcgauugaagagagugugcuccugaccgugugcguaacuuacccuggaaacaccuuuuguacagaaaucaaugccauagagccaaagauuacugacgaacuugagcugcaguucaaaaccgucgacacaaagacgcuacccaaccuccuggcugugcagaaucauaaguuguacagcggccagaucaacgaucuggguucuuuugcacaagggugcggaaauauccagaaaaccaacuuauccguuauuggcacugguacagccaaguucgacuauaucugucacggcgcuucacggaaagauauaguggucagaaggugcuacaauaacaauuaugagaguuguaagcuccugaaagaggaaccuagccuuauuuuuagugacaaccaugaaaccaucgagguggccaauauucgccaccuguugggggaacuccaguucaagcugaugcuaggagaucugcgauacaagucuuucgcagagaacccagagcuugaaaucgaggcgaaaugcguuggcugucccucgugcuuuagcucauauuccuguaauuuccggauaaguucuagcauugacacugugugcgccaucgaugggccgugcacaaucuuucauaaccgucucauuaucuccucaaccaagcaagacuacggaauuaaaaugucuuguaaggaaaaaccuaacccaguagagaaguucaauauaugcaagagagucuauagcgugcuguuuacgacuaucgauaaaaacgacaagauugaaaucaauaccggcgaucagacaaguuucauccaggagaaagacgauagguguaagaccugguugugccgcgugcgggacgaggguauuuccgucauauuugaacccaucaaggcuuucuuugggagcuacuucucuauugccuuuuacguugugaucggaauuaucgcacuguucauaacuaucuauauuuucuuaccuaugguauucaaacucaaggacauccugaaaaagaacgagcuucuguacuugcaggaaaugaaauauaaguga

SEQ ID NO: 10868 - RNA, 4305 nt, Artificial Sequence
  derived and/or modified CDS sequence (opt3) from ANADV(EIV-17769Yak)__KT313739.1__GP
auguuccugauccucgugcuucugauucccuuuuacauaaccgccacaccugucgcuacuagaugcuuccacggcgggcaguugaucgcagagagcaaguccuuaacggccauuucugaauuuugucugaaagacgauguuucaaccgugaagagugagaucacauaucucaaaaacgacacuggaauuuucgcgcauagcaagguacuaaggaauuggaucauaaaagauuggaagaacugcaauccagugccgaccgcugguggcuccaucaacgucauugaagugaaugccgaccugucucuuucgacaaagaccuacguuuguucacgggauugcacuaucacaguggacaaagaggaugcacaaauuaucuuucagaccgacaaccugaaucacuucgaagucagcgggacgacuuugaguuccggaugguuuaagaccaaagccucugugacacucgaucgcacuugugagcauauaaagguaaccugcggcaaaaagacacugcaguuccacgcuuguuuuaagcaucacaugagcugcauucgauucuuucacaacaccauccugcccgguacgauggcaguuuccauuugucagaauaucgagcucaucauuauaacuucauuaacacugaucauuuucauccuuauggugauauugaccaaaacuuauauuugcuacguccugaugccucuauuuaugccaguggccuaucucuacgggugggcuuauaaccguaguuguaagaaaugcagcugcuguggacuggccuaccaucccuucacaaauugcggcucucacugugugugcggccuuaaguucgaagcguccgacagaaugaggauccaucgggagucagggcugugucaaggauacaagagcuugcgcgucgcaagacuccugugcaagaguaaagguucuuccuuaaucauuagcauccugcucucgguucuuauucugucuuuugugaccccuauagaaggcacguugaccaacuauccagaguccaagaaguacucacuagaggaaaucgccgauguaauugagggguucaucgcugaaaaaggaaucaaggaguauauugugcuguacacaaguauauuuggcgcccuccugcuucugaucgcauugauuaucacugucagccucaauaggauuaccgaauaucugacaaacuuaaaugugaucuacugucacgagugcuccauguaucacucuaaaaagaacauaaaauacguuggugacuucacuaacaaguguggguuuugcaccuguggagagcuggaagaucaggagggccuaaauaugcauaaggugagcaaaaagugcaucuaccgguaucagcucacauggucaaaagucauuaugaccauccuggugugccuuuugauugcucagaacacuguacugaucguugccgcgaaugacgacuguugggccaagcaaagucucgaaauagagugcgugggcccccugcagcaggucgaugcaugugaagacaaauccagccgcucuuacaacggggaggcuaagaaacuugugggaacgucaaaagucacagagcuggaugccggucaggugaauuugcucggccaaaccauugaaagugcuaucauugccauccgaaagcagagaacuuaugcaaccaugcacuuccuggagagcguuuucuuagggaggcauugcgacuacuauaaaguguucgaacacaacuccggauacucucaggccaaguggcggcugcuagcuaaaacaaaucauuuugauauauguucgcgucacagcacccaccauuucugccgcuguauguccgacggcacuaagugcgagaacgguaauagagauuuugcgggggaaaugaacacaacguaucacucaaagagggacuucuuuaaacaugauuucaaucucuucuguacccugcuugagaacgcauuuccuggcacuacagagaguuuguacuaccaacugcucucuaagcggaauaccacaggagccagcaaacuguuaggcaagcugaucacuaaauucgggaacaauaaccuuuuuguaggaauuuggaaguucggucaguuuuugcucucccugccauaugucaacaauaccgaacuaucagcucugcagagcucuaaaauccucgaguccccggaaccccugcuucgaagugccagcggccgccaggagucuuuguccucagcaacgccuggggaggccaguagagaaugcaggaacgcuaagaagauuagcuguaucucgccacgguucggagugcccauggagaaucugaccgccugcggcgaauccccuaacuacaaaauauauaagacaccaacucgcauuuacaaaucuaauaacaagggugagaucuggugcgcaggggacguucacuguuuucaagaauuuacccccguguuacaggaggucguggauaaacucaagaagaugacaugcuuucugacugagccggaagcggaggaagacgcuuucagcaucgccauugcaauguguaaaauccuugacaagggcguaugcaccauuaauucagagagauggaacauaaucaaaugugauaguggacugauguauuacacggaccagagggauggccaggacacagggaaugauuuuggagaauauugcauuucccacaacuguaagaccgagcguuucccuaucaaucccucuauuaucagcgacugcauaugggaguaccauucccggaaaucacgauacaucagcacuuugaaccucgaaagucuggaggaauuuaagagagccauuucugagaagcuaucccacacacuggugguuuaucaauucaaaccaaccagcaaucucccucauaugaagcccgucuacaaauauaucacugcucaggguguggaaaacucggauggcauugacucagccuucaucaccgcaucuaugccagcucugagugggacauccauaggauacaaugugaugagcaaggauaacuuuccccuuuucgacauuaucaucuuuauuaaaucugccgucauaaagacgaccuauaaccacaucuacgauacuggcccuacaauugguaucaauguuaugcaugacgagcacuguaccgggcagugcccaauugagaucccgcacaaggaaaacugguugacauucagccaggagaggacuucccgcuggggcugugaagaguuuggaugccuggcgauaaauaccggcugcguguucgggucaugucaagauaucauucggcccgagacgaaaguguauagaaaggccaucgaagagaguguauuacucacagucugcgugaccuacccuggaaacacuuuuuguaccgaaauuaaugcuaucgagccaaaaauaacagacgaacuggagcuucaguucaagacuguugacaccaaaacacugcccaaccuacucgcagugcagaaucauaagcuguacagcggccagauuaacgauuuggguucuuuugcccaagggugcggaaauauccagaaaacgaaccuguccgucaucggcaccgguacugcuaaguucgacuauauuugucacggcgccucaaggaaggauaucgugguucgccgaugcuacaauaacaauuaugagaguuguaaauuacucaaggaggaaccuagccugauauuuuccgacaaccaugaaacaauugagguggcaaauauccggcaccuucugggggaauugcaguucaaacucaugcugggagaucuacguuacaagucuuucgcggagaacccagagcuggaaauugaggccaaaugcguaggcugucccucgugcuuuagcucauauuccuguaacuucagaaucaguucuagcauagacaccgucugcgcuauugaugggccgugcacuaucuuucauaauaggcuuaucauuuccucaacaaagcaagacuacggaaucaagaugucuuguaaagaaaagccuaacccaguggagaaauucaauauuugcaagcgcguguauagcguccucuuuaccacgauagauaaaaacgacaagaucgaaauugauacuggcgaccagaccaguuucauccaggagaaggaugaccgguguaaaacauggcugugcagaguuagggacgaggguaucuccgugauuuuugaacccauaaaggccuucuuugggagcuacuucucuaucgcauuuuacguagugauuggaaucauugcuuuguucaucaccauauauaucuuucugccuauggucuucaaauuaaaggauauucucaaaaagaaugagcugcuuuaccugcaggaaaugaaguauaaauga

SEQ ID NO: 10869 - RNA, 4305 nt, Artificial Sequence
  derived and/or modified CDS sequence (opt3) from ANADV(EIV-18098Yak)__KT313742.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucacuuaucucaaaaacgacaccggaauuuucgcccauagcaagguacuaaggaauuggaucauaaaagauuggaagaacugcaauccagugccgacagcggguggcuccaucaacgucauugaagugaaugcugaccugucucuuucgaccaagacuuacguuuguucacgggauugcacaaucaccguggacaaagaggaugcccaaauuaucuuucagacggacaagcugaaccacuucgaagucagcgggacuaccuugaguuccggaugguuuaaaacaaaggcaucugugacucucgaucgcaccugugagcauauaaaaguaacaugcggcaagaagacccugcaguuccacgccuguuuuaaacaucacaugagcugcauucgauucuuucacaauacgauccugcccgguacuauggcuguuuccauuugucagaacaucgagcucaucauuauaacaucauuaacccugaucauuuucauccuuauggugauauugacuaagacauauauuugcuacguccugaugccucuauuuaugccaguggcauaucucuacgggugggccuauaaucguaguuguaaaaagugcagcugcuguggacuggcuuaccaucccuucaccaacugcggcucucacugugugugcggccuuaaauucgaagccuccgacagaaugaggauccaucgggagucagggcugugucaaggauacaagagcuugcgcgucgcgagacuccugugcaaaaguaaggguucuuccuuaaucauuagcauccugcucucgguucuuauucugucuuuugugacgccuauagaaggcaccuugacaaauuauccagaguccaagaaauacucacuagaggaaaucgcagauguaauugagggguucaucgccgaaaagggaaucaaagaguauauugugcuguacaccaguauauuuggcgcucuccugcuucugaucgccuugauuaucacugucagccucaacaggauuacagaauaucugacuaauuuaaacgugaucuacugucacgagugcuccauguaucacucuaagaaaaauauaaaguacguuggugacuucaccaacaaguguggguuuugcacauguggagagcuggaagaucaggagggccuaaacaugcauaaagugagcaagaaaugcaucuaccgguaucagcucaccuggucaaaggucauuaugacuauccuggugugccuuuugauugcacagaauacgguacugaucguugcugccaacgacgacuguugggcgaaacaaagucucgaaauagagugcgugggcccccugcagcaggucgaugccugugaagacaaguccagccgcucuuacaauggggaggcaaagaaacuugugggaacaucaaaggucaccgagcuggaugcuggucaggugaacuugcucggccaaacuauugaaagugccaucauugcuauccgaaaacagagaaccuaugccacaaugcacuuccuggagagcguuuucuuagggaggcauugcgacuacuauaagguguucgaacacaauuccggauacucucaggcaaaauggcggcugcuagccaagaccaaccauuuugauauauguucgcgucacagcacucaccauuucugccgcuguauguccgacggcacaaagugcgagaaugguaacugggauuuugcuggggaaaugaauacgaccuaucacucaaaaagagacuucuuuaagcaugauuucaaccucuucuguacucugcuugagaaugcguuuccuggcacaaccgagaguuuguacuaccaacugcucucuaaaaggaacacaacuggagcaagcaagcuguuaggcaaacugaucaccaaguucgggaauaacaaucuuuuuguaggaauuuggaaauucggucaguuuuugcucucccugccauaugucaacaacacggaacuaucagcccugcagagcucuaagauccucgaguccccggaaccccugcuucggagugcuagcggccgacaggagucuuuguccucagccaccccuggggaggcaagucgcgaaugcagaaaugccaagaaaauuagcuguaucucgccaagguucggagugcccauggagaaccugacagcuugcggcgaauccccuaauuacaagauauauaaaacuccagcccggauuuacaagucuaacaauaaaggugagaucuggugcgcaggggacguucacuguuuucaagaauuuacccccguguuacaggaggucguggauaagcucaagaaaaugacaugcuuucugacugagccggaagcggaggaagacgcuuucagcaucgccauugcaauguguaagauccuugacaaaggcguaugcaccauuaacucagagcgcuggaauauaaucaagugugauaguggacugauguauuacacggaccagagagauggccaggacacagggaacgauuuuggagaauauugcauuucccacaauuguaaaaccgagagguucccuaucaaccccucuauuaucagcgacugcauaugggaguaccauucccguaagucacgguacaucagcacuuugaaucucgaaagucuggaggaauuuaagcgagccauuucugagaaacuaucccacacacuggugguuuaucaauucaagccaaccagcaaccucccucauaugaaacccgucuacaaguauaucacugcucaggguguggaaaauucggauggcauugacucagccuucaucaccgcaucuaugccagcucugagugggacauccauaggauacaacgugaugagcaaagauaauuuuccccuuuucgacauuaucaucuuuauuaagucugccgucauaaagacgaccuauaaccacaucuacgauacuggcccuacaauugguaucaacguuaugcaugacgagcacuguaccgggcagugcccaauugagaucccgcacaaagaaaauugguugacauucagccaggagagaacuuccagguggggcugugaagaguuuggaugccuggcgauaaacaccggcugcguguucgggucaugucaagauaucauucgccccgagacgaagguguaucggaaagccaucgaagagaguguauuacucacagucugcgugaccuacccuggaaauacuuuuuguaccgaaauuaacgcuaucgagccaaagauaacagacgaacuggagcuucaguucaaaacuguugacaccaagacacugcccaaucuacucgcagugcagaaccauaaacuguacagcggccagauuaaugauuuggguucuuuugcccaagggugcggaaacauccagaagacgaaucuguccgucaucggcaccgguacugcuaaguucgacuauauuugucacggcgccucaagaaaagauaucgugguuaggcgcugcuacaacaauaacuaugagaguuguaaguuacucaaagaggaaccuagccugauauuuuccgacaaucaugaaacaauugagguggcaaacauccgacaccuucugggggaauugcaguucaagcucaugcugggagaucuacgguacaaaucuuucgcggagaauccagagcuggaaauugaggccaagugcguaggcugucccucgugcuuuagcucauauuccuguaacuuccguaucaguucuagcauagacaccgucugcgcuauugaugggccgugcacuguguuucauaacagacuuaucaucuccucaacaaagcaagacuacggaauuaaaaugucuuguaaggaaaaaccuaauccaguggagaaguucaacaucugcaaaagggucuauagcguucucuuuaccacgauugauaagaaugacaagauagaaaucaacacuggcgaucagaccaguuucauucaggagaaagacgaucgcuguaagacauggcugugccgggugagagacgaggguaucuccguaaucuuugaacccauuaaagccuucuuugggagcuacuucucuauagcauuuuacguggucaucggaauuaucgcuuuguucauuaccaucuauauauuucugccuaugguguucaaguuaaaagacauccucaagaagaaugagcugcuuuaccugcaggaaaugaaauauaaguga

SEQ ID NO: 10870 - RNA, 4305 nt, Artificial Sequence
  derived and/or modified CDS sequence (opt3) from ANADV(EIV-18136Yak)__KT313745.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucacuuaucucaaaaacgacaccggaauuuucgcccauagcaagguacuaaggaauuggaucauaaaagauuggaagaacugcaauccagugccgacagcggguggcuccaucaacgucauugaagugaaugcugaccugucucuuucgaccaagacuuacguuuguucacgggauugcacaaucaccguggacaaagaggaugcccaaauuaucuuucagacggacaagcugaaccacuucgaagucagcgggacuaccuugaguuccggaugguuuaaaacaaaggcaucugugacucucgaucgcaccugugagcauauaaaaguaacaugcggcaagaagacccugcaguuccacgccuguuuuaaacaucacaugagcugcauucgauucuuucacaauacgauccugcccgguacuauggcuguuuccauuugucagaacaucgagcucaucauuauaacaucauuaacccugaucauuuucauccuuauggugauauugacuaagacauauauuugcuacguccugaugccucuauuuaugccaguggcauaucucuacgggugggccuauaaucguaguuguaaaaagugcagcugcuguggacuggcuuaccaucccuucaccaacugcggcucucacugugugugcggccuuaaauucgaagccuccgacagaaugaggauccaucgggagucagggcugugucaaggauacaagagcuugcgcgucgcgagacuccugugcaaaaguaaggguucuuccuuaaucauuagcauccugcucucgguucuuauucugucuuuugugacgccuauagaaggcaccuugacaaauuauccagaguccaagaaauacucacuagaggaaaucgcagauguaauugagggguucaucgccgaaaagggaaucaaagaguauauugugcuguacacaaguauauuuggcgcucuccugcuucugaucgccuugauuaucaccgucagccucaacaggauuacagaauaucugacuaauuuaaacgugaucuacugucacgagugcuccauguaucacucuaagaaaaauauaaaguacaucggugacuucaccaacaaguguggguuuugcacauguggagagcuggaagaucaggagggccuaaacaugcauaaaguuagcaagaaaugcauuuaccgguaucagcucaccuggucaaaggugaucaugacuauucuggucugccuuuugaucgcacagaauacggugcugauaguagcugccaacgacgacuguugggcgaaacaaagucucgaaauugagugcguuggcccccugcaacagguggaugccugugaagacaaguccagccgcucuuacaauggggaggcaaagaaacuugucggaacaucaaaggugaccgagcuggaugcuggucaggucaacuugcucggccagacuaucgaaagugccauuaucgcuauacgaaaacagagaaccuaugccacaaugcacuuccuggagagcguguuuuuagggaggcauugcgacuacuauaagguuuucgaacacaauuccggauacucucaggcaaaauggcggcugcuagccaagaccaaccauuuugauaucuguucgcgucacagcacucaccauuucugccgcuguauguccgacggcacaaagugcgagaaugguaacugggauuuugcuggggaaaugaauacgaccuaucacucaaaaagagacuucuuuaagcaugauuucaaacucuucuguacucugcuugagaacgcguuuccuggcacaaccgagaguuuguacuaccaacugcucucuaagaggaauacaacuggagcaagcaaacuguuaggcaagcugauuaccaaauucgggaacaauaaccuuuuugugggaaucuggaaguucggucaguuuuugcucucccugccauauguaaauaacacggaacuaucagcccugcagagcucuaagauucucgaguccccggaaccccugcuucggagugcuagcggccgacaggagucuuuguccucagccaccccuggggaggcaaguaaagaaugccgcaacgccaagaaaaucagcuguauaucgccaagauucggaguccccauggagaaucugacagcuugcggcgaauccccuaacuacaagauuuauaaaacuccaaccaggaucuacaagucuaauaacaagggugagaucuggugcgugggggacguucacuguuuucaagaguucacacccguguuacaggaggucguggauaaacucaagaaaaugacuugcuuucugaccgagccggaagccgaggaagacgcauucagcauugcgaucgcuauguguaagauucuugacaaaggcguaugcacgauaaauucagagcgguggaacaucaugaagugugauaguggacugauguauuacacagaccagcgcgauggccaggacaccgggaaugauuuuggagaauauugcauuucccacaacuguaagacugagagauucccuaucaaucccucuauuaucagcgacugcauaugggaguaccauuccaggaaaucacguuacaucgguacauugaaccucgaaagccuggaggaauuuaagcgggccauuagugagaaacuaucucacacccuggugguuuaucaauucaagccaacuuccaaucucccucauaugaaacccgucuacaaguauaucaccgcacagggcguggaaaacagcgaugggauugacucggccuucaucacagcuucaaugccagcccugucuggaacgaguauaggcuacaaugugauguccaaggauaacuuuccccuuuucgacauuaucaucuuuauuaaaagcgcagucauaaagaccacuuauaaucacaucuacgauacagguccuaccauugggaucaacguuaugcaugacgagcacuguacaggccagugcccaauugagaucccgcacaaagaaaacugguugacuuucucucaggagcgaaccagcagauggggaugugaagaguuuggcugccuggcuauaaauacggggugcguguucggauccugucaagauaucauuaggcccgagacaaagguguaucgcaaagccaucgaagagucaguauuacucaccgucugcgugacuuacccuggcaacaccuuuuguacagaaauuaaugcgaucgagccaaagauaacugacgaacuggagcuucaguucaaaaccguugacacaaagacgcugcccaaccuacucgccgugcagaaucauaagcuguacaguggucagauuaacgauuuggggagcuuugcucaaggaugcggcaauauccagaaaaccaaccugucugucaucgguacuggcacagcaaaguucgacuauauuugucacggggccucccggaaagauaucgugguuagaaggugcuacaauaacaauuaugagucauguaaguuacucaaagaagaaccuagucugauauuuagcgacaaccaugaaaccauugagguggcuaauauccgccaccuucugggagaauugcaguucaagcucaugcugggcgaucuacgauacaaguccuucgccgagaacccagagcuggaaauugaggcacggugcguagggugucccucuugcuuuucgagcuauucauguaauuuccguaucuccaguucuauagacacugucugcgcgauugauggaccgugcacaaucuuucauaacagacuuaucauuagcuccaccaaacaagacuacggcaucaagaugucauguaaagaaaagccuaacccaguggagaaauucaauauuugcaagaggguguauucuguccucuuuacgacuauagauaagaacgacaaaaucgaaauuaauaccggugaucagacuagcuucauccaggagaaggacgaucgcuguaaaaccuggcugugccggguuagagacgaggggaucagugugauuuuugaacccauaaaggccuucuuuggauccuacuucagcaucgcuuuuuacguagugauuggcaucauugccuuguucaucauaaucuauauuuuucugccuauggucuucaaauuaaaggacauccucaagaaaaacgagcugcuuuaccugcaggaaaugaaguauaaauga

SEQ ID NO: 10871 - RNA, 4305 nt, Artificial Sequence
  derived and/or modified CDS sequence (opt3) from ANADV(EIV-18146Yak)__KT313748.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucauuuaucucaaaaacgacacuggaaucuucgcccauagcaagguacuaaggaauuggauaaucaaagauuggaagaacugcaauccagugccgaccgcggguggcuccauuaacgucaucgaagugaaugcugaccugucucuuucgacaaagaccuacguuuguucacgggauugcacuauuacaguggacaaagaggaugcccaaaucauauuucagaccgacaagcugaaccacuucgaagucagcgggacgacuuugaguuccggaugguuuaaaaccaaggcaucugugacacucgaucgcacuugugagcauauuaaaguaaccugcggcaagaagacacugcagcugcacgccuguuucaaacaucacaugagcugcauccgauuuuuccacaauaccauucuccccgguacgauggcuguuuccaucugucagaacaucgaguuaauuauaaucacuucacugacacuuauuaucuuuauauugauggugauucugaccaagacuuauaucugcuacguccuaaugccucucuucaugccaguggcauaucuguacgggugggccuauaaucguaguuguaaaaagugcagcugcuguggacuugcuuaccaucccuuuacaaacugcggcucucacugugugugcggccugaaauucgaagccuccgacagaaugaggauccaucgggagucaggguugugucaaggauacaagagccuccgcgucgcgagacuguuaugcaaaaguaaggguucuucccugauuguuagcauccuccuuucggugcugauuuugucuuucguaaccccuauagaaggcacgcuaaccaauuauccagaguccaagaaauacucacuggaggaaaucgcagaugugauugagggguuuaucgccgaaaagggaaucaaagaguauauuguccucuacacaaguauauucggcgcucugcuucuguugaucgcccucauuaucacugugagccugaacaggauuaccgaauauuuaacaaaucugaacguuaucuacugucacgagugcuccauguaucacucuaagaaaaauauaaaguacaucggugacuuuacuaacaaguguggguucugcaccuguggagagcuagaagaucaggagggccucaacaugcauaaagugagcaagaaaugcauuuaccgguaucagcugacauggucaaaggucaucaugaccauucuugugugcuugcugaucgcacagaauacuguacucauaguugcugccaacgacgacuguugggcgaaacaaagucuggaaauugagugcgugggcccccuucagcaggucgaugccugugaagacaaguccagccgcucuuacaaugaggaggcaaagaaacugguggggacgucaaaggucacagaauuggaugcuggacaggugaaccuccugggucaaaccaucgagagugccauuaucgcuauacgaaaacagagaacuuaugccaccaugcacuuuuuagaaagcguuuuccugggcaggcauugcgacuacuauaagguguuugagcacaauuccggguacucucaggcaaaauggcggcuacucgccaagacaaaccauuucgauaucuguucgcgucacagcacccaccauuuuugccgcuguauguccgacggaacuaagugcgaaaauggcaacugggauuucgcuggugagaugaauacaacguaucacucaaaaagagacuuuuucaagcaugauuuuaaccuguucuguacccuuuuggagaaugcguucccugggacuacagaaagucuguacuaccaacuccugucuaaaaggaacaccacaggcgcaagcaaguuacugggaaaacuuauuacuaaguuuggcaauaacaauuuguucguagggaucuggaaauuuggacaguuccuccugucccuaccauaugucaacaacaccgagcugucagcccuccagagcucuaagauucuggaauccccggagccccuuuugcggagugcuagcggucgacaggagucucuguccucagccacgccuggcgaagcaaguaaggagugccgcaaugccaaaaagaucagcuguauaucgccaagauuuggggugcccauggaaaacuuaaccgcuugcggagaguccccuaauuacaaaauuuauaagacaccaacuaggaucuacaaaucuaacaauaagggcgaaaucuggugcgccggugacguucacuguuuccaagaguuuacccccgugcuccaggaggucguggauaagcugaaaaagaugacaugcuuccuuacugaaccggaggcagaagaggacgcguuuagcauugcuaucgccauguguaaaauucuggacaaggggguaugcaccauaaacucagaacgguggaauaucauuaaaugugauaguggcuugauguauuacacggaccagcgcgauggacaggacacaggcaacgauuucggggaguauugcaucucccacaauuguaagaccgagagauuuccuauuaaccccucuaucauaagcgacugcaucugggaauaccauuccaggaagucacguuacauuagcacucucaaucuggagagucuagaagaguucaaacgggcaaucucugaaaagcugucccacacacucauuguguaucaauuuaaaccaaccagcaaccugccucauaugaagcccguuuacaaauauaucacugcccagggagucgaaaauucggaugguauagacucagcuuucauuaccgccucuaugccagcacuuaguggcacauccaucggguacaacgugaugagcaaggauaauuuccccuuguuugacaucauuauauucaucaagucugcugugauuaaaacgaccuauaaccacaucuacgauacuggaccuacaauuggcaucaacgucaugcaugacgagcacuguaccggucagugcccaauagagaucccgcacaaggagaauuggcugacauuuagccaggaacgaacuuccagaugggggugugaggaguucggcugcuuagccauuaacaccggaugcguuuuuggcucaugucaagauaucauuaggcccgaaacgaaaguguaucgcaaggcgaucgaggaaagugugcuccugacaguaugcgucaccuacccugggaauacuuucuguaccgagauaaacgccauugaaccaaaaaucacagacgagcuugagcugcaguuuaagacuguggacaccaaaacacuacccaaucuccuggcuguucagaaccauaaguuguacagcggacagaucaaugaucugggcucuuucgcacaagguugcgggaacauucagaagacgaauuuauccgugaucggaaccggcacugccaaauuugacuauauaugucacggugcuucacggaaggauauugucgugagaaggugcuacaacaauaacuaugaaaguuguaaacuccugaaggaggaaccuagccuuaucuucuccgacaaucaugagacaauugaaguugccaacauccgccaccuguugggcgagcuccaguuuaaacugaugcuaggggaucugcgauacaagucuuucgcagagaauccagaacuugagauagaagcgcggugcgugggaugucccucgugcuucagcucauauuccuguaacuuucguauuaguucuagcaucgacaccguaugcgccaucgauggcccgugcacuauuuuccauaacagacucaucauuuccucaacaaagcaagacuacgggauaaaaaugucuuguaaggagaaaccuaauccagucgaaaaguuuaacaucugcaaaaggguguauagcgugcuguucaccacgauugauaagaaugacaagaucgagaucaacacuggagaucagaccaguuuuauucaggagaaagacgaucgcuguaagacaugguugugccgggucagagacgaaggcauauccguuaucuucgagcccauuaaagccuuuuucgguagcuacuuuucuaucgcuuucuacgugguaauugggaucauagcacuguuuaucauuaucuauauuuucuuaccuaugguguuuaagcucaaagacauccugaagaagaaugaacuucuguacuugcaggagaugaaauauaaguga

SEQ ID NO: 10872 - RNA, 4305 nt, Artificial Sequence
  derived and/or modified CDS sequence (opt3) from ANADV(EIV-18353Yak)__KT313751.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucauuuaucucaaaaacgacacuggaaucuucgcccauagcaagguacuaaggaauuggauaaucaaagauuggaagaacugcaauccagugccgaccgcggguggcuccauuaacgucaucgaagugaaugcugaccugucucuuucgacaaagaccuacguuuguucacgggauugcacuauuacaguggacaaagaggaugcccaaaucauauuucagaccgacaagcugaaccacuucgaagucagcgggacgacuuugaguuccggaugguuuaaaaccaaggcaucugugacacucgaucgcacuugugagcauauuaaaguaaccugcggcaagaagacacugcaguuccacgccuguuuuaaacaucacaugagcugcauccgauucuuucacaauaccauucugcccgguacgauggcuguuuccaucugucagaacaucgagcucauuauaaucacuucauuaacacugauuaucuucauacuuauggugauuuugaccaagacuuauaucugcuacguccugaugccucuauuuaugccaguggcauaucucuacgggugggccuauaaucguaguuguaaaaagugcagcugcuguggacuggcuuaccaucccuucacaaacugcggcucucacugugugugcggccuuaaauucgaagccuccgacagaaugaggauccaucgggagucagggcugugucaaggauacaagagcuugcgcgucgcgagacuccugugcaaaaguaaggguucuuccuuaauuaucagcauucugcucucgguucuuauacugucuuuugugaccccuaucgaaggcacguugaccaauuauccagaguccaagaaauacucacuagaggaaauugcagauguaaucgagggguucaucgccgaaaagggaauuaaagaguauauagugcuguacacaaguaucuuuggcgcucuccugcuucugauugccuugaucauuacugucagccucaacaggaucaccgaauaucugacaaauuuaaacgugauauacugucacgagugcuccauguaucacucuaagaaaaauaucaaguacauuggugacuucacuaacaaguguggguuuugcaccuguggagagcuggaagaucaggagggccuaaacaugcauaaaguuagcaagaaaugcaucuaccgguaucagcucacauggucaaaggugauuaugaccauccuggucugccuuuugauagcacagaauacugugcugauuguagcugccaacgacgacuguugggcgaaacaaagucucgaaaucgagugcguuggcccccugcaacagguggaugccugugaagacaaguccagccgcucuuacaaugaggaggcaaagaaacuugucgggacgucaaaggugacagaacuggaugcuggacaggucaacuugcucggucagaccauugagagugccaucauagcuauccgaaaacagagaacuuaugccaccaugcacuuccuggaaagcguguuuuuaggcaggcauugcgacuacuauaagguuuucgagcacaauuccggguacucucaggcaaaauggcggcugcuagccaagacaaaccauuuugauauuuguucgcgucacagcacccaccauuucugccgcuguauguccgacggaacuaagugcgaaaauggcaacugggauuuugcuggugagaugaauacaacguaucacucaaaaagagacuucuuuaagcaugauuucaaccucuucuguacccugcuugagaaugcguuuccugggacuacagaaaguuuguacuaccaacugcucucuaaaaggaacaccacaggcgcaagcaagcuguuaggaaaacugaucacuaaguucggcaauaacaaucuuuuuguggggauuuggaaauucggacaguuuuugcucucccugccauauguaaacaacaccgagcuaucagcccugcagagcucuaagauccucgaauccccggagccccugcuucggagugcuagcggucgacaggagucuuuguccucagccacgccuggcgaagcaaguaaggagugccgcaaugccaaaaagauaagcuguauuucgccaagauucgggguccccauggaaaaccugaccgcuugcggagaguccccuaauuacaaaaucuauaagacaccaacuaggaucuacaaaucuaacaauaagggcgaaauuuggugcgccggugacgugcacuguuuucaagaguucacccccguuuuacaggagguggucgauaagcucaaaaagaugacaugcuuucugacugaaccggaggcagaagaggacgcguucagcaucgcuauugccauguguaaaauacuugacaagggggugugcaccaucaacucagaacgguggaauauuaucaaaugugauaguggccugauguauuacacggaccagcgcgauggacaggacacaggcaacgauuuuggggaguauugcauuucccacaauuguaagaccgagagauucccuaucaaccccucuauaaucagcgacugcauuugggaauaccauuccaggaagucacguuacaucagcacuuugaaucucgagagucuggaagaguuuaaacgggcaauuucugaaaagcuaucccacacacugaucguauaucaauucaaaccaaccagcaaccucccucauaugaagcccguguacaaauauauaacugcccagggaguugaaaauucggaugguauugacucagcuuucaucaccgccucuaugccagcacugaguggcacauccaucggguacaacgucaugagcaaggauaauuuuccccuuuucgacauuauaaucuuuauuaagucugcugugaucaaaacgaccuauaaccacauuuacgauacuggaccuacaaucggcauaaacgugaugcaugacgagcacuguaccggucagugcccaaucgagauuccgcacaaggagaauugguugacauucagccaggaacgaacuuccagaugggggugugaggaguuuggcugccuggccaucaacaccggaugcgucuucggcucaugucaagauauuaucaggcccgaaacgaaaguuuaucgcaaggcgauagaggaaaguguguuacucacagugugcguaaccuacccugggaauacuuuuuguaccgagauuaacgccaucgaaccaaaaaucacagacgagcuggagcuucaguucaagacugucgacaccaaaacacugcccaaucuacucgcugugcagaaccauaagcuguacagcggacagauuaaugauuugggcucuuuugcacaagguugcgggaacauccagaagacgaaucuguccguuauaggaaccggcacugccaaauucgacuauauuugucacggugcuucacggaaggauaucguggucagaaggugcuacaacaauaacuaugaaaguuguaaauuacucaaggaggaaccuagccugaucuuuuccgacaaucaugagacaauugaaguggccaacauacgccaccuucugggcgaguugcaguucaaacucaugcugggggaucuacgauacaagucuuucgcagagaauccagaacuggagauugaagcgcggugcguuggaugucccucgugcuuuagcucauauuccuguaacuuccguaucaguucuagcaucgacaccgugugcgccauugauggcccgugcacuaucuuucauaacagacuuauuauauccccuacaaagcaagacuacgggaucaaaaugucauguaaggagaaaccaaaucccguagaaaaguucaacauuugcaaaagggucuauucugugcucuuuaccacgaucgauaagaaugacaagaucgagauuaacacuggagaucagaccagcuucauacaggagaaagacgaucgcuguaagacauggcugugccgggugagagacgaaggcaucagugucauuuuugagccuaucaaggcuuucuuugguuccuacuucagcauugccuuuuacguugugaucgggauaaucgcauuguucauuaucauuuauaucuuucugcccaugguauucaaauuaaaagacauacucaagaagaaugaacugcuuuaccugcaggagaugaaauauaaguga

SEQ ID NO: 10873 - RNA, 4305 nt, Artificial Sequence
  derived and/or modified CDS sequence (opt3) from ANADV(EIV-18560Yak)__KT313754.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucauuuaucucaaaaacgacacuggaaucuucgcccauagcaagguacuaaggaauuggauaaucaaagauuggaagaacugcaauccagugccgaccgcggguggcuccauuaacgucaucgaagugaaugcugaccugucucuuucgacaaagaccuacguuuguucacgggauugcacuauuacaguggacaaagaggaugcccaaaucauauuucagaccgacaagcugaaccacuucgaagucagcgggacgacuuugaguuccggaugguuuaaaaccaaggcaucugugacacucgaucgcacuugugagcauauuaaaguaaccugcggcaagaagacacugcaguuccacgccuguuuuaaacaucacaugagcugcauccgauucuuucacaauaccauucugcccgguacgauggcuguuuccaucugucagaacaucgagcucauuauaaucacuucauuaacacugauuaucuucauacuuauggugauuuugaccaagacuuauaucugcuacguccugaugccucuauuuaugccaguggcauaucucuacgggugggccuauaaucguaguuguaaaaagugcagcugcuguggacuggcuuaccaucccuucacaaacugcggcucucacugugugugcggccuuaaauucgaagccuccgacagaaugaggauccaucgggagucagggcugugucaaggauacaagagcuugcgcgucgcgagacuccugugcaaaaguaaggguucuuccuuaauuaucagcauucugcucucgguucuuauacugucuuuugugaccccuaucgaaggcacguugaccaauuauccagaguccaagaaauacucacuagaggaaauugcagauguaaucgagggguucaucgccgaaaagggaauuaaagaguauauagugcuguacacaaguaucuuuggcgcucuccugcuucugauugccuugaucauuacugucagccucaacaggaucaccgaauaucugacaaauuuaaacgugauauacugucacgagugcuccauguaucacucuaagaaaaauaucaaguacauuggugacuucacuaacaaguguggguuuugcaccuguggagagcuggaagaucaggagggccuaaacaugcauaaaguuagcaagaaaugcaucuaccgguaucagcucacauggucaaaggugauuaugaccauccuggucugccuuuugauagcacagaauacugugcugauuguagcugccaacgacgacuguugggcgaaacaaagucucgaaaucgagugcguuggcccccugcaacagguggaugccugugaagacaaguccagccgcucuuacaaugaggaggcaaagaaacuugucgggacgucaaaggugacagaacuggaugcuggacaggucaacuugcucggucagaccauugagagugccaucauagcuauccgaaaacagagaacuuaugccaccaugcacuuccuggaaagcguguuuuuaggcaggcauugcgacuacuauaagguuuucgagcacaauuccggguacucucaggcaaaauggcggcugcuagccaagacaaaccauuuugauauuuguucgcgucacagcacccaccauuucugccgcuguauguccgacggaacuaagugcgaaaauggcaacagagauuuugcuggugagaugaauacaacguaucacucaaaaagggacuucuuuaagcaugauuucaaccucuucuguacccugcuugagaaugcguuuccugggacuacagaaaguuuguacuaccaacugcucucuaaacggaacaccacaggcgcaagcaagcuguuaggaaaacugaucacuaaguucggcaauaacaaucuuuuuguggggauuuggaaauucggacaguuuuugcucucccugccauauguaaacaacaccgagcuaucagcccugcagagcucuaagauccucgaauccccggagccccugcuucgaagugcuagcggucgccaggagucuuuguccucagccacgccuggcgaagcaaguaaggagugcagaaaugccaaaaagauaagcuguauuucgccaagguucgggguccccauggaaaaccugaccgcuugcggagaguccccuaauuacaaaaucuauaagacaccaacucggaucuacaaaucuaacaauaagggcgaaauuuggugcgccggugacgugcacuguuuucaagaguucacccccguuuuacaggagguggucgauaagcucaaaaagaugacaugcuuucugacugaaccggaggcagaagaggacgcguucagcaucgcuauugccauguguaaaauacuugacaagggggugugcaccaucaacucagaacgcuggaauauuaucaaaugugauaguggccugauguauuacacggaccagagagauggacaggacacaggcaacgauuuuggggaguauugcauuucccacaauuguaagaccgagagguucccuaucaaccccucuauaaucagcgacugcauuugggaauaccauucccguaagucacgguacaucagcacuuugaaucucgagagucuggaagaguuuaaacgagcaauuucugaaaagcuaucccacacacugaucguauaucaauucaaaccaaccagcaaccucccucauaugaagcccguguacaaauauauaacugcccagggaguugaaaauucggaugguauugacucagcuuucaucaccgccucuaugccagcacugaguggcacauccaucggguacaacgucaugagcaaggauaauuuuccccuuuucgacauuauaaucuuuauuaagucugcugugaucaaaacgaccuauaaccacauuuacgauacuggaccuacaaucggcauaaacgugaugcaugacgagcacuguaccggucagugcccaaucgagauuccgcacaaggagaauugguugacauucagccaggaaagaacuuccaggugggggugugaggaguuuggcugccuggccaucaacaccggaugcgucuucggcucaugucaagauauuauccgccccgaaacgaaaguuuaucggaaggcgauagaggaaaguguguuacucacagugugcguaaccuacccugggaauacuuuuuguaccgagauuaacgccaucgaaccaaaaaucacagacgagcuggagcuucaguucaagacugucgacaccaaaacacugcccaaucuacucgcugugcagaaccauaagcuguacagcggacagauuaaugauuugggcucuuuugcacaagguugcgggaacauccagaagacgaaucuguccguuauaggaaccggcacugccaaauucgacuauauuugucacggugcuucaagaaaggauaucguggucaggcgcugcuacaacaauaacuaugaaaguuguaaauuacucaaggaggaaccuagccugaucuuuuccgacaaucaugagacaauugaaguggccaacauacgacaccuucugggcgaguugcaguucaaacucaugcugggggaucuacgguacaagucuuucgcagagaauccagaacuggagauugaagcgcguugcguuggaugucccucgugcuuuagcucauauuccuguaacuucagaaucaguucuagcaucgacaccgugugcgccauugauggcccgugcacuaucuuucauaacaggcuuauuauauccccuacaaagcaagacuacgggaucaaaaugucauguaaggagaaaccaaaucccguagaaaaguucaacauuugcaaacgcgucuauucugugcucuuuaccacgaucgauaagaaugacaagaucgagauuaacacuggagaucagaccagcuucauacaggagaaagacgaucgguguaagacauggcugugcagagugagggacgaaggcaucagugucauuuuugagccuaucaaggcuuucuuugguuccuacuucagcauugccuuuuacguugugaucgggauaaucgcauuguucauuaucauuuauaucuuucugcccaugguauucaaauuaaaagacauacucaagaagaaugaacugcuuuaccugcaggagaugaaauauaaguga

SEQ ID NO: 10874 - RNA, 4305 nt, Artificial Sequence
  derived and/or modified CDS sequence (opt3) from ANADV(EIV-18715Yak)__KT313757.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucacuuaucucaaaaacgacaccggaauuuucgcccauagcaagguacuaaggaauuggaucauaaaagauuggaagaacugcaauccagugccgacagcggguggcuccaucaacgucauugaagugaaugcugaccugucucuuucgaccaagacuuacguuuguucacgggauugcacaaucaccguggacaaagaggaugcccaaauuaucuuucagacggacaagcugaaccacuucgaagucagcgggacuaccuugaguuccggaugguuuaaaacaaaggcaucugugacucucgaucgcaccugugagcauauaaaaguaacaugcggcaagaagacccugcaguuccacgccuguuuuaaacaucacaugagcugcauucgauucuuucacaauacgauccugcccgguacuauggcuguuuccauuugucagaacaucgagcucaucauuauaacaucauuaacccugaucauuuucauccuuauggugauauugacuaagacauauauuugcuacguccugaugccucuauuuaugccaguggcauaucucuacgggugggccuauaaucguaguuguaaaaagugccccugcuguggacuggcuuaccauccuuucaccaacugcggcagccacugugugugcggccuuaaauucgaagccucugacagaaugaggauccaucgggaguccgggcugugucaaggauacaagucauugcgcgucgcgagacuccugugcaaaagcaaggguaguucuuuaaucauuuccauccugcucagcguucuuauucugucguuugugacgccaauagaaggcaccuugacaaauuaucccgagucuaagaaauacucccuagaggaaaucgcagauguaauugagggguucaucgccgaaaagggaaucaaagaguauauugugcuguacacuucaauauuuggcgcucuccugcuucugaucgccuugauuaucaccgucagucucaacaggauuacagaauaucugacuaauuuaaacgugaucuacugucacgagugcagcauguaucacuccaagaaaaauauaaaguacaucggugacuucaccaacaaguguggguuuugcacauguggagagcuggaagaucaggagggccuaaacaugcauaaaguuucuaagaaaugcauuuaccgguaucagcucaccuggagcaaggugaucaugacuauucugaucugccuuuugauagcacagaauacgguccugauuguggcugccaacgacgacuguugggcgaaacaaucacucgaaaucgagugcguaggcccucugcagcagguugaugccugugaagacaagaguucccgcagcuacaauggggaggcaaagaaacuugugggaacaucucgagucaccgagcuggaugcuggucaggugaacuugcucggccaaacuauugaaucagccaucauagcuaucagaaagcagaggaccuaugccacaaugcacuuccuggagagugucuuuuuagggcggcauugcgacuacuauaaaguguucgaacacaauagcggauacucccaggcaaaguggcgucugcuagccaaaaccaaccauuuugauauuuguucucgccacucgacucaccauuucugcagauguaugagcgacggcacaaagugcgagaaugguaacugggauuuugcuggggaaaugaauacgaccuaucacuccaagagggacuucuuuaaacaugauuucucacucuucuguacucugcuugagaacgcguuuccaggcacaaccgagaguuuguacuaccaacugcucucuaagcggaauacaacuggagcaagcaaacuguuaggcaagcugaucaccaaauucgggaacaauaaccuuuuuguuggaauuuggaaguucggucaguuuuugcucucccugccguaugugaauaacacggaacuaucagcccugcagagcucuaaaauccucgagucccccgaaccucugcuucgaagugcuagcggccgccaggagucuuuguccucagccaccccaggggaggcaaguaaggaaugcagaaacgccaagaaaauaagcuguauuucgcccagguucggaguaccuauggagaaucugacagcuugcggcgaauccccaaacuacaagaucuauaaaacucccacccggaucuacaagucuaauaacaaaggugagauuuggugcgccggggacguccacuguuuucaagaauuuacaccgguguuacaggagguuguggauaagcucaagaaaaugacuugcuuucugaccgagccugaagcagaggaagacgcguucagcaucgcuauugccauguguaagauacuugacaaaggcgucugcacgaucaauucagagcgcuggaacauuaucaagugugauaguggacugauguauuacacagaccagagagauggccaggacaccgggaaugauuuuggagaauauugcauuucccacaacuguaaaacugagagguuccccaucaauccaucuauaaucagcgacugcgugugggaguaccauucccguaagucacgguacauuagcacauugaaccucgaaagucuggaggaauuuaagcgagcaaucucugagaaacuaucccacacccugguaguguaucaauucaagccuacuagcaaucucccccauaugaaaccaguuuacaaguauauuaccgcccagggugucgaaaacucggauggcaucgacucagcuuucauaacagccucuaugcccgcacugagugggacguccauuggauacaaugugaugagcaaagauaacuuuccucuuuucgacaucaucauuuuuauaaagucugcugugaucaagaccacuuauaaucacauuuacgauacaggcccaaccaucgguauuaacgucaugcaugacgagcacuguacagggcagugcccgaucgagauaccccacaaagaaaacugguugacuuucagccaggagagaaccuccagguggggcugugaagaguuuggaugccuggccaucaauacgggcugcguuuucgggucaugucaagauauuauccgcccugagacaaagguguaucggaaagcgauugaagagaguguguuacucaccguaugcgucacuuacccaggaaacaccuuuuguacagaaaucaaugccauagagcccaagauuacugacgaacuggagcuucaguucaaaaccguggacacaaagacgcugccuaaccuacucgcuguucagaaucauaaacuguacagcggccagaucaacgauuuggguucuuuugcacaagggugcggaaauauccagaagaccaaccuguccgugauuggcacugguacagccaaguucgacuauaucugucacggcgcuucaagaaaagauauagucgugaggcgcugcuacaauaacaauuaugagaguuguaaguuacucaaagaggaaccaagccugauuuucuccgacaaccaugaaaccaucgagguugccaauauucgacaccuucugggggaauugcaguucaagcucaugcugggagaucuacgguacaaaucuuucgcagagaaccccgagcuggaaaucgaggcgcguugcgugggcuguccgucgugcuuuagcucauauuccuguaauuucagaauaaguucuagcauugacacuguaugcgccaucgaugggccuugcacaaucuuucauuccaggcuuauuaucucaucuaccaagcaagacuacggaauuaagaugagcuguaaagaaaagccaaaccccgucgagaaauucaacauaugcaagcgcguguauagugugcucuuuacgacuaucgauaaaaaugacaagauugaaaucaacaccggcgaucagacauccuucauccaggagaaggacgaucgguguaaaaccuggcugugcagagucagggacgaggguauuagcguuauauuugaaccuaucaaggcuuucuuugggucuuacuucucaauugccuuuuacgugguaaucggaauuaucgcauuguucauaaucauuuauaucuuucugcccaugguguucaaauuaaaggacauucucaaaaagaaugagcugcuuuaccugcaggaaaugaaguauaaauga

SEQ ID NO: 10875 - RNA, 4305 nt, Artificial Sequence
  derived and/or modified CDS sequence (opt3) from ANADV(EIV-23263Tyum)__KT313760.1__GP
auguuccugauccucgugcuucugauucccuuuuacauaaccgccacaccugucacuacgagaugcuuccacggcgggcaguugaucgcugagagcaaguccuuaaccgcaauuucugaauuuugucugaaagacgauguuucaacagugaagagugagaucacuuaucuaaagaacgacaccggaauuuucgcccauagcaagguacucaggaauuggaucauaaaagauuggaagaacugcaauccagugccgacagcggguggcuccaucaacgucauugaagugaaugcugaccugucucuuucgaccaagacuuacguuuguucacgggauugcacaaucaccguggacaaagaggaugcccaaauuaucuuucagacggacaagcugaaccacuucgaagucagcgggacuaccuugaguuccggaugguuuaaaacaaaggcaucugugacucucgaucgcaccugugagcauauaaaaguaacaugcggcaagaagacccugcaguuccacgccuguuuuaaacaucacaugagcugcauucgauucuuucacaauacgauccugcccgguacuauggcuguuuccauuugucagaacaucgagcucaucauuauaacaucauuaacccugaucauuuucauccuuauggugauauugacuaagacauauauuugcuacguccugaugccucuauuuaugccaguggcauaucucuacgggugggccuauaaucguaguuguaaaaagugcagcugcuguggacuggcuuaccaucccuucaccaacugcggcucucacugugugugcggccuuaaauucgaagccuccgacagaaugaggauccaucgggagucagggcugugucaaggauacaagagcuugcgcgucgcgagacuccugugcaaaaguaaggguucuuccuuaaucauuagcauccugcucucgguucuuauucugucuuuugugacgccuauagaaggcaccuugacaaauuauccagaguccaagaaauacucacuagaggaaaucgcagauguaauugagggguucaucgccgaaaggggaaucaaggaguauauugugcuguacaccaguauauuuggcgcucuccugcuucugaucgccuugauuaucacugucagccucaaccggauuacagaauaucugacuaauuuaaacgugaucuacugucacgagugcuccauguaucacucuaaaaagaauauaaaauacaucggugacuucaccaacaaguguggguuuugcacauguggagagcuggaagaucaggagggccuaaacaugcauaagguuagcaaaaagugcauuuaccgcuaucagcucaccuggucaaaagugaucaugacuauucuggucugccuuuugaucgcacagaauacggugcugauaguagcugccaacgacgacuguugggcgaagcaaagucucgaaauugagugcguuggcccccugcaacagguggaugccugugaagacaaauccagccgaucuuacaauggggaggcaagaaaacuugucggaacaucaaaggugaccgagcuggaugcuggucaggucaacuugcucggccagacuaucgaaagugccauuaucgcuauaaggaaacagcggaccuaugccacaaugcacuuccuggagagcguguuuuuagggcgucauugcgacuacuauaagguuuucgaacacaauuccggauacucucaggcaaaauggcgccugcuagccaagaccaaccauuuugauaucuguucgagacacagcacucaccauuucuguaggugcauguccgacggcacaaaaugcgagaaugguaacugggauuuugcuggggaaaugaauacgaccuaucacucaaagcgggacuucuuuaagcaugauuucaaacucuucuguacucugcuugagaacgcguuuccuggcacaaccgagaguuuguacuaccaacugcucucuaagcgaaauacaacuggagcaagcaaacuguuaggcaagcugauuaccaaauucgggaacaauaaccuuuuugugggaaucuggaaguucggucaguuuuugcucucccugccauauguaaauaacacggaacuaucagcccugcagagcucuaaaauucucgaguccccggaaccccugcuucgcagugcuagcggcagacaggagucuuuguccucagccaccccuggggaggcaaguaaggaaugcaggaacgccaagaaaaucagcuguauaucgccacgguucggaguccccauggagaaucugacagcuugcggcgaauccccuaacuacaagauuuuuaaaacuccaacccgcaucuauaagucuaauaacaaaggugagaucuggugcgccggggacgugcacuguuuccaagaauuuacacccauuuuacaggagguuguggauaagcucaagaaaaugacuugcuuccugaccgagccggaagcagaggaagacgcguuuagcaucgcuauugccauguguaagauacuugacaaaggcgucugcacgaucaauucagagagauggaacauuaucaagugugauaguggacugauguacuauacagaccagagggauggccaggacaccgggaaugauuucggagaauacugcauuucccacaacuguaaaacugagcguuuuccuaucaaucccucuauaaucagcgacugcauuugggaguaucauucccggaagucacgauacaucagcacauugaaccucgaaagucuggaggaguucaagagagcaauuucugagaaacuaucccacacccuggugguauaccaauucaagccaacuagcaaucucccucauaugaaacccguguauaaguacaucaccgcccaggguguugaaaacucggauggcauagacucagcuuuuauuacagccucuaugccagcacugagugggacguccaucggauauaaugucaugagcaaagauaacuucccccuuuuugacaucauuauauucaucaagucugcugugauuaagaccacuuacaaucacaucuaugauacaggcccuaccauugguaucaacgugaugcaugacgagcacuguacagggcagugcccaauagagaucccgcacaaagaaaacugguugacuuuuagccaggagaggaccucccgcuggggcugugaagaguucggaugccuggccauuaauacgggcugcgucuuugggucaugucaagauaucauucggcccgagacaaagguuuacagaaaagcgaucgaagagaguguguuacucaccgugugcguaacuuauccuggaaacaccuucuguacagaaauaaaugccauugagccaaagaucacugacgaacuggagcuucaguuuaaaaccgucgacacaaagacgcugcccaaccuacucgcugugcagaaucauaaacuguacagcggccagaucaacgauuuggguucuuucgcacaagggugcggaaauauucagaagaccaaccuguccguuaucggcacugguacagccaaguuugacuacauaugucacggcgcuucaaggaaagauauugugguccgccgaugcuauaauaacaauuacgagaguuguaaguuacucaaagaagaaccuagccugaucuucuccgacaaccaugaaaccauugagguggccaauauccggcaccuucugggggaauugcaguucaagcucaugcugggagaucuacguuauaaaucuuuugcagagaacccagagcuggaaauagaggcgagaugcguuggcugucccucgugcuucagcucauacuccuguaauuuuaggauuaguucuagcaucgacacugugugcgccaucgaugggccgugcacaauuuuccauaaccgccuuaucauuuccucaaccaagcaagacuauggaauaaagaugucuuguaaagaaaagccuaacccaguagagaaauuuaauaucugcaagcgggucuacagcgugcucuuuacgacuauugauaaaaacgacaagaucgaaaucaauaccggcgaucagacaaguuuuauucaggagaaggacgauagauguaaaaccuggcugugcagggugcgagacgaggguauauccgucaucuucgaacccauuaaggcuuucuucgggagcuauuuuucuaucgccuucuacguugugauuggaaucauagcauuguuuaucauuaucuacauuuuccugccuaugggcuucaaauuaaaggacauccucaaaaagaacgagcugcuuuaucugcaggaaaugaaguacaaauga

SEQ ID NO: 10876 - RNA, 4305 nt, Artificial Sequence
  derived and/or modified CDS sequence (opt3) from BATV(804992)__FJ436801.1__GP
augcugcuccuucugguguuguuaauccccugcugugucagcgccuccccuguuauuaccagaugcuuccacggcgggcagcugauagcugagaggaagucucaagcagccaucucagaauuuugucuaaaagacgaugugaguacaauuaagagcgagaucauuuacgaaaagaacgacacuggacucuucgcgcauaauaagguacugcggaacuggaucauaaaagauuggaagaauugcaacccagugccgacggcugguggcuccaucaaugucauugaggugaacaccgaccuuucucugacaacuaagaccuauguuuguucgcgcgauugcacaaucaccguggacaaagaagaugcccagauuaucuuucagacugagaaguugaaucacuucgaggucucagggacaacccucagcaguggaugguuuaaaacgaaggcauccgugacucuggaccgaaccugugaacauauaaaaguaacaugcggcaagaagacucugcaguuccacgccuguuuuaaacaucacaugucuugcauucguuucuuucacgguaccauccuccccgggacaauggcuaccagcauuugucaaaacaucgaguuaaucauuauaaucucccugacgcuuauuaucuucauauugaugguuauucugacuaagacauacaucugcuaucuacucaugccucuguuuaugccaaucgcauacuucuauggauggucauacaauaaaaguugcaagaaaugucccugcuguggccuugccuaucauccuuuuaccaacugcggcagccacugugugugcgggcugaaguucgaggcuucugauagaaugaggauucaucgggaauccggauugugucaggguuacaaaucacuccgcgucgccagacuguuaugcaagagcaagggcaguucucugaucauuuccauacuccuuagcaugcugaucuugucguucgugacuccaauugaggggacacuaaccaauuaccccgaaucuaggaaauaugaccuggaggaaaucgcggaugugcucgagggauuugucguugaaaagggcaucaaagaguacgugguauucuauacguccauuuuuggugcacuguuccuucugauggccuugauagugaucauugcucucaaccgggucaccgaguaccugacaaauaucaacguguuauauugucacgaaugcucaauguaccacaguaagaaaaauauuaaguauaucggggacuuuacuaacaaguguggauucuguaccugcggcgagcuggaagaucaggagggccuaaaaauacauaagguuagccgcaaaugcaucuacaaguaccagcucacaugguccaaagugauuaugaugauccuggucugccuuuugauugcccaaaacacuauccugauaguggcagcuucugacgacuguuggaccaaaaagagccucgaaauggagugcauugggccucugcagcagguagauacaugugacgauaaaaccucacgaaguuauuccggagaggccaagaaacuuguuagagcgagcaagaucucugaccuggaugccgcacagguggguuugcucggcucaacuauugaaagugcuaucgccagcauaaggcggcaacguacguacuccacaaugcaccuguuagagucugucuuucuggggaaacauugcgacuauuacaagguguucgaacacaauucgggauauagccaggcuaaguggcgccuaaccgccaaaacucaucacuuugauaucuguuccagacacucaacccaucacuucuguaggugcauuagugacggcacaaagugccagaacggugauugggacuuugcaggggagaugaacucuaucuaccaaagcaaaaaggauuucuuuaaacaugacuucaaacucuucuguacccuggucgaaaaugccuuuccaggcacuacagagucccuuuucuaugagauguugucaaagaagaauacgaccggaauuacuaagcugcucgacaaacugacaaagaaauuuggcaacaauaacauguucguggggaucuggaaguuuggacaguacuuaaugagccugccguacguuaaugaaaccucucuuucccccauacaguuggcuaaagugcucgagguaacagaucagcaccaccggagugucagcggucgacaagaaucucuggcguccgcaacuccuggcucaaagaguagcgagugcgaccaugccaagaaagugucgugcauuuccccacgcuucggggcucccauggagggacuaauggccuguggcaacucuccuaauuauaagaucuacaaaaccccagcaaagcuguauaaaagcaacaauaagggugaaguuuggugcucaggggaugugcacuguuuucaggagcucacgcccgccagucaggaauccgucgacagaaucaagcagaugaccugcuuccugacagagccggaagugaacgaugacguauuuucuauugcuaucgccauguguaaagugcaagauaagggcguuugcacuauuaaugaggacagguggaacauaaucaaaugugauagcggacuuauuuacuauaccgaccagcgggagggccaggauacagggaacgacuucggagaauacugcuugucccauucaugucgcaucgagagauuuccuauuaaucccgcaaucauaagcgauugccugugggaauaucacaguaggaagucuaaauacaucacuuccuuagaccucgagagccuggaagaguucaagcgugcgauuucggagaaacuuucacauacccuggucguguacaacuuuaaaccaacggcuaauuugccucacaucaagcccguguauaaauacauuacaguccaggguguugaaaacucugacggcguggauagugccuauaucaccgcauccaugccagcccucagcgggacuucuauaggauacaauauuaugagccgggacaacuucccccuguucgauaucaucauuuuuauaaaguccgcuaucauuaaagccacauauaaucacaucuacgacaccggcccuacuauugguaucaacgugaugcaugaugagcacuguaccgggcaaugcccaacagacauaccgcauaaggaaaauuggaucacguucgcacaggagcgaaccucaagauggggcugcgaagaguuuggaugucuagcuguaaacacuggcugcgucuucgggaguugucaggauauuaucaggcccgagacaaaaguguaucgcaaggccguugaagagagcgugcugcucaccgucugcauuacauacccuggaaagacuuuuuguaccgaaaucaaugcgauagagccaaaaauuacggacgagcuggaacuucaguucaagacaguggauaccaaaacuuugcccaacauccuggccguucaaaaucacaaguuauacucuggccagaucaacgaccucgguuccuuuucacaggggugcggaaauauucaaaagaccaacaguagcaucauaggcacagguacugcuaaguucgauuaugugugucauggcgcaucccggaaggacauuaucguaagaaggugcuacaacaauaacuaugagucuuguaaacugcuuaaggaggaacagucgcugauguuugccgauaaucacgaaaccauugacgucgcuaacgugcgccaccuacucggggaccugcaguucaaauugaugcugggagauuuacgauacaagagcuuugccgagaauccugaccucgagaucgaagcaaaaugcgugggcuguccaucaugcuucacauccuauaguugcucuuucaagauagucagcaacauugauacgguuuguuccaucgaggggcccugcaccacuuuucauaaucggcugaugaucacaucaaccaagcaggacuacggaauuaaaaugucuuguaagacuaaaccgggccuuacagaagaguuccaaaucugcaagaaaaccuauacggugcuguuugcgacuguagaaaagaacgauaagauugagauaagcaccggugaccagacaaguuucauccaggagcgugaugacagauguaaaaccugguugugcagggugcgcgaugaagggauuuccgucaucuuugagccuauccgggccuucuuuggaagcuacuucucuauugcuuuuuacauagugaucggcauuaucguucucuuccuggugauuuauaucuuucuaccaaugauguucaagcugagagacguccuuaaaaggaaugaauaccucuaucugcaggagauaaagcacaaauga

SEQ ID NO: 10877 - RNA, 4305 nt, Artificial Sequence
  derived and/or modified CDS sequence (opt3) from BATV(8627-11)__FJ436799.1__GP
augcugcuccuucugguguuguuaauccccugcugugucagcgccuccccuguuauuaccagaugcuuccacggcgggcagcugauagcugagaggaagucucaagcagccaucucagaauuuugucuaaaagacgaugugaguacaauuaagagcgagaucauuuacgaaaagaacgacacuggacucuucgcgcauaauaagguacugcggaacuggaucauaaaagauuggaagaauugcaacccagugccgacggcugguggcuccaucaaugucauugaggugaacaccgaccuuucucugacaacuaagaccuauguuuguucgcgcgauugcacaaucaccguggacaaagaagaugcccagauuaucuuucagacugagaaguugaaucacuucgaggucucagggacaacccucagcaguggaugguuuaaaacgaaggcauccgugacucuggaccgaaccugugaacauauaaaaguaacaugcggcaagaagacucugcaguuccacgccuguuuuaaacaucacaugucuugcauucguuucuuucacgguaccauccuccccgggacaauggcuaccagcauuugucaaaacaucgaguuaaucauuauaaucucccugacgcuuauuaucuucauauugaugguuauucugacuaagacauacaucugcuaucuacucaugccucuguuuaugccaaucgcauacuucuauggauggucauacaauaaaaguugcaagaaaugucccugcuguggccuugccuaucauccuuuuaccaacugcggcagccacugugugugcgggcugaaguucgaggcuucugauagaaugaggauucaucgggaauccggauugugucaggguuacaaaucacuccgcgucgccagacuguuaugcaagagcaagggcaguucucugaucauuuccauacuccuuagcaugcugaucuugucguucgugacuccaauugaggggacacuaaccaauuaccccgaaucuaggaaauaugaccuggaggaaaucgcggaugugcucgagggauuugucguugaaaagggcaucaaagaguacgugguauucuauacguccauuuuuggugcacuguuccuucugauggccuugauagugaucauugcucucaaccgggucaccgaguaccugacaaauaucaacguguuauauugucacgaaugcucaauguaccacaguaagaaaaauauuaaguauaucggggacuuuacuaacaaguguggauucuguaccugcggcgagcuggaagaucaggagggccuaaaaauacauaagguuagccgcaaaugcaucuacaaguaccagcucacaugguccaaagugauuaugaugauccuggucugccuuuugauugcccaaaacacuauccugauaguggcagcuucugacgacuguuggaccaagcgaagccucgaaauggagugcauugggccucugcagcagguagauacaugugacgauaagaccucaagaaguuauuccggagaggccaaaaagcugguuagggcgagcaaaaucucugaccuugaugccgcacagguggguuugcucggcucaacuauugaaagugcuaucgccagcauacggcgucaacgcacguacuccacaaugcaccuguuagagucugucuuucuggggaagcauugcgacuauuacaaaguguucgaacacaauucgggauauagccaggcuaaguggagacuaaccgccaagacucaucacuuugauaucuguuccaggcacucaacccaucacuucugccgguguauuagugacggcacaaaaugccagaacggugauugggacuuugcaggggagaugaacucuaccuaccaaagcaagaaagauuucuuugaacaugacuucaaacucuucuguacucuggucgagaaugccuuuccaggcacaacggagucccuuuucuaugaaauguugucaaagaagaauaccacuggaaucacaaaacugcucgacaagcugaccaagaaauuuggcaacaauaacauguucguggggauuuggaaguuuggacaguacuuaaugagccugccguacguuaaugagacaucucuuucccccacucaguuggcuaaagugcucgaaguaaccgaucagcaccaccgaagugucagcggucgccaagagucucuggcguccgcaacgccuggcucaaagaguagcgagugcgaccaugccaaaaaggugucgugcaucuccccaagauucgggguucccauggaaggacuaauggcuuguggcaacucuccuaauuauaagauauacaaaaccccagccaagcuguauaaaagcaacaauaagggugagguguggugcucagggaacguccacuguuuucaggaacucaaucccgcaagucaggaguccguggauaggauuaaacagaugacaugcuuccugacugaaccggagguaaacgacgauguguuuucuaucgccaucgcuauguguaagguucaagacaagggcgucugcaccauuaacaaagaucgguggaauaucauuaagugugacagcggacuuauauacuauacagaucagcgcgagggccaggacacugggaacgauuucggagaauacugcuugucccauucauguagaaucgagagguuuccuauuaaucccgccaucauuagcgacugccugugggaauaucacagucguaaaucuaaguacaucaccuccuuagaucucgagagccuggaagaguucaaacgggcaauaucggagaaacuuucacauacgcuggugguguacaacuuuaagccaacagcgaauuugccucacaucaaacccgucuaugaauacauuaccguucaggguguggagaacucugacggcguggacagugcuuauaucacugccuccaugccagcacucagcgggacaucuauuggauacaauaucaugagccgagauaacuucccccuguucgacauaauuaucuuuaucaaguccgccauuauaaaagcuaccuauaaucacaucuacgauacuggcccuaccauugguaucaacguaaugcaugacgaacacuguacagggcaaugcccaacggauauuccgcauaaggagaauuggaucaccuucgcccaggaaagaacuucaagguggggcugcgaggaguuuggaugucuagcagucaacacaggcugcguguucgggaguugucaggacauaauccgccccgaaaccaaaguuuaucggaaggcuguggaggaaagcguccugcucacagugugcauuacuuacccuggaaaaaccuuuuguacggagaucaaugccauugagccaaagaucacagaugaacuggagcuucaguucaagaccguugacacuaaaaccuugcccaacauacuggcggugcaaaaucacaaguuauacucuggccagauuaacgaucucgguuccuuuucacaggggugcggaaacauccagaaaacaaauaguagcaucauuggcacugguaccgccaaguucgacuauguaugucauggcgcuuccagaaaagauaucauagucaggcgcugcuacaacaauaacuaugaaucuuguaagcugcuuaaggaggaacaaucgcugauguuugcagacaaucacgagacaauugauguggccaacgugcgacaccuacucggggaccugcaguucaaauugaugcugggagacuuacgguacaagagcuuugcugagaauccugaucucgaaaucgaggccaaaugcgucggcuguccaucaugcuucacguccuauaguugcucuuucaagauuguuagcaacaucgacaccguguguuccauagaagggcccugcacuacauuucauaaucgucugaugauuaccucaacuagacaggauuacggaaucaaaaugucuuguaagacaaagccgggccuuaccgaggaauuucaaaucugcaaaaagacguauacuguacuguucgcaaccguggagaaaaacgacaagauugagaucagcacaggugaucagaccaguuucauucaggaaagggacgaucgcuguaaaacuugguugugccgggucagagacgaggggauauccgugaucuuugaaccuauuagggcguucuuuggaagcuacuucucuaucgccuuuuacaucguuauuggcauaaucguccucuuccuggugauuuauaucuuucuaccaaugauguucaagcugcgagaugugcuuaagcgcaaugaguaccucuaucugcaggaaauuaaacacaaguga

SEQ ID NO: 10878 - RNA, 4305 nt, Artificial Sequence
  derived and/or modified CDS sequence (opt3) from BATV(Chittoor/IG-20217)__JX846599.1__GP
augcugcuccuucugguguuguuaauccccugcugugucagcgccuccccuguuauuaccagaugcuuccacggcgggcagcugauagcugagaggaagucucaagcagccaucucagaauuuugucuaaaagacgaugugaguacaauuaagagcgagaucauuuacgaaaagaacgacacuggacucuucgcgcauaauaagguacugcggaacuggaucauaaaagauuggaagaauugcaacccagugccgacggcugguggcuccaucaaugucauugaggugaacaccgaccuuucucugacaacuaagaccuauguuuguucgcgcgauugcacaaucaccguggacaaagaagaugcccagauuaucuuucagacugagaaguugaaucacuucgaggucucagggacaacccucagcaguggaugguuuaaaacgaaggcauccgugacucuggaccgaaccugugaacauauaaaaguaacaugcggcaagaagacucugcaguuccacgccuguuuuaaacaucacaugucuugcauucguuucuuucacgguaccauccuccccgggacaauggcuaccagcauuugucaaaacaucgaguuaaucauuauaaucucccugacgcuuauuaucuucauauugaugauuauccugacuaagacauacaucugcuaucuacucaugccucuguuuaugccaauugcauacuucuauggauggucauacaauaaaaguugcaagaaaugucccugcuguggccuugccuaucauccuuuuaccaacugcggcagccacuguguuugcgggcugaaguucgaggcuucugauagaaugaggauccaucgggaauccggauugugucaggguuacaaaucacuccgcguggccagacuguuaugcaagagcaagggcaguucucugauuauauccauccuccuuagcaugcugauuuugucguucgucacuccaaucgaggggacacuaaccaauuaccccgaaucuaggaaauaugaccuggaggaaaucgcggaugugcucgagggauuuguggucgaaaagggcauuaaagaguacguuguguucuauacguccauauuuggugcacuguuccuucugauggccuugaucguaauuaucgcucucaaccgggugaccgaguaccugacaaauauuaacgucuuauauugucacgaaugcucaauguaccacaguaagaaaaauaucaaguauauaggggacuuuacuaacaaguguggauucuguaccugcggcgagcuggaagaucaggagggccuaaaaauccauaaggugagccgcaaaugcauuuacaaguaccagcucacaugguccaaaguuaucaugaugauucuggugugccuuuugaucgcccaaaacacuauacugauugucgcagcuucugacgacuguuggaccaaaaagagccucgaaauggagugcaucgggccucugcaacagguggauacaugugacgauaaaaccucacgaaguuauuccggagaggccaagaaacuuguaagagcgagcaagauuucugaccuggaugccgcacagguugguuugcucggcucaacuaucgaaagugcuauagccagcaucaggcggcagcguacguacuccacaaugcaccuguuagagucuguguuucuggggaaacauugcgacuauuacaaggucuucgaacacaauucgggauauagccaggcuaaguggcgccuaaccgccaaaacucaucacuuugauauuuguuccagacacucaacccaucacuucuguaggugcaucagugacggcacaaagugccagaacggugauugggacuuugcaggggagaugaacucuaccuaccaaagcaaacgggauuucuuugaacaugacuucaaacucuucuguacucugauugagaaugccuuuccaggcacaacggagucccuuuucuaugaaauguugucaaagaagaauaccacuggaaucacaaaacugcucgacaagcugaccaagaaauuuggcaacaauaacauguucguggggauauggaaguuuggacaguacuuaauuagccugccguacgucaaugagacaucucuuucccccacucaguuggcuaaagugcucgaaguuaccgaucagcaccaccgaaguaucagcggucgccaagagucucuggcguccgcaacgccuggcucaaagaguagcgagugcgaccaugccaaaaaggcuucgugcaucuccccaagauucggggugcccauggaaggacuaauggccuguggcaacucuccuaauuauaagauuuacaaaaccccagcaaagcuguauaaaagcaacaauaagggugagguauggugcucagggaacuuucacuguuuccaggaacucauccccgccagucaggaguccgucgauaggauuaaacagaugacaugcuuucugacugaaccggaggugaaugacgauguuuucucuauagcuaucgccauguguaaggugcaagacaagggcgucugcaccauuaacaaagaucgguggaacgugaucaagugugacagcggacuuauuuacuauacagaucagcgcgagggccaggacacugggaaugauuuuggagaauacugcuugucccauucauguagaaucgagagguucccuauaaaccccgcaaucauuagcgacugccugugggaauaucacagucguaaaucuaaguacaucaccuccuuagaucucgagagccuggaagaguuuaaacgggcgauuucggagaaacuuucacauacgcugaucguauacaauuucaagccaacagcuaacuugccucacauaaaacccguguauaaguacauuaccguucagggugucgaaaauucugacggcguggacagugccuauaucacugcauccaugccagcccucagcgggacaucuaucggauacaacauuaugagccgagauaauuucccccuguuugacauaaucauuuucaucaaauccgcuauuaucaaggccaccuauaaccacauauacgauacuggcccuaccaucgguauuaaugugaugcaugacgagcacuguacagggcaaugcccaacggauaucccgcauaaagaaaacuggauuaccuuugcacaggagagaacuucaagguggggcugcgaagaguucggaugucuagcugucaauacaggcugcguuuuugggaguugucaggacaucauacgccccgagaccaagguguaucggaaagccguggaagagagcguacugcucacagucugcauuacuuacccuggaaagaccuucuguacggaaaucaacgcgaucgagccaaagauuacagaugagcuggaacuucaguuuaaaaccguggacaucaagacuuugcccaauauacuggccguucaaaaccacaaauuauacucuggccagauuaaugaucucgguuccuucucacaggggugcggaaacauccaaaagaccaacaguagcauuaucggcacagguacugcuaaauuugacuaugugugucauggcgcauccagaaaggauauaauugucaggcgcugcuacaauaacaauuaugagucuuguaagcugcuuaaagaggaacagucgcugauguucgccgacaaccacgaaaccaucgauguggcuaauguucgacaccuacucggggaccugcaguuuaaguugaugcugggagacuuacgguacaagagcuucgccgagaacccugaucucgagaucgaagcaaagugcgugggcuguccaucaugcuucacauccuauaguugcucuuuuaaaauuguaagcaauaucgacacggucuguuccauugaggggcccugcaccacuuuccauaaccgucugaugauaacaucaaccaagcaggauuacggaaucaagaugucuuguaaaacuaagccgggccuuacagaagaguuucaaauuugcaaaaagaccuauacggugcuguucgcgacuguggagaaaaaugacaagaucgaaaucagcaccggugaucagacaaguuuuauucaggagagagacgauagguguaagaccugguugugccgcguccgggacgaagggauauccguuaucuucgagccuauuagagccuuuuucggaagcuacuuuucuaucgcuuucuacauugugaucggcauaaucguacucuuucuggugauuuauaucuuccuaccaaugauguuuaaacugagggauguccuuaagcgaaacgaauaccucuaucugcaggagauuaaacacaaguga

SEQ ID NO: 10879 - RNA, 4305 nt, Artificial Sequence
  derived and/or modified CDS sequence (opt3) from BATV(41.3)__KM507322.1__GP
auguuacucuuccuuauccuguugauucccugcuacgccagcgcuuccccuguggucaccagauguuuucacggcgggcaguuaauagcagagucuaggucaccaacagccguuagugaauuuugccugaaggacgaugugagcacuaucaaauccgagauuaucuauguaaagaacgacacgggacuauuugcgcauaauaaagugcuccggaacuggauuaucaaggauuggaaaaauuguaacccgguccccaccgcugguggcucuauaaaugugaucgaaguuaacacagaccugucgcuuucaacuaagaccuacgugugcagccgcgauuguacaauuaccgucgacaaggaggaugcccaaaucauuuuccagacugaaaaacugaaucacuuugaggugagugggacaaccuuguccucuggaugguucaagacgaaagcaagcguaacucucgaccgaaccugcgagcauaucaagguuacauguggcaaaaagacucugcaguuucacgccugcuucaagcaucacauguccuguauacguuucuuccacucaaccauucugccugguacaauggcuaccaguaucugccagaacauugaacucaucaucauuauaagccugacgcugcuuaucuuuauuuugauggcaauccugacuaaaacauauauauguuaccuacucaugccacuguucaugcccauugccuaucuuuacggguggucuuauaauagauccugcaagaaaugcucauguugcggacuggcuuaccauccuuuuaccaacuguggcagccacugcguguguggcuugaaguucgaggccagugauaggaugcggauccaucgcgaaucugggcucugccaaggauacaaaucccugagagucgcgagguuacuguguaagagcaaagguucgucucucaucauuuccauccuucugucaauguugauucuaaguuucgugacuccaauagagggcacacugaccaauuaucccgagagccggaaguacgaccucgaagagaucgcagaugugcuggaaggguuuauuacggagaagggaaucaaagaauaugucguuuucuacaccuccaucuuuggcggucuuuuccuguugcucgcccugauuauaaucauugcuuuaaaccgcgugacagaguaucugacuaauaucaacguauuuuacugccacgaguguucuauguaucacagcaagaaaaauauuaaguacaucggggacuucaccaacaaaugcggauuuuguacaugcggcgaacuagaggaucaggaaggccucaagauacauaaggugucacgaaaaugcaucuacaaguaucagcugacuuggaguaaaauuaucaugauuauccuugucuguuugcugauagcccagaacaccauucucaucguggcagcuuccaaugacugcugggccaagaaaagccuggagauggaauguauugggccucuucaacagguugagucuugcgacgauaaggcgucaagaaguuacagcggagaggccaagaaacuggugagggcauccaagaucucugacuuggaugcugcccaggucggucuccugggcucgacaauagaaagcgcuaucgccuccauucggaaacagcguaccuauccaacuaugcacuuacuggagucaguguuccuagcaaagcauugugacuacuauaaaaguuuugaacacaacucuggguacagccaagccaaguggcgccucacggcuaagacacaucacuucgauaucugcuccagacacucaacccaucacuuuuguaggugcauuagcgacggaacuaaaugucagaauggcgauugggacuucgcgggugagaugaacucuaccuaucaguccaagaaagauuucuucgaacaugacuucaagcuguuuugcacacuuuuggagaaugcauucccggggaccacugagaguuuuuacuaccaaaugcugcagaaaaagaacacaacgggcguaguuaaacuccuggaugaauuaaccaagaaguucggaaauaacaauauguuugugggcaucuggaaauucgggcaguaucugaugagccuucccuacauaaacgagacuucuuugacaccucuccagcuguccaagauucuagaagccucaaaucaacaccaccggaguaucagcggacgacaggagucgcuggcuaacgccgcauccgguggcaaaucuaaggagugugaccaugccaaaaaggucagcugcaucucaccacgcuuuggggugcccauggaaggacucauugcuugcggcaguuccccuaauuauaagaucuacaaaaugccaaccaagcuguauaaaucuaacaauaagggugaggucugguguagcggggacgugcacugcuuccaggaacuuaaccccgccucccaggagucaguugauagaauuaaacaaaugacaugcuuuuugacugaaccggagaccaacgaggacguguucagcauagcaaucaguauguguaagguacaggauaagggcgucuguacgauuaaugaagagagguggaacgugaucaaaugcgacucuggacugauuuacuauaccgaucagcgggacggccaggauacagggaaugacuuuggagaauacuguuuaucccauaacugccgcaucgagagauucccuauaaaucccacuaucauuaacgauugucucugggaauaccacagcaggaagucgaaauauaucaccucacuggaccuugagucucuggaggaauuuaagcgugcgauuagugagaaauugucccauacacucaucguuuacaauuucaagccaacugcuaaccugccucacauaaagcccguguauaaauacauuaccguccaagguguggaaaauagcgauggcguagacucugccuauaucacggcaagcaugccagcccuauccgggacaucaaucggauacaacauuaugaguaaggauaauuucccccuguuugacauaaucauuuucaucaaaagcgcugugauuaaggccaccuauaaccacaucuacgacacuggcccuacaauagguaucaauguuaugcaugaugagcacugcaccgggcaguguccaacugacauuccgcauaaagaaaacuggaucaccuuuucucaggagcggacaucccgauggggcugcgaggaauuuggaugccucgcagucaauacgggcuguguguuugggucaugccaggauauuaucagacccgagaccaagguguacaggaaagcuauagaagagaguguccugcuuacuguuuguauuacauauccuggaaagaccuucugcacagagaucaacgccaucgaaccaaagauuacugacgaguuggaacugcaauuuaaaaccguggauacgaagacauuacccaacauccucgcggugcagaaucacaaacuguacagcggccagauaaacgaccuugguuccuucucucaaggguguggaaauauucagaagaccaacucgagcaucauuggcacugguaccgccaaauuugauuauguaugccauggcgcuucacgcaaggacaucauaguccggagauguuacaauaacaauuaugaguccugcaggcugcuaaaggaggaacagagucucauguucgcagauaaccacgagacaauugacguggccaauguucgccaccuguugggggaucugcaguuuaaauuaaugcucggagaccugcgauacaagucuuucgcugaagauccugaccuugagaucgaagccaaaugugugggcugcccaagcuguuucacuuccuauucaugcaacuuucggaucgucucuaauauugacaccgugugcagcaucgaggggcccuguacaacguuccauaaccgucugaugauuaccaguacuaagcaagauuacggaauaaaaauguccugcaagggcaagccggguagcacagaagaguuucagaucuguaaaaagaccuacacuguuuuguucacaaccguggagaaaaaugacaagauugaaaucaacacgggggaucagacuucuuuuauccaggagagagacgauaggugcaaaaccuggcucugucgcguacgggacgaaggaauuucagucauauucgagccuaucagagcauuuuucggcuccuauuuuaguauugcguucuacaucgugguggguauuaucguccuguuucuaaugauauauaucuuccugccaauggccuuuaaacuuagggauguucucaagcgaaaugaauaccuguauuugcaagagauuaagcacaaguga

SEQ ID NO: 10880 - RNA, 4305 nt, Artificial Sequence
  derived and/or modified CDS sequence (opt3) from BATV(EIV-1217Astr)__KT313699.1__GP
augcuucucuuccuuauccuguugauucccugcuacgccagcgcuuccccuguggucaccagauguuuucacggcgggcaguuaauagcagagucuaggucaccaacagccguuagugaauuuugccugaaggacgaugugagcacuaucaaauccgagauuaucuauguaaagaacgacacgggacuauuugcgcauaauaaagugcuccggaacuggauuaucaaggauuggaaaaauuguaacccgguccccaccgcugguggcucuauaaaugugaucgaaguuaacacagaccugucgcuuucaacuaagaccuacgugugcagccgcgauuguacaauuaccgucgacaaggaggaugcccaaaucauuuuccagacugaaaaacugaaucacuuugaggugagugggacaaccuuguccucuggaugguucaagacgaaagcaagcguaacucucgaccgaaccugcgagcauaucaagguuacauguggcaaaaagacucugcaguuucacgccugcuucaagcaucacauguccuguauacguuucuuccacgguaccauucugccugggacaauggcuaccucaaucugccagaacauugaacucaucaucauuauaaguuuaacgcugcuuaucuuuauuuugauggcaauccugacuaaaacauauauauguuaccuacucaugccacuguucaugcccauugccuaucuuuacggauggagcuauaauagaucuugcaagaaaugcuccuguugcggccuggcuuaccauccuuuuaccaacuguggcucacacugcguguguggguugaaguucgaggccagcgauaggaugcggauccaucgcgaaaguggacucugccaagguuacaaaucucugagagucgcgagguuacuguguaaguccaaaggcagcucgcucaucauuucuauccuucuguccauguugauucuaucauucgugacuccaauagaggggacacugaccaauuaucccgagagucggaaguacgaccucgaagagaucgcagaugugcuggaaggauuugucacggagaagggcauuaaagaauauguuguguucuacaccagcaucuuuggugggcuuuuccuguugcucgcccugaucauuauaaucgcuuuaaaccgcguaacagaguaucugacuaauauuaacguguuuuacugccacgaguguuccauguaucacucuaagaaaaauaucaaguacauuggagacuucaccaacaaaugcggcuuuuguacaugcggcgaacuagaggaucaggaagggcucaagauccauaaggucagccgaaaaugcauauacaaguaucagcugacuuggucaaaaaucauuaugaucauucuuguguguuugcugaucgcccagaacaccauacucauuguugcagcuaguaaugacugcugggccaagaaaucccuggagauggaauguaucggaccucuucaacagauggagagcugcgacgauaaggcgucuagaucauacaguggugaggccaagaaacuggugagggcaagcaagauuuccgacuuggaugcugcccaggucggccuccuggggucuacaaucgaaucggcuauagccagcauccggaaacagcguaccuauccaacuaugcacuuacuggaguccguguuccuagcaaagcauugugacuacuauaaaucauuugaacacaacaguggauacucucaagccaaguggcgccucacggcuaagacacaucacuucgauauuugcagcagacacuccacccaucacuuuuguaggugcaucucagacggcacuaaaugucagaauggugauugggacuucgcgggggagaugaacagcaccuaucagucuaagaaagacuuuuucaagcaugauuucaaacuguuuugcacacuuuuggaaaaugcauucccgggcaccacugaguccuuuuacuaccaaaugcugcagaagaaaaacacaacgggaguaguuaagcuccuggaugaguuaaccaagaaauucggcaauaacaauauguuuguggggauuuggaaguucggacaguaucugaugagucuucccuacaucaacgaaacuagcuugacaccucuccagcugucuaaaauacuagaggccuccgaccaacaccaccggucaauuaguggucgacaggaaagccuggcuaaugccgcaucgggcgggaaguccaaagagugugaccaugccaagaaggucucuugcaucagcccacgcuuuggagugcccauggagggccucaucgcuugcggugggucaccuaacuauaaaauuuacaagaugccaaccaaacuguauaagaguaauaacaaaggcgaagucugguguuccggagaugugcacugcuuccaggagcuuaaucccgccuugcaggaaucuguugacagaaucaagcaaaugacauguuuucugacugagccggaaaccaacgaggauguguucagcauugcaauauccaugugcaagguacaggacaaaggcgucuguacgaucaacgaggaaagguggaaugugauuaagugcgauucaggguuaaucuacuauaccgaccagcgggauggacaggacacagguaacgauuuuggcgaguacugucucagccauaauugccgcauugaaagauucccuaucaaccccacuauaaucaaugacugucugugggaguaccacaguaggaaaucuaaguauauuaccucccuugaucuggaaaguuuggaggaguuuaaacgugcgaucucggaaaagcucucacauacacugauuguuuacaacuucaagccaacugcuaaucuaccucacaucaaacccguguauaaguacauaaccguccaagggguggagaacucugacggaguagauagugccuauauuacggcauccaugccagcccugagcggcacaucuaucgguuacaauaucaugagcaaagacaacuucccccucuuugacauuauaaucuucauuaaguccgcugugaucaaagccaccuauaaucacauuuacgauacugggccuacaaucggcauaaacguuaugcaugacgaacacugcaccggacaguguccaacugauaucccgcauaaggagaauuggauuaccuuuucacaggaacggacaagucgauggggcugcgaggaguucgggugccuggcagucaacacgggauguguguuuggcagcugccaggacaucauuagacccgaaaccaaaguguacaggaaggcuaucgaggaaucuguccuuuugacuguuuguauaacauauccugguaagaccuucugcacagagauuaaugccaucgagccaaaaaucacugaugaacuggaguuacaauuuaagaccguggacacgaaaacacuccccaacauucuggcggugcagaaccacaagcuguacuccgggcagaucaaugaucugggaucauucagucaaggcugugguaacauacagaaaaccaauagcuccauuaucggcacugggaccgccaaguuugacuauguaugccauggagcuucucgcaaggauauuaucguccggagauguuacaacaauaacuaugaaucgugcaggcuacucaaagaggaacagagccugauguucgcagacaaucacgagacaauagauguggccaacguucgccacuugcugggcgacuuacaguuuaagcucaugcugggggaucuucgauacaaaucauucgcugaggacccugaccuggaaauugaggccaagugugugggaugcccauccuguuucacuagcuauucuugcaauuuucggaucgucagcaacaucgauaccgugugcuccauugaaggccccuguacaacguuccauaaucguuugaugaucaccucaacuaaacaagacuacgguauuaagaugucuugcaaggggaaaccgggaagcacagaggaauuucagauauguaagaaaaccuacacuguucucuucacaaccguggagaagaacgauaaaaucgagauuaauacgggcgaccagaccaguuuuauccaggaaagagaugacaggugcaagacuuggcugugucgcguacgggaugaggguaucuccgucguguucgaaccuauuagagcauuuuucggcagcuauuuuucuauagcguucuacaucguggucgggauuaucguucuauuucuggugauuuauaucuuccuuccaauggccuuuaagcucagggacguacugaaacgaaacgaguacuuguaucugcaagaaauaaagcacaaauga

SEQ ID NO: 10881 - RNA, 4305 nt, Artificial Sequence
  derived and/or modified CDS sequence (opt3) from BATV(EIV-12497Bl)__KT313692.1__GP
augcuccucuuccuuauccuguugauucccugcuacgccagcgcuuccccuguggucaccagauguuuucacggcgggcaguuaauagcagagucuaggucaccaacagccguuagugaauuuugccugaaggacgaugugagcacuaucaaauccgagauuaucuauguaaagaacgacacgggacuauuugcgcauaauaaagugcuccggaacuggauuaucaaggauuggaaaaauuguaacccgguccccaccgcugguggcucuauaaaugugaucgaaguuaacacagaccugucgcuuucaacuaagaccuacgugugcagccgcgauuguacaauuaccgucgacaaggaggaugcccaaaucauuuuccagacugaaaaacugaaucacuuugaggugagugggacaaccuuguccucuggaugguucaagacgaaagcaagcguaacucucgaccgaaccugcgagcauaucaagguuacauguggcaaaaagacucugcaguuucacgccugcuucaagcaucacauguccuguauacguuucuuccacgguaccauucugccugggacaauggcuaccucaaucugccagaacauugaacucaucaucauuacgaguuuaacucugcuuauauuuaucuugauggcaauucugacaaaaaccuauaucuguuaccuacucaugccacuguucaugcccauagccuaucuuuacggauggagcuauaauagaucuugcaagaaaugcuccuguugcggccuggcuuaccauccuuuuacuaacuguggcucacacugcguguguggguugaaguucgaggccagcgauaggaugcggauucaucgcgaaaguggacucugccaagguuacaaaucucugagagucgcgagguuacuguguaaguccaaaggcagcucgcucaucaucucuauucuucuguccauguugauccuaucauucgugacaccaauugaggggacccugacgaauuaucccgagagucggaaguacgaccucgaagagauagcagaugugcuggaaggauuuaucaccgagaagggcauuaaagaauaugucguuuucuacacaagcaucuuuggugggcuuuuccuguugcucgcccugaucauuauaaucgcuuuaaaccgcgugacugaguaucugaccaauauuaacguauuuuacugccacgaguguuccauguaucacucuaagaaaaauaucaaguacauuggagacuucacaaacaaaugcggcuuuuguacuugcggcgaacuagaggaucaggaagggcucaagauccauaaggugagccgaaaaugcauauacaaguaucagcugaccuggucaaaaaucauuaugaucauucuugucuguuugcugaucgcccagaacacaauacucauuguggcagcuaguaaugacugcugggccaagaaaucccuggagauggaauguaucggaccucuucaacagguugagagcugcgacgauaaggcgucuagaucauacaguggugaggccaagaaacuggugagggcaagcaagauuuccgacuuggaugcugcccaggcuggccuccuggggucuaccaucgaaucggccauagcaagcauccggaaacagcguacuuauccaacgaugcacuuacuggaguccgucuuccuagccaagcauugugacuacuauaaaucauuugaacacaacaguggauacucucaagcuaaguggcgccucacagcgaagacccaucacuucgauauuugcagcagacacuccacucaucacuuuuguaggugcaucucagacggcaccaaaugucagaauggugauugggacuucgcaggggagaugaacagcacauaucagucuaagaaagauuucuucgaacaugacuucaagcuguuuugcacccuuuuggagaaugccuucccgggcacuacagaguccuuuuacuaccaacugcuccagaaaaagaacacgaccggagugguaaaacuguuagaugaacugacuaagaaguucggcaauaacaauauguuuguugggauuuggaaauucggacaguaucuuaugaguuugcccuacaucaacgagacaagccucaccccucugcagcuaucuaagauacuggaggcuuccgaccaacaccaccggucaauuaguggucgacaggaaagccucgccucggcagccuccggcgggaaaucuaaggagugugaccaugcuaaaaaggugagcugcaucucaccacgcuuuaguguccccauggaaggacugaucgccugcggcuccucuccuaauuauaagauuuacagaaugccaacaaaacuuuauaagagcaacaauaaaggugaggugugguguuccggggauguccacugcuuccaggaauugaaccccgcaucacaggagagcguggacaggaucaagcaaaugauuuguuuucugacugaaccggagguuaaugaggauguguucaguauagcgaucucuaugugcaaaguacaggacaagggcgucuguaccauuaacgaggaacgguggaacgugaucaagugcgauuccggauuaauuuacuauacggaccagcgcgauggccaggacaccgggaaugauuuuggagaauacugucucagccauaacugcagaaucgagagguucccuauaaaucccacaaucauuaacgacugucugugggaauaccacucgcguaaaucaaaguauaucacuucucuugaucuggagaguuuggaggaauuuaaacgggcuauuuccgagaagcucagccauacccugaucguuuacaauuucaaaccaacagccaaccuaccucacauaaagcccguguauaaguacauuacuguccaagguguggaaaauucugacggcguagauagcgcauauaucaccgccuccaugccagcucugucagggacgaguaucggauacaacauuaugagccgagacaauuucccccucuuugacauaaucauuuucaucaaaucugccgugauuaaggcaacauauaaccacaucuacgauaccggcccuacuauagguaucaauguuaugcaugacgagcacugcacagggcaguguccaaccgauauuccgcauaaagaaaacuggaucacuuuuucccaggagagaaccucaagguggggcugcgaggaauuuggaugccuggcugucaauacaggcuguguguuugggaguugccaggacauuauccgccccgagacgaagguguaccggaaagccgucgaagagagcguucuuuugaccguguguauaacuuauccuggaaagacauucugcaccgagauuaacgcgaucgaaccaaaaaucacagaugagcuggaauuacaauuuaagacuguggacaccaagacgcuccccaauauucuggccguacagaaccacaaacuuuacuccggccagaucaacgaucuggguucuuucucgcaaggguguggaaauauacagaagacaaacagcucaauuaucggcaccgguacugcuaaauuugacuaugucugccauggcgcauccagaaaggauauuaucgugaggcgcuguuacaauaacaauuaugagaguugccgacuacucaaagaggaacagucucugauguucgccgacaaccacgagaccauagauguugcuaaugugcggcacuugcugggggacuuacaguuuaagcucaugcugggagaucuucguuacaagagcuucgccgaagacccuggccuggagauugaagcaaaaugugucgggugcccauccuguuucacaucauauucuugcaacuuuagaaucgugagcaauaucgacacuguuugcaguauugagggacccuguaccacauuccauaacagguugaugaucacguccaccaagcaagauuacggcauuaaaaugagcugcaaggguaaaccggggucuacugaagaguuucagauauguaagaagacauacaccgugcuguucacuacaaucgagaaaaaugacaagauugaaaucaacaccggagaucagacgucauuuguacaggagcgcgacgaucggugcaaaacuuggcuguguagagucagggacgaaggcaucuccgugauuuucgagccuauacgagcguuuuucgguaguuauuuuagcaucgccuucuacauuguggucggcaucauuguucuauuucuggugaucuauauauuccuuccaauggcuuuuaagcuccgcgauguacugaaacggaaugaauacuuguaucugcaagagaucaagcacaaguga

SEQ ID NO: 10882 - RNA, 4305 nt, Artificial Sequence
  derived and/or modified CDS sequence (opt3) from BATV(EIV-12845Ms)__KT313690.1__GP
augcuucucuuccuuauccuguugauucccugcuacgccagcgcuuccccuguggucaccagauguuuucacggcgggcaguuaauagcagagaacaggucuccaacagccguuucagaauuuugccugaaggacgaugugaguacuaucaaaagcgagauuaucuauguaaagaaugacacgggacuauuugcgcauaacaaagugcuccggaauuggauuaucaaggauuggaaaaacuguaauccgguccccaccgcugguggcuccauaaacgugaucgaaguuaauacagaccugucucuuucgacuaagaccuacgugugcucacgcgauuguacaauuaccgucgacaaggaggaugcccaaaucauuuuccagacugaaaaacugaaccacuuugaggugagcgggacaaccuugaguuccggaugguucaagacgaaagcaucuguaacucucgaccgaaccugcgagcauaucaagguuacauguggcaaaaagacucugcaguuucacgccugcuucaagcaucacaugagcuguauacguuucuuccacuccaccauucugccugguacaauggcuaccucaaucugccagaauauugaacucaucaucauuauaaguuuaacgcugcuuaucuuuauuuugauggcaauccugacuaaaacauauauauguuaccuacucaugccacuguucaugcccauugccuaucuuuacggguggagcuauaacagaucuugcaagaaaugcuccuguugcggacuggcuuaccauccuuuuaccaauuguggcucacacugcguguguggcuugaaguucgaggccagcgauaggaugcggauccaucgcgaaagugggcucugccaaggauacaaaucucugagagucgcgagguuacuguguaaguccaaagguagcucgcucaucauuucuauccuucuguccauguugauucuaucauucgugacuccaauagagggcacacugaccaacuaucccgagagucggaaguacgaccucgaagagaucgcagaugugcuggaaggguuuauuacggagaagggaaucaaagaauaugucguuuucuacaccagcaucuuuggcggucuuuuccuguugcucgcccugauuauaaucauugcuuuaaaucgcgugacagaguaucugacuaacaucaauguauuuuacugccacgaguguuccauguaucacucuaagaaaaacauuaaguacaucggggacuucaccaacaaaugcggauuuuguacaugcggcgaacuagaggaucaggaaggccucaagauacauaaggugagccgaaaaugcaucuacaaguaucagcugacuuggucaaaaauuaucaugauuauccuugucuguuugcugauagcccagaauaccauucucaucguggcagcuaguaacgacugcugggccaagaaaucccuggagauggaauguauugggccucuucaacagguugagagcugcgacgauaaggcgucuagaucauacaguggagaggccaagaaacuggugagggcaagcaagaucuccgacuuggaugcugcccaggucggucuccugggcucuacaauagaaucggcuaucgccagcauucggaaacagcguaccuauccaacuaugcacuuacuggaguccguguuccuagcaaagcauugugacuacuauaaaucauuugaacacaauaguggguacucucaagccaaguggcgccucacggcuaagacacaucacuucgauaucugcagcagacacuccacccaucacuuuuguaggugcauuucagacggaacuaaaugucagaacggcgauugggacuucgcgggugagaugaauagcaccuaucagucuaagaaagauuucuucgaacaugacuucaagcuguuuugcacacuuuuggagaacgcauucccggggaccacugaguccuuuuacuaccaaaugcugcagaaaaagaauacaacgggcguaguuaaacuccuggaugaauuaaccaagaaguucggaaacaauaacauguuugugggcaucuggaaauucgggcaguaucugaugagucuucccuacauaaaugagacuagcuugacaccucuccagcugucuaagauucuagaagccuccgaccaacaccaccggucaaucaguggacgacaggagagccuggcuaacgccgcaucggguuccaaaucuaaggagugugaccaugccaaaaaggucagcugcaucucaccacgcuuuggcgugcccauggaagggcucauugcuugcggaaguuccccuaauuauaagaucuacaaaaugccaaccaagcuguauaaaucuaacaauaagggcgaggucugguguagcggugaugugcacugcuuccaggaacuuaaccccgccucccaggagucaguugacagaauuaaacaaaugacaugcuuuuugacugaaccggagaccaacgaggauguguucagcauagcaaucaguauguguaagguacaggacaagggggucuguacgauuaaugaagagagguggaacgugaucaaaugcgauucuggccugauuuacuauaccgaccagcgggauggacaggacacaggcaaugauuuuggggaauacuguuuaucccauaacugccgcaucgagagauucccuauaaaucccacuaucauuaacgacugucucugggaauaccacagcaggaagucgaaauauaucaccucacuggaucuugagucucuggaggaauuuaagcgugcgauuagugagaaauugucccauacacucaucguuuacaauuucaagccaacugcuaaccugccucacauaaagcccguguauaaauacauuaccguccaaggaguggaaaauagcgacgguguagauucugccuauaucacggcaagcaugccagcccuauccggcacaucaaucggguacaacauuaugaguaaggacaauuucccccuguuugacauaaucauuuucaucaaaagcgcugugauuaaggccaccuauaaccacaucuacgauacuggaccuacaauaggcaucaauguuaugcaugacgagcacugcaccggucaguguccaacugauauuccgcauaaagaaaacuggaucaccuuuucucaggagcggacaucccgaugggggugcgaggaauuuggcugccucgcagucaauacgggauguguguuuggcucaugccaggacauuaucagacccgagaccaagguguacaggaaagcuauagaagagaguguccugcuuacuguuuguauuacauauccugggaagaccuucugcacagagaucaacgccaucgaaccaaagauuacugaugaguuggaacugcaauuuaaaaccguggacacgaagacauuacccaacauccucgcggugcagaauuacaaacuguauagcggacagauaaacgaucuuggcuccuucucucaagguugugggaauauucagaagaccaacucgagcaucauuggaacuggcaccgccaaauuugacuacguaugccacggugcuucacgcaaggauaucauaguccggagauguuauaauaacaauuacgaguccugcaggcugcuaaaggaggaacagagucucauguucgcagacaaccaugagacaauugauguggccaauguucgccaccuguugggcgaccugcaguuuaaauuaaugcucggggaucugcgauauaagucuuucgcugaagacccugaccuugagaucgaagccaaaugugugggaugcccaagcuguuucacuuccuacucaugcaacuuucggaucgucucuaauauugauaccgugugcagcaucgagggccccuguacaacguuccacaaccgucugaugauuaccaguacuaagcaagacuacgggauaaaaauguccugcaagggaaagccgggcagcacagaagaguuucagaucuguaaaaagaccuauacuguuuuguucacaaccguggagaaaaaugauaagauugaaaucaacacgggugaccagacuucuuuuauccaggagagagaugacaggugcaaaaccuggcucugucgcguacgggaugaagggauuucagucauauucgagccuaucagagcauuuuucggauccuacuuuaguauugcguucuauaucguggugggcauuaucguccuguuucuaguuauauacaucuuccugccaauggccuuuaagcugagggacgugcucaagcgaaaugaauaucuguacuugcaagagauuaaacauaaguga

SEQ ID NO: 10883 - RNA, 4305 nt, Artificial Sequence
  derived and/or modified CDS sequence (opt3) from BATV(EIV-2077Astr)__KT313702.1__GP
augcuccuguuccuuauccuguugauucccugcuacgccagcgcuuccccuguggucaccagauguuuucacggcgggcaguuaauagcagagucuaggucaccaacagccguuagugaauuuugccugaaggacgaugugagcacuaucaaauccgagauuaucuauguaaagaacgacacgggacuauuugcgcauaauaaagugcuccggaacuggauuaucaaggauuggaaaaauuguaacccgguccccaccgcugguggcucuauaaaugugaucgaaguuaacacagaccugucgcuuucaacuaagaccuacgugugcagccgcgauuguacaauuaccgucgacaaggaggaugcccaaaucauuuuccagacugaaaaacugaaucacuuugaggugagugggacaaccuuguccucuggaugguucaagacgaaagcaagcguaacucucgaccgaaccugcgagcauaucaagguuacauguggcaaaaagacucugcaguuucacgccugcuucaagcaucacauguccuguauacguuucuuccacgguaccauucugccugggacaauggcuaccucaaucugccagaacauugaacucaucaucauuauaaguuuaacgcugcuuaucuuuauuuugauggcaauccugacuaaaacauauauauguuaccuacucaugccacuguucaugcccauugccuaucuuuacggauggagcuauaauagaucuugcaagaaaugcuccuguugcggccuggcuuaccauccuuuuaccaacuguggcucacacugcguguguggguugaaguucgaggccagcgauaggaugcggauccaucgcgaaaguggacucugccaagguuacaaaucucugagagucgcgagguuacuguguaaguccaaaggcagcucgcucaucauuucuauccuucuguccauguugauucuaucauucgugacuccaauagaggggacacugaccaauuaucccgagagucggaaguacgaccucgaagagaucgcagaugugcuggaaggauuugucacggagaagggcauuaaagaauauguuguguucuacaccagcaucuuuggugggcuuuuccuguugcucgcccugaucauuauaaucgcuuuaaaccgcguaacagaguaucugacuaauauuaacguguuuuacugccacgaguguuccauguaucacucuaagaaaaauaucaaguacauuggagacuucaccaacaaaugcggcuuuuguacaugcggcgaacuagaggaucaggaagggcucaagauccauaaggucagccgaaaaugcauauacaaguaucagcugacuuggucaaaaaucauuaugaucauucuuguguguuugcugaucgcccagaacaccauacucauuguugcagcuaguaaugacugcugggccaagaaaucccuggagauggaauguaucggaccucuucaacagauggagagcugcgacgauaaggcgucuagaucauacaguggugaggccaagaaacuggugagggcaagcaagauuuccgacuuggaugcugcccaggucggccuccuggggucuacaaucgaaucggcuauagccagcauccggaaacagcguaccuauccaacuaugcacuuacuggaguccguguuccuagcaaagcauugugacuacuauaaaucauuugaacacaacaguggauacucucaagccaaguggcgccucacggcuaagacacaucacuucgauauuugcagcagacacuccacccaucacuuuuguaggugcaucucagacggcacuaaaugucagaauggugauugggacuucgcgggggagaugaacagcaccuaucagucuaagaaagauuucuucgaacaugacuucaagcuguuuugcacacuuuuggagaaugcauucccgggcaccacugaguccuuuuacuaccaaaugcugcagaaaaagaacacaacgggaguaguuaaacuccuggaugaauuaaccaagaaguucggcaauaacaauauguuuguggggauuuggaaauucggacaguaucugaugagucuucccuacaucaacgagacuagcuugacaccucuccagcugucuaagauacuagaagccuccgaccaacaccaccggucaauuaguggucgacaggagagccuggcuaaugccgcaucgggcgggaaauccaaggagugugaccaugccaaaaaggucucuugcaucagcccacgcuuuggagugcccauggaaggccucaucgcuugcggugggucaccuaacuauaagauuuacaaaaugccaaccaagcuguauaaaaguaauaacaagggcgaggucugguguuccggagaugugcacugcuuccaggaacuuaaucccgccuugcaggagucuguugacagaaucaaacaaaugacauguuuucugacugaaccggagaccaacgaggauguguucagcauugcaauauccaugugcaagguacaggacaagggcgucuguacgaucaacgaagagagguggaaugugauuaaaugcgauucaggguuaaucuacuauaccgaccagcgggauggacaggacacagguaacgauuuuggcgaauacugucucagccauaauugccgcauugagagauucccuaucaaccccacuauaaucaaugacugucugugggaauaccacaguaggaagucuaaauauauuaccucccuugaucuggagagcuuggaggaauuuaagcgugcgaucucggagaaacucucacauacacugauuguuuacaacuucaagccaacugcuaaucuaccucacaucaagcccguguauaaauacauaaccguccaagggguggaaaacucugacggaguagauagugccuauauuacggcauccaugccagcccugagcggcacaucuaucgguuacaauaucaugagcaaggacaacuucccccucuuugacauuauaaucuucauuaaauccgcugugaucaaggccaccuauaaucacauuuacgauacugggccuacaaucggcauaaacguuaugcaugacgagcacugcaccggacaguguccaacugauaucccgcauaaagaaaauuggauuaccuuuucacaggagcggacaagucgauggggcugcgaggaauuugggugccuggcagucaacacgggauguguguuuggcagcugccaggacaucauuagacccgagaccaagguguacaggaaagcuaucgaagagucuguccuuuugacuguuuguauaacauauccugguaagaccuucugcacagagauuaaugccaucgaaccaaagaucacugaugagcuggaauuacaauuuaaaaccguggacacgaagacacuccccaacauucuggcggugcagaaccacaaacuuuacuccgggcagaucaaugaucugggaucauucagucaaggcugugguaacauacagaagaccaauagcuccauuaucggcacugggaccgccaaauuugacuauguaugccauggagcuucucgcaaggauauuaucguccggagauguuacaacaauaacuaugagucgugcaggcuacucaaggaggaacagagccugauguucgcagacaaucacgagacaauagauguggccaacguucgccacuugcugggcgacuuacaguuuaaacucaugcugggggaucuucgauacaagucauucgcugaagacccugaccuggagauugaagccaaaugugugggaugcccauccuguuucaccaguuauucuugcaauuuucggaucgucagcaacaucgauacugugugcuccauugagggccccuguacaacguuccauaaucguuugaugaucaccucaacuaagcaagacuacgguauuaaaaugucuugcaaggggaagccgggaagcacagaagaguuucagauauguaaaaagaccuacacuguucucuucacaaccguggagaaaaacgauaagaucgaaauuaauacgggcgaccagaccaguuuuauccaggagagagaugacaggugcaaaacuuggcugugucgcguacgggaugaagguaucuccgucguguucgagccuauuagagcauuuuucggcagcuauuuuucuauagcguucuacaucguggucgggauuaucguucuauuucuggugauuuauaucuuccuuccaauggccuuuaagcucagggacguacugaagcgaaacgaauacuuguaucugcaagagauaaaacacaaguga

SEQ ID NO: 10884 - RNA, 4305 nt, Artificial Sequence
  derived and/or modified CDS sequence (opt3) from BATV(Italy-2009)__KC168047.1__GP
auguuacucuuccuuauccuguugauucccugcuacgccagcgcuuccccuguggucaccagauguuuucacggcgggcaguuaauagcagagucuaggucaccaacagccguuagugaauuuugccugaaggacgaugugagcacuaucaaauccgagauuaucuauguaaagaacgacacgggacuauuugcgcauaauaaagugcuccggaacuggauuaucaaggauuggaaaaauuguaacccgguccccaccgcugguggcucuauaaaugugaucgaaguuaacacagaccugucgcuuucaacuaagaccuacgugugcagccgcgauuguacaauuaccgucgacaaggaggaugcccaaaucauuuuccagacugaaaaacugaaucacuuugaggugagugggacaaccuuguccucuggaugguucaagacgaaagcaagcguaacucucgaccgaaccugcgagcauaucaagguuacauguggcaaaaagacucugcaguuucacgccugcuucaagcaucacauguccuguauacguuucuuccacucaaccauucugccugguacaauggcuaccaguaucugccagaacauugaacucaucaucauuauaagccugacgcugcuuaucuuuauuuugauggcaauccugacuaaaacauauauauguuaccuacucaugccacuguucaugcccauugccuaucuuuacggguggucuuauaauagauccugcaagaaaugcucauguugcggacuggcuuaccauccuuuuaccaacuguggcagccacugcguguguggcuugaaguucgaggccagugauaggaugcggauccaucgcgaaucugggcucugccaaggauacaaaucccugagagucgcgagguuacuguguaagagcaaagguucgucucucaucauuuccauccuucugucaauguugauucuaaguuucgugacuccaauagagggcacacugaccaauuaucccgagagccggaaguacgaccucgaagagaucgcagaugugcuggaaggguuuauuacggagaagggaaucaaagaauaugucguuuucuacaccuccaucuuuggcggucuuuuccuguugcucgcccugauuauaaucauugcuuuaaaccgcgugacagaguaucugacuaauaucaacguauuuuacugccacgaguguucuauguaucacagcaagaaaaauauuaaguacaucggggacuucaccaacaaaugcggauuuuguacaugcggcgaacuagaggaucaggaaggccucaagauacauaaggugucacgaaaaugcaucuacaaguaucagcugacuuggaguaaaauuaucaugauuauccuugucuguuugcugauagcccagaacaccauucucaucguggcagcuuccaaugacugcugggccaagaaaagccuggagauggaauguauugggccucuucaaagaguugagucuugcgacgauaaggcgucaaggaguuacagcggagaggccaagaaacuggugcgggcauccaagaucucugacuuggaugcugcccaggucggucuccugggcucgacaauagaaagcgcuaucgccuccauucguaaacagcgcaccuauccaacuaugcacuuacuggagucaguguuccuagcaaagcauugugacuacuauaaaaguuuugaacacaacucuggguacagccaggccaaguggagacucacggcuaagacacaucacuucgauaucugcuccaggcacucaacccaucacuuuugucggugcauuagcgacggaacuaaaugucaaaauggcgauugggacuucgcgggugagaugaacucuaccuaucaguccaagaaagacuuuuucgaacaugauuucaagcuguuuugcacacuuuuggagaaugcauucccggggaccacugagaguuuuuacuaccagaugcugcagaaaaagaacacaacgggcguaguuaaacuccuggaugaauuaaccaagaaguucggaaauaacaauauguuugugggcaucuggaaauucgggcaauaucugaugagccuucccuacauaaacgagacuucuuugacaccucuccagcuguccaagauucuagaagccucaaaucagcaccaccgaaguaucagcggacgccaagagucgcuggcuaacgccgcauccgguggcaaaucuaaggagugugacaaugccaaaaaggucagcugcaucucaccaagauuuggggugcccauggaaggacucauugcuugcggcaguuccccuaacuauaagaucuacaaaaugccaaccaagcuguauaaaucuaauaacaagggugaggucugguguagcggggacgugcauugcuuccaggaacuuaaccccgccucccaggagucaguugauaggauuaaacagaugacaugcuuuuugacugaaccggagaccaaugaggacguguucagcauagcaaucaguauguguaagguacgggauaagggcgucuguacgauuaacgaggaacgcuggaaugugaucaaaugcgacucuggacugauuuacuauaccgaucaaagagacggccaggauacagggaacgacuuuggagaauacuguuuaucccacaauugcaggaucgagcguuucccuauaaaccccgcgaucauuaaugauugucucugggaauaccauagccggcgaucgaaguauaucacuucacuggaccuugagucucuggaggaauuuaaaagagcuauuagugagaaguugucccacacccucaucguuuacaacuucaaaccaacagccaaucugccucauauaaagcccguguauaaguacauuacuguccaggguguggaaaacagcgauggcguagacucugcauauaucaccgccagcaugccagcucuauccgggacgucaaucggauacaauauuaugaguaaagauaacuucccccuguuugacauaaucauuuucaucaagagcgccgugauuaaagcaacauauaaucacaucuacgacaccggcccuacuauagguaucaacguuaugcacgaugagcauugcacagggcaguguccaaccgacauuccgcacaaggaaaauuggaucacuuuuucucaagagaggaccucccgcuggggcugcgaggaguucggaugccucgcugucaacacaggcuguguguuugggucaugccaggauauuauccggcccgaaacgaaaguguacagaaaggccauagaagagaacguccugcuuaccguuuguauuacuuauccuggaaaaacauucugcaccgagaucaaugcgaucgaaccaaagauuacagacgaguuggaacugcaguuuaagacuguggauaccaaaacguuacccaacauccucgccgugcagaaucauaagcuguacaguggccaaauaaacgaccuugguagcuucucccagggguguggaaauauucagaaaacaaacucuucgaucauuggcaccgguacugcuaaguuugauuauguaugccacggcgcaagcaggaaagacaucauaguccgccgauguuacaauaacaauuaugagucaugccggcugcuaaaggaggaacaaucccucauguucgccgauaaccaugagaccauugacguggcuaauguucgucaccuguugggggaucugcaguuuaaguuaaugcucggagaccugagauacaaaaguuucgccgaagauccugaccuugagaucgaagcaaagugugugggcugcccaucuuguuucacaagcuauuccugcaacuuuaggaucgucucaaauauugacacugugugcucuaucgaggggcccuguaccacauuccacaaccgccugaugauuacgagcaccaaacaggauuacggaauaaagaugaguugcaaaggcaagccggguuccacugaagaguuucagaucuguaagaaaacauacaccguuuuguucacuacaguggagaagaaugacaaaauugaaaucaacaccggggaucaaacgagcuuuauccaggagcgggacgauagaugcaagacuuggcucuguaggguacgagacgaaggaauuucugucauauucgagccuauccgcgcguuuuucggcucauauuuuuccauugccuucuacaucgugguggguauuaucguccuguuucuaaugauauauaucuuccugccaauggcuuuuaaacuucgggauguucucaagagaaacgaauaccuguauuugcaggagauuaagcauaaauga

SEQ ID NO: 10885 - RNA, 4305 nt, Artificial Sequence
  derived and/or modified CDS sequence (opt3) from BATV(MM2222)__AB257763.1__GP
augcugcuccuucugguguuguuaaucagcugcugugucuccgccucucccguuauuaccagaugcuuccacggcgggcagcugauagcugagaggaagucacaaacagcaaucagugaauuuugucuaaaagacgaugugagcacuauuaaguccgagaucauuuacgaaaagaacgacacgggacucuucgcccauaauaagguacugcggaacuggaucauaaaagauuggaagaauugcaacccugugccaaccgcggguggcucuaucaaugucauugaggugaacacagaccuuucgcugacuaccaagacauauguuuguucacgcgauugcaccaucacuguggacaaagaagaugcucagauugucuuucagacagagaaguugaaucacuucgaggugagcgggaccacgcucaguuccggaugguuuaaaacuaaggccucuguaacccuggaccgaacaugugaacauaucaaaguuacuugcggcaagaagacccugcaguuccacgcauguuuuaaacaucacaugagcugcauacguuucuuucacgguacaauucucccggggaccauggccacguccaucugucaaaacauugaguuaaucaucauuauaucacugacucuuaucauuuucaucuugauggugauacugacaaagaccuacauuugcuaucuacucaugccccuguuuaugccuaucgcuuacuucuauggauggaguuacaauaaaagcugcaagaaauguccaugcuguggccuugcauaucaucccuuuacuaacugcggcucucacugugucugcgggcugaaguucgaagccuccgauagaaugaggauccaucgggagucaggauugugucaggguuacaaaagccuccgcguggcuagacuguuaugcaagaguaagggcaguucccugauuaucagcauucuccuuucgaugcugauauugucuuucgugacaccuaucgaggggacccuaacgaauuacccagaauccaggaaauauaaccuggaggaaauugccgacguccucgagggauuuguuguggaaaagggcaucaaagaguacguaguguucuauaccucaaucuuuggugcgcuguuccuucugauggcauugauugucauaaucgcccucaaucgggugacagaguaccugacuaacauuaauguuuuauauugucacgaaugcaguauguaccacagcaagaaaaacaucaaguauauuggggauuuuaccaacaaguguggauucugcacaugcggcgagcuggaagaccaggagggccuaaaaauccauaaggugucccgcaaauguauauacaaguaccagcucacuuggucuaaaaucauuaugaugauccuggucugccuuuugauugcucaaaauaccauccugauaguggccgcaagcgaugacuguuggacaaagaagucacucgaaauggagugcauugggccccugcagcagguagacaccugugaggauaaaacuucucgauccuauagcggagaagcuaagaaacuuguuagagccucuaagaucucagaccuggaugcggcccagguggguuugcucggcaguacgauugagagcgcaaucgcuuccauaaggcggcaacguacauacucuaccaugcaccuguuagaaucggucuuucuggggaaacauugcgacuauuacaagguguucgagcacaacagcggauauucccaggccaaguggcgccuaacugcuaaaacccaucacuuugauaucuguucaagacacaguacacaucacuucuguaggugcauuucugacggcaccaagugccagaauggugauugggacuuugccggggaaaugaacagcaucuaccaauccaaacgggauuucuuuaagcaugacuucaaacucuucuguacucugauugaggaugcauuuccuggcacaacggagucacuuuucuaugaaauguugagcaagaaaaauaccacuggaaucacaaagcugcucgacaagcugaccaaaaaguuuggcaacaauaacauguucgucgggauauggaaauuuggacaguacuuaaugucucugccauacgugaaugagacaucccuuaguccgacucaguuggccaagguucucgaagugaccgaccaccaccaucgaagcauuucuggucgccaggagucccuggcuucagcgacgaguggcagcaaaucguccgagugcgaucacgcaaagaagguaucuugcaucagccccagauucggggucccuauggaaggacuaaucgccuguggcaacucaccaaauuauaaaauuuacaagacccccgcuaaacuguauaagaguaacaauaaaggugagguguggugcuccggggacguucauuguuuucaagaacucaucccugccucucaggagagcguggauaggauuaagcagaugacaugcuuccugacugaaccagaggucaacgacgauguguuuuccauagcaaucucaauguguaagguacaggacaaaggcgugugcaccauuaaugaggaucgguggaacguuaucaagugugacagcggacuuauuuacuauacagaucaacgcgaaggccaggacacugggaacgauuucggagaguacugcuugagucacucuuguagaaucgaaagguuucccauaaauccgaccaucauuuccgacugccugugggaguaucauagccguaaaucgaaguacaucacgucauuagaucucgaaucucuggaggaguucaaacgggccauuagugaaaaacuuucccacacacugaucgucuacaacuuuaagccuaccgcuaauuugccccacauaaaaccaguguauaaguacauuacugugcagggugucgagaacagcgacggcguugacucugccuauaucacagcaagcaugccugcgcucuccgggaccucaaucggauacaauauuaugagucgagauaacuucccccuguucgacauaaucauuuuuaucaaaagcgcuauuaucaaggccacuuauaaucauauauacgauaccggcccaacaaucgguauuaacgugaugcacgacgaacauuguacggggcagugccccaccgauaucccucacaaagagaauuggauuacuuucgcacaagaaagaacaucuagguggggcugcgaggaguuuggaugucuagccgugaacaccggcugcguauucggguccugucaggacaucauacgcccagaaacaaaggucuaucggaaagcuguggaggaaucaguucugcucacugugugcauuaccuacccgggaaagacguuuuguacagagaucaaugccaucgagcccaagauuaccgaugaacuggagcuucaguucaaaacugucgacaccaagacauugccuaacauccuggcagugcagaaucauaaauuauacaguggccaaauaaacgaucucgguagcuuuucccaggggugcggaaauauucagaagacuaacucuucgaucauuggcaccgguacagcuaaauucgacuauguuugucacggcgccagcagaaaggauaucauagugaggcgcugcuacaacaauaacuaugaaucauguaagcugcuuaaagaggaacaaucccugauguuugcggacaaucacgagacgauugauguagccaacguccgacaucuacucggggaccugcaguucaaguugaugcugggagacuuacgguacaaaaguuuugcugagaauccagaucucgaaaucgaggcaaagugcgugggcugucccucuugcuucaccagcuauuccugcucauucaaaaucgugucuaacauugacacugucuguagcaucgaagggccuugcacaaccuuucacaaucgucugaugauuacaaguacuaagcaggauuacggaauaaagauguccuguaaaaccaagccaggccccaucgaggaauuucagauuugcaaaaagacguauacuauccuuuucaccacaguugagaaaaacgacaagaucgagauuagcaccggugaucaaacuucuuucauacaggaaaaggacgauagauguaaaacauggcugugcagggugcgcgacgaggggaucucaguaauuuuugaaccgauccgggccuucuuuggauccuacuucaguauugcuuuuuacaucgugauaggcaucauugucuuguuccucgugaucuauauuuuucugccuaugauguucaagcuaagagauguucugaaaaggaaugaguaccuuuaucuccaggaaaucaagcauaaauga

SEQ ID NO: 10886 - RNA, 4305 nt, Artificial Sequence
  derived and/or modified CDS sequence (opt3) from BATV(MM2222)__AY772534.1__GP
augcugcuccuucugguguuguuaaucagcugcugugucuccgccucucccguuauuaccagaugcuuccacggcgggcagcugauagcugagaggaagucacaaacagcaaucagugaauuuugucuaaaagacgaugugagcacuauuaaguccgagaucauuuacgaaaagaacgacacgggacucuucgcccauaauaagguacugcggaacuggaucauaaaagauuggaagaauugcaacccugugccaaccgcggguggcucuaucaaugucauugaggugaacacagaccuuucgcugacuaccaagacauauguuuguucacgcgauugcaccaucacuguggacaaagaagaugcucagauugucuuucagacagagaaguugaaucacuucgaggugagcgggaccacgcucaguuccggaugguuuaaaacuaaggccucuguaacccuggaccgaacaugugaacauaucaaaguuacuugcggcaagaagacccugcaguuccacgcauguuuuaaacaucacaugagcugcauacguuucuuucacgguacaauucucccggggaccauggccacguccaucugucaaaacauugaguuaaucaucauuauaucacugacucuuaucauuuucaucuugauggugauacugacaaagaccuacauuugcuaucuacucaugccccuguuuaugccuaucgcuuacuucuauggauggaguuacaauaaaagcugcaagaaauguccaugcuguggccuugcauaucaucccuuuacuaacugcggcucucacugugucugcgggcugaaguucgaagccuccgauagaaugaggauccaucgggagucaggauugugucaggguuacaaaagccuccgcguggcuagacuguuaugcaagaguaagggcaguucccugauuaucagcauucuccuuucgaugcugauauugucuuucgugacaccuaucgaggggacccuaacgaauuacccagaauccaggaaauauaaccuggaggaaauugccgacguccucgagggauuuguuguggaaaagggcaucaaagaguacguaguguucuauaccucaaucuuuggugcgcuguuccuucugauggcauugauugucauaaucgcccucaaucgggugacagaguaccugacuaacauuaauguuuuauauugucacgaaugcaguauguaccacagcaagaaaaacaucaaguauauuggggauuuuaccaacaaguguggauucugcacaugcggcgagcuggaagaccaggagggccuaaaaauccauaaggugucccgcaaauguauauacaaguaccagcucacuuggucuaaaaucauuaugaugauccuggucugccuuuugauugcucaaaauaccauccugauaguggccgcaagcgaugacuguuggacaaagaagucacucgaaauggagugcauugggccccugcagcagguagacaccugugaggauaaaacuucucgauccuauagcggagaagcuaagaaacuuguuagagccucuaagaucucagaccuggaugcggcccagguggguuugcucggcaguacgauugagagcgcaaucgcuuccauaaggcggcaacguacauacucuaccaugcaccuguuagaaucggucuuucuggggaaacauugcgacuauuacaagguguucgagcacaacagcggauauucccaggccaaguggcgccuaacugcuaaaacccaucacuuugauaucuguucaagacacaguacacaucacuucuguaggugcauuucugacggcaccaagugccagaauggugauugggacuuugccggggaaaugaacagcaucuaccaauccaaacgggauuucuuuaagcaugacuucaaacucuucuguacucugauugaggaugcauuuccuggcacaacggagucacuuuucuaugaaauguugagcaagaaaaauaccacuggaaucacaaagcugcucgacaagcugaccaaaaaguuuggcaacaauaacauguucgucgggauauggaaauuuggacaguacuuaaugucucugccauacgugaaugagacaucccuuaguccgacucaguuggccaagguucucgaagugaccgaccaccaccaucgaagcauuucuggucgccaggagucccuggcuucagcgacgaguggcagcaaaucguccgagugcgaucacgcaaagaagguaucuugcaucagccccagauucggggucccuauggaaggacuaaucgccuguggcaacucaccaaauuauaaaauuuacaagacccccgcuaaacuguauaagaguaacaauaaaggugagguguggugcuccggggacguucauuguuuucaagaacucaucccugccucucaggagagcguggauaggauuaagcagaugacaugcuuccugacugaaccagaggucaacgacgauguguuuuccauagcaaucucaauguguaagguacaggacaaaggcgugugcaccauuagcgaggaucgguggaauguuaucaagugugacaguggacuuauuuacuauacagaucaacgcgaaggccaggacacugggaacgauuucggagaguacugcuugucucacuccuguagaaucgaaagguuucccauaaacccgaccaucauuagcgacugccugugggaguaucauucgcguaaaucaaaguacaucacgucuuuagaucucgaaagucuggaggaguucaaacgggccauuuccgaaaaacuuagccacacacugaucgucuacaauuuuaagccuaccgcuaacuugccccacauaaaaccaguguauaaguacauuacugugcagggugucgaaaauucugacggcguugacagcgccuauaucacagcauccaugccugcgcucucagggaccaguaucggauacaacauuaugagccgagauaauuucccccuguucgacauaaucauuuuuaucaaaucugcuauuaucaaggccacuuauaaccauauauacgauaccggcccaacaaucgguauuaaugugaugcacgacgaacauuguacggggcagugccccaccgauaucccucacaaagagaacuggauuacuuucgcacaagaaagaacauccagguggggcugcgaggaguuuggaugucuagccgugaauaccggcugcguauucgggucaugucaggacaucauacgcccagaaacaaaggucuaucggaaagcuguggaggaaaguguucugcucacugugugcauuaccuacccgggaaagacguuuuguacagagaucaacgccaucgagcccaagauuaccgaugaacuggagcuucaguucaaaacugucgacaccaagacauugccuaauauccuggcagugcagaaccauaaauuauacagcggccaaauaaaugaucucgguuccuuuucucaggggugcggaaacauucagaagacuaauucgagcaucauuggcaccgguacagcuaaauucgacuauguuugucacggcgccucaagaaaggauaucauagugaggcgcugcuacaacaacaauuaugaauccuguaagcugcuuaaagaggaacaaagucugauguuugcggacaaccacgagacgauugauguagccaauguccgacaucuacucggggaccugcaguucaaguugaugcugggagacuuacgguacaaaucuuuugcugagaacccagaucucgaaaucgaggcaaagugcgugggcugucccagcugcuucaccuccuauucaugcucuuucaaaaucgugagcaauauugacacugucuguaguaucgaagggccuugcacaaccuuucacaaccgucugaugauuacuuccacaaagcaggauuacggaauaaagaugagcuguaaaaccaagccaggccccaucgaggaguuccagauuugcaaaaagacguauacuauccuuuuuaccacaguugagaaaaaugacaagaucgagauuucuaccggugaucaaacuucauucauacaggaaaaggacgauagauguaaaacauggcugugcagggugcgcgacgaggggaucuccguaauuuuugaaccgauccgggccuucuuuggaaguuacuucagcauugcuuuuuacaucgugauaggcaucauugucuuguuccucgugaucuauauuuuucugccuaugauguucaagcuaagagauguucugaaaaggaacgaguaccuuuaucuccaggaaaucaagcauaaauga

SEQ ID NO: 10887 - RNA, 4305 nt, Artificial Sequence
  derived and/or modified CDS sequence (opt3) from BATV(MM2222)__JX846596.1__GP
augcugcuccuucugguguuguuaaucagcugcugugucuccgccucucccguuauuaccagaugcuuccacggcgggcagcugauagcugagaggaagucacaaacagcaaucagugaauuuugucuaaaagacgaugugagcacuauuaaguccgagaucauuuacgagaaaaacgacacgggacucuucgcccauaauaagguacugcggaacuggaucauaaaagauuggaagaauugcaacccugugccaaccgcggguggcucuaucaaugucauugaagugaacacagaccuuucgcugacuaccaagacauauguuuguucacgcgauugcaccaucacuguggacaaagaagaugcucagauugucuuucagacagagaaguugaaucacuucgaggugagcgggaccacgcucaguuccggaugguuuaaaacuaaggccucuguaacccuggaccgaacaugugaacauaucaaaguuacuugcggcaagaagacccugcaguuccacgcauguuuuaaacaucacaugagcugcauacguuucuuucacgguacaauucucccggggaccauggccacguccaucugucaaaacauugaguuaaucaucauuauaucacugacucuuaucauuuucaucuugauggugauacugacaaagaccuacauuugcuaucuacucaugccccuguuuaugccuaucgcuuacuucuauggauggaguuacaauaaaagcugcaagaaauguccaugcuguggccuugcauaucaucccuuuacuaacugcggcucucacugugucugcgggcugaaguucgaagccuccgauagaaugaggauccaucgggagucaggauugugucaggguuacaaaagccuccgcguggcuagacuguuaugcaagaguaagggcaguucccugauuaucagcauucuccuuucgaugcugauauugucuuucgugacaccuaucgaggggacccuaacgaauuacccagaauccaggaaauauaaccuggaggaaauugccgacguccucgagggauuuguuguggaaaagggcaucaaagaguacguaguguucuauaccucaaucuuuggugcgcuguuccuucugauggcauugauugucauaaucgcccucaaucgggugacagaguaccugacuaacauuaauguuuuauauugucacgaaugcaguauguaccacagcaagaaaaacaucaaguauauuggggauuuuaccaacaaguguggauucugcacaugcggcgagcuggaagaccaggagggccuaaaaauccauaaggugucccgcaaauguauauacaaguaccagcucacuuggucuaaaaucauuaugaugauccuggucugccuuuugauugcucaaaauaccauccugauaguggccgcaagcgaugacuguuggacaaagaagucacucgaaauggagugcauugggccccugcagcagguagacaccugugaggauaaaacuucucgauccuauagcggagaagcuaagaaacuuguuagagccucuaagaucucagaccuggaugcggcccagguggguuugcucggcaguacgauugagagcgcaaucgcuuccauaaggcggcaacguacauacucuaccaugcaccuguuagaaucggucuuucuggggaaacauugcgacuauuacaagguguucgagcacaacagcggauauucccaggccaaguggcgccuaacugcuaaaacccaucacuuugauaucuguucaagacacaguacacaucacuucuguaggugcauuucugacggcaccaagugccagaauggugauugggacuuugccggggaaaugaacagcaucuaccaauccaaacgggauuucuuuaagcaugacuucaaacucuucuguacucugauugaggaugcauuuccuggcacaacggagucacuuuucuaugaaauguugagcaagaaaaauaccacuggaaucacagagcugcucgacaagcugaccaagaaauuuggcaacaauaacauguucgucgggauauggaaguuuggacaguacuuaaugucucugccauacgugaaugaaacaucccuuaguccgacucaguuggccaaaguucucgaggugaccgaccaccaccaucgaagcauuucuggucgccaggagucccuggcuucagcgacgaguggcagcaagucguccgaaugcgaucacgccaaaaagguaucuugcaucagccccagauucggggucccuauggagggacuaaucgcauguggcaacucaccaaauuauaagauuuacaaaacccccgcuaagcuguauaaaaguaacaauaagggugaaguguggugcuccggggacguucauuguuuucaagagcucaucccugccucucaggaaagcguggauaggauuaaacagaugacaugcuuccugacugagccagaggucaacgacgauguguuuuccauagcaaucucaauguguaagguacaggacaagggcgugugcaccauuaaugaagaucgguggaacguuaucaaaugugacagcggacuuauuuacuauacagaucaacgcgagggccaggacacugggaacgauuucggagaauacugcuugagucacucuuguagaaucgagagguuucccauaaauccgaccaucauuuccgacugccugugggaauaucauagccguaagucgaaauacaucacgucauuagaucucgagucucuggaggaguucaagcgggccauuagugaaaaacuuucccacacacugaucgucuacaacuuuaagccuaccgcuaauuugccccacauaaagccaguguauaaauacauuacugugcagggugucgaaaacagcgacggcguugacucugccuauaucacagcaagcaugccugcgcucuccgggaccucaaucggauacaauauuaugagucgagauaacuucccccuguucgacauaaucauuuuuaucaagagcgcuauuaucaaagccacuuauaaucauauauacgauaccggcccaacaaucgguauuaacgugaugcacgacgagcauuguacggggcagugccccaccgauaucccucacaaggaaaauuggauuacuuucgcacaagagagaacaucuagguggggcugcgaggaauuuggaugucuagccgugaacaccggcugcguauucggguccugucaggacaucauacgcccagagacaaaagucuaucggaaggcuguggaagagucaguucugcucacugugugcauuaccuacccgggaaaaacguuuuguacagagaucaaugccaucgaacccaagauuaccgaugagcuggaacuucaguucaagacugucgacaccaaaacauugccuaacauccuggcagugcagaaucauaaguuauacaguggccaaauaaacgaucucgguagcuuuucccaggggugcggaaauauucagaaaacuaacucuucgaucauuggcaccgguacagcuaaguucgacuauguuugucacggcgccagcagaaaagauaucauagugaggcgcugcuacaacaauaacuaugagucauguaagcugcuuaaggaggaacaaucccugauguuugcggacaaucacgagacgauugauguagccaacguccgacaucuacucggggaccugcaguucaaauugaugcugggagacuuacgguacaagaguuuugcugaaaauccagaucucgagaucgaagcaaaaugcgugggcugucccucuugcuucaccagcuauuccugcucauucaagaucgugucuaacauugacacugucuguagcaucgaggggccuugcacaaccuuucacaaucgucugaugauuacaaguacuaaacaggauuacggaauaaagauguccuguaagaccaaaccaggccccaucgaagaguuccagauuugcaagaaaacguauacuauccuuuuuaccacaguugagaagaacgacaaaaucgaaauuagcaccggugaucaaacuucuuucauacaggagaaggacgauagauguaagacauggcugugcagggugcgcgacgaagggaucucaguaauuuuugagccgauccgggccuucuuuggauccuacuucaguauugcuuuuuacaucgugauaggcaucauugucuuguuccucgugaucuauauuuuucugccuaugauguucaaacuaagagauguucugaagaggaaugaauaccuuuaucuccaggagaucaaacauaaguga

SEQ ID NO: 10888 - RNA, 4305 nt, Artificial Sequence
  derived and/or modified CDS sequence (opt3) from BATV(MS50)__JX846605.1__GP
augaagaugcugacccucaucauuauagugagcugcugggucgccacacuucagaacccccugaucuccagauguuuccacggcgggcaauugauugcugagaaaaagucuuuaacuucaaucagugaauuuugcauuaaagacgauguuagcaugcugaaguccgaggugaucuaccagaaaaaugacacgggaauauauggucauucuaagguauucaggcacuggaccaucgcagauuggaaguacuguaacccugugccaacagccggcgggucgauuaaugucaucgaacuagacaaaaaccucaaucugauugcgaagaacuaugugugcacucgggauuguaccaucacaguugacaaagagaaugcucagauaguguuucagaccgauaaguugaaccauuucgaagucacuggaacaaccauuucaacgggcugguuuaaaacuaaggccagcguggcacuggaccgaaccugcgagcacaucaagguaaguugugguaaaaagacauugcaauuccaugccugcuuuaaacagcacauguccuguguucgcuuccuccaccguucuaugcugccggggagcauggcuaauuccauuugccagaacaucgagcugaucauuauaaucacucucaccuuagugauuuuuauccugaugcuuauagcaacaagauucuacauuuguuauuugcugauccccgucuuuaugccuaucgccuacgcuuauggaugggccuacaauaggucaugcaagaaaugcaguuguugcggccuagcguaccauccauucaccaacuguggcagcuauugcguguguggggcacgguuugaaacgucugaucgcaugagacuccacagggaguccggacugugccaggguuucaagucacuucggauggcccgccgacuguguaaaagcaagggcaguucuuuggugauuuccauccuccuggcuacuuuaauucugagcuucgucacacccauagaagggaccaugacuaauuacccuacaaacgagaaguauucgcucgacgagaucgccgauguucuuaaauggaaggaacaagagucugaauacaaauauuacgcaauucuguaugcuuccaucaucggagccugcuuuaccguguuguucgcgggcacggcccuagcacugaauauuguacucgagcugcuuaccaagauaaacgugaucuacugugaagagugcucaauguaccauaguaaaagcaacauuaaguauaucggugacuuuacaaauaaguguggguucugcacuugcggacuguuggaggauccagacggcgucgugguucacaaagugaagagauccuguaccuaccaguauaaacucacaugggucaagacuauuaugaucgugcugucuauauuauuucugcuacagaacaucauuguaaucguugcugccgacagcgauugcuggaccaaugaggaacucaaacccgaaugugugggcccucugauugcuccagccgacugcacagagaaggauaagaaaaccuaccuuacugaagcagccgcuuuggucaagacgaaaaagaucucacagguggacgcggauaacgucgagauacuggggaaaacaauugagagugcaaucaaggccauugaaaagcaaaagaccuaucacaggaugcaucuccuggaggcuguguuccuuaauaagcacugugacuacuauaaacuguuugaacauaacuccggauacagccagguuaaguggcggauguuggccaaaacucagcacuucgauaucugcgcauuugccaaggagucuaaauucuguaagugcauggcugguggcgccugugcagaagacucaugggauuuugacaccacaaugaauaguaccuacacuagcaagggggauaacuucaaacaugacaugucccucuuucugaagauauucgaggcggcuuucccgggaacaucuuauguguacauguuaaauaaaaucaaggagaaaaagcccuaucaaucgguaacgaugauugacaagaucaaaaccaaguacccuaacaauaaaaugcuggucgccuaucuagaauuuggcaagugccucauggguguggggcacgcaagcacuuucgagcugcagcagucccagcuugaacguuuguaccaaccagccgagcugucacgcaguguuggccagcucacaucucugagcaacgcucaggugggaaccauuacaaaagaguguuccaaguauaaggauaucucaugcuuaagccccagauuuggcauaccuauggaaaauauggucgccugcggggacucuccaaacuacaaaauuuacaagaaacccaucaagguguauaaagcacacgauaggguagagacuugguguaucaaggaccagcauugccugguggauuacaccccggcugaagccgacguugucaagaaacuuaagacgaugaaauguugguugaaugauccuggaaccgagacagacgcguauacuaccgccauuaaguccugccggaucauggauaaagguguguguacagugaacggccaaaaguggaguauuauaaaaugcgacagcgaucuccuguacuauacugaccacaucgaaggggaggauaccggaaacgacauuggccauuacuguaucucugucgguugcaagacggaccgauaucccauuaauccagauaucguuacagacuguaccugggaguucaagucccgcaaaucaaguuacauagggaagaucagcaugcagucgcuagaagauuacaaaaaggcucugacugacaaacucacacacacccuggagacuuauuccuuugcaccuaccgccgaucuuccccacauuaagccaaucuacaaguauauuacagcucagggcguggaaaacucugacggaaucgagggcgccuacauaacggcaaccauucccgcgcuugggggaacuagcaucgguuauucagugcagaguaaagauggcuucccucuguuagaccucaucauuuacauaaaggccgcuguaaucagauccacauauauucaucuguacgauaccgggccaacaaucucuauuaauacuaaacacgacgaaaagugcaccggacaauguccggccgagaucgagcaugaagcaaacuggcuuacguuuagccaggagaggacaucccgguggggcugcgaagaguucgguugccuggcuauaaauaccgggugugucuuuggcucaugccaggaugugauccgccccgaaacuaaaguuuacagaaagagcguggaggaggaagucguguugaccguuuguauuaacuauccuggaaauacauucugcacugagaucaacgccauugaaccaaagaucaccgaggagguggaacuccaguuuaaaacaguagacacgaagacccugcccacucuacuggcagucacaaaucacaaacucuucaguggccaaauaaacgaucuggggaccuuuggacagauguguggcaaugugcagaagacuaacucuuccauucuugguagcgggacaccuaaauucgacuauaccugccauggagccucgaggaaggacaucaucgugcguaaguguuacaauaacaauuacgauucaugcaaauugcugaaggaggaaaaacaauuagucuucaacgacgaucacgagacgauuacuguugugaacaaucggcaccucguaggcgaacuggcuaucaaacuuauacugggugacauucaguauaaacuauuuaccgagaagcucgaucugcagaucgacgcgaagugugugggcugcccagauuguuucgagucuuacgccugcaacuuucagauugucaguaauaucgacacagugugcgcaauaaacgggcccugugauauuuuccauaaucgaaucuccaucagaagcacccaacagaacuauggaguuaaaaugucuugcaagaggacuccggaccagaaugaaaaauuugugauuuguggccgcgaguacagcgucuucuuucacacagugcagaagaacgauaaaaucgaaauuaauaccggggaccaaacauccuacauaaaggagauggacacucggugcaaaaccugguuguguagaguuagggaugaaggacugucagugaucuucgagccuauuaaggccuuuuucggcaguuauuuuagcaucgcuuucuacaucgucuuauucauuauaaucgccuuucucguaauuuauaucuucaugccaauguuuaugaagcugcgcgacauucuuaaacagaacgagaagcuguacuugcaggaaaucaaacagaaguga

SEQ ID NO: 10889 - RNA, 4305 nt, Artificial Sequence
  derived and/or modified CDS sequence (opt3) from BATV(NM/12)__KJ187039.1__GP
augcugcuccuucugguguuguuaauccccugcugugucagcgccuccccugcuauuaccagaugcuuccacggcgggcagcugauagcagagaggaagucucaaacagccaucucagaauuuugucuaaaagacgauguuaguacuauuaagagcgagaucauuuacgaaaagaacgacacgggacucuucgcgcauaauaaggugcugcggaacuggaucauaaaagauuggaagaauugcaacccaguaccgaccgcugguggcuccaucaaugugauugaggucaacacagaccuuucucugacuaccaagacauauguguguucgcgcgauugcaccaucacuguugacaaagaagaugcccagauuaucuuucgaacagagaaguugaaucacuucgaggugucagggaccacgcucagcaguggaugguuuaaaacuaaggcauccgucacccuggaccguacaugugaacauauaaaagugacuugcggcaagaagacccugcaguuccacgccuguuuuaaacaucacaugucuugcauuagauucuuucacgguacaauccuccccgggaccauggcuacgagcauuugucagaacaucgaguuaaucauuauaaucucccugacucuuauuaucuucauauugaugguaauucugacaaggaccuacaucugcuaucuacucaugccucuguuuaugccaaucgcauacuucuauggauggucauacaauaagaguugcaaaaagugucaaugcuguggccuugccuaucaucccuuuacuaacugcggcagccacuguguuugcgggcugaaauucgaagccucugaucggaugcgcauucauagagaguccggauugugucaggguuacaagucacucaggguggcccggcuguuaugcaaaagcaagggcaguucucugaucauuuccauacuccuuagcaugcugaucuugucguucgucacaccuauugaggggacccuaacgaauuacccagaaucucgcaaguaugaccuggaggaaaucgcggaugugcucgagggauuuguggucgaaaaaggcaucaaggaguacguuguguucuauaccuccauuuuuggugcacuguuccuucugauggccuugauaaucauuaucgcucucaaccgaguaacagaguaccugacuaauauuaacguguuuuauugucacgaaugcucaauguaccacaguaaaaagaauaucaaauauauaggggacuucaccaacaaguguggauuuugcacaugcggcgaguuagaagaucaggagggccugaagauccauaaagucagcagaaaguguauuuacaaauaccagcuaacuugguccaagaucauuaugaugauccucgugugccugcuuauagcccaaaacaccauuuugaucguugcagcuucugacgacuguuggacaaaaaggagccuggaaauggggugcauuggaccccuccaacagguggauaccugugacgauaagacuucacggaguuauuccggugaggccaagaaacugguccgugcgagcaagaucucugaccuugaugccgcacaggugggccuguuggggucaacgauagagagugcuaucgccagcauucgcaaacaaagaacauacuccaccaugcaccuccuggaaucuguauucuuaggaaagcauugcgacuauuacaaaguuuuugagcacaauucgggcuauagccaggcuaaguggaggcugacugccaagacccaucacuucgauaucuguucccggcacucaacacaucacuuuugccgauguauuagugacgguaccaaaugccagaacggggauugggacuucgcaucugaaaugaauagcacuuaccaauccaagcgcgacuuuuucgagcaugauuucaaacaguuuuguacacuaaucgaaaacgccuucccuggcacgaccgagucacucuuuuaugagaugcugagcaagaaaaauacuacaggaauaaccaaacuuuuggacaaacugacaaagaaguucggcaacaauaacauguuuguggggauuuggaaauucggacaguaccucaugucucugccauacgucaaugaaacuuccuuaaguccgacccagcuggcuaaggugcuugaggucacggaucaccaccauagaagcaucucugguaggcaagaauccuuggcgucagcagcccccggcaguaaaagcucggagugcgaccacgcucggcgcguguccugcaucucuccuagauuugggguuccaauugagggacucaccgccuguggcagcucacccaacuauaagaucuacaaaacuccugcaaagcuguauaagaguaauaacaaaggugaaguguggugcuccggggauguacauugucuacaggagcugauuccagcuccccaggaaucugucgacaggauaaagcagaugacaugcuuccucaccgagccgggcgugaaugaugacaucuuuagcauugcuaucuccauguguaaaguucaagauaagggagugugcacaauuaacgaagaccguuggaaugucgugaaaugugaucggggccugaucuacuauacugaccagcgagaggggcaggauaccggaaacgacuucgguaaguacugccuuucacacagcuguagaauagagagguuuccuaucaaccccgccauuaucaaugauugcuugugggaauaucauagucgcaagucuaaauacauuacgucccuggacuuagagagccucgaagaguucaagcgggcaaucucggaaaaacugucacacacacuuauaguacacaacuuuaagccaaccgcgaaucugccucauauuaaacccguguacaaguauaucacuguucagggcgucgagaacucugacgggguggauagugcuuacaucacagccuccaugccagcauugagcggaaccucuauuggcuauaauauaaugagcagagacaacuucccccucuucgauaucauuaucuuuauuaaguccgccaucauaaaagcuacuuacaaucacaucuaugacaccgguccuacaauugggaucaacgugauucaugaugagcacuguacgggccaaugcccaaccgacaucccgcauaaggaaaauuggauaacuuucgcccaggagaggacaucacgcuggggaugcgaagaguuuggcugucuggcaauuaacaccgggugcgucuucggaaguugucaggauaucauccgacccgaaacaaaaguuuaccggaaggcuguggaggagagcgugcuacugacuguaugcauuaccuauccuggcaaaacguuuuguacagaaaucaaugccauagagccaaagauuaccgacgaacucgagcugcaguucaaaacugucgauaccaagacacuucccaacaucuuggcggugcaaaaucacaagcuguacucuggucagauuaacgacuuaggguccuuuucacagggaugcggcaauauccagaaaacuaacaguagcauaauugguaccggcacagccaaguucgauuacguuugucacggggcuucccguaaagacaucaucgugagaaggugcuauaacaauaacuacgagucuuguaagcuccugaaagaggaacagucgcuuauguuugcagauaaucaugaaacgauugacgucgccaacgugcgccaucugcuaggagaccuccaguucaagcugauguugggcgaucugcgguauaagagcuuugcugagaauccugacuuagaaaucgaggccaaaugcguuggguguccaucaugcuucaccuccuacaguugcucuuucaagauugugagcaacauagauacuguauguuccaucgagggacccugcacaauuuuucacucaagacucaugaucaccucuacuaaacaggacuauggcaucaagaugagcuguaaaacaaagccggguccuaccgaagaguuccaaauuugcaagaaaacguacacuauacuguuuaccacaaucgaaaagaaugauaaaauugagaucaguaccggggaccagacuuccuucauucaggaaagggaugaccgaugucgcacauggcuuugccgggucagagaugagggaaucggcgugauauuugagccaaucagggcauucuuugguagcuauuucucuauugcguuuuacaucgugauuggcaucauaauucuguucuuggucaucuacauuuuucuccccaugguuuucaagcugcgugacgugcuaaaacgcaacgaauaucuguaccuucaggagaucaagcacaaguga

SEQ ID NO: 10890 - RNA, 4305 nt, Artificial Sequence
  derived and/or modified CDS sequence (opt3) from BATV(ON-1/E/94)__AB257764.1__GP
augcuccuguuccuugugcuguugaucagcugcuacgucuccgccucucccguuauuaccagauguuuucacggcgggcaguuaauagcugagaggaagucacaaacagcaaucagugaauuuugccugaaagacgaugugagcacuauuaaguccgagaucauuuaugagaaaaacgacacgggacuauuugcccauucuaagguacuccggaauuggaucauaaaagauuggaagaacuguaauccugugccaaccgcggguggcucgaucaacgucauugaagugaaugcugaccugucacuugccacaaagacuuacguuugcagccgcgauuguaccaucacaguggacaaagaagaugcacagauugucuuccagaccgagaagcugaaccacuuugaggugagugggacuacauuguccucuggaugguucaaaaccaaggccagcguaacgcucgaccgaacuugcgaacauaucaaaguuaccuguggcaagaagacacugcaguuucacgcuugcuucaaacaucacauguccuguauacguuucuuccacgguacuauucugccggggaccauggcaacaucaaucugccaaaauauugagcucaucaucauuauaaguuuaacccugaucauuuuuauccuuauggugauauugacgaagacuuauauuuguuaccugcuaaugccccucuucaugccuaucgccuauuuuuacggauggagcuauaacaaaucuugcaagaaaugcuccuguugcggccuggcuuaccauccauucacaaauuguggcucacacugcgucugugggcuuaaguucgaagccagcgauagaaugaggauccaucgggagaguggacugugccaggguuacaaaucuuugcgcguggcgagacuccuguguaaguccaagggcagcucguuaauuaucucuauucugcucuccaugcuuauacugucauuugugacccccaucgaggggacuuugacaaacuauccugaaaguaggaaauacgaccuagaggaaauugcagauguccuggagggauucguuguggaaaagggcaucaaagaguauguaguguuuuacaccagcaucuucggugcccucuuucugcuuauggcucugauugucauaaucgccuugaaucgggugacggaguaucucaccaacauuaauguucuguacugccacgaauguuccauguaucacucuaagaaaaacaucaaguacauuggggacuucacaaauaagugcggauuuuguacuugcggcgaguuagaagaucaggagggccugaaaauccauaaggugagccgcaaaugcauauacaaguaucagcuaaccuggucaaaaaucauuaugaucauucucgucugucugcuuaucgcacaaaacacaauauugauuguggcugccagugacgacugcuggacuaagaagucccuggaaauggaguguguagggccacuccagcagguugauaccugcgaggacaaaacaagccgaucuuacucaggagaagcgaagaaacuggugagagccaguaagaucagcgaucuugacgcagcucaggucggucuguugggcuccaccauugagucugccaucgcuucgauaaggaaacaacggacuuauagcacgaugcaccuccuggaauccguguucuuagggaagcauugugauuacuauaaggucuuugagcacaacucaggauacagucaggccaaauggcgucugacagcaaagacccaucacuucgacaucugcucucgccacagcacucaucacuuuuguagaugcauuuccgauggcaccaaaugucagaauggugacugggauuucgccggggaaaugaacucaacauaucaaagcaagagggacuuuuucgagcaugauuucaaacuauuuugcacccucaucgagaaugcuuuccccggcacuacagaaucucuguuuuacgagaugcuuuccaagaaaaacacgaccggaauuacuaaguugcuggacaagcucaccaaaaaguucggcaauaacaauauguuuguggggaucuggaaauucggacaguaccugaugaguuuaccuuauguuaacgaaacaagccugucuccaacacagcuugcgaagguguuggagguaacugaccaccuccaccgguccauaucaggucgacaggagcugcuaaccagugcaacgccgggcagcaaaucguccgaaugugaucaugccaagaaggucucuugcauuagcccccgcuuuggggugccuauggagggacugaucgcuugcggcaauucaccaaguuacaaaaucuauaagacccccacaaaacucuacaaguccaacaauaaaggugaaguuugguguucuggggacgugcacugcuuccaagagcugauuccugccagccaggaauccgucgauagaaucaagcagaugacuuguuuucuuaccgagccagaggugucagacgauguauucagcauugcaauaaguaugugcaaggugcaggacaaaggcguuuguacaaucaacgaagauagguggaaugucauuaagugcgacucuggauugaucuauuacacugaucaacgggagggccaggacaccgggaacgaucugggagaauauuguuuaucccauagcugccgcauugagagauuucccaucaauccgauaaucauuucggacugucucugggaauaccacucaaggaaaucuaaguacaucacgagucuggaucuugagucccuggaggaguucaaacgugccauuagcgaaaaguugucucauacacucaucguguauaacuuuaagccuaccgcuaaccugccccacauaaaaccaguguacaaguauauuacuguccaggguguugaaaauagcgacggcguggacuccgccuacaucacagcaucaaugccugcgcuaagugggaccagcaucggauauaacauuaugucucgggauaauuucccccuguucgacauaaucauuuuuaucaaauccgcuauuaucaaggccacuuacaaccacauauaugauaccggcccaacaaucgguauuaaugugaugcaugacgagcacugcacggggcagugucccaccgauaucccucauaaagaaaacuggauuacuuucgcacaagagcgaacaucaagauggggcugcgaggaauuuggaugccucgccguaaauaccggcugugucuucgggaguugccaggacaucauaaggccagagacaaagguguaccgcaaagcuguugaagagagcgugcugcuuacugucuguauuaccuacccgggaaagacguuuugcacagagaucaacgccaucgaacccaagauuaccgaugaguuggaacugcaguucaaaacuguggacaccaagacauuaccuaauauccucgcaguucagaaccacaaacuguauuccggccaaauaaaugaucuugguucuuuuucgcagggguguggaaacauucagaagacuaauagcucaaucauuggcaccgguacagcuaaauucgacuacgugugccauggcgccucccggaaggauaucguagucagaagguguuauaacaauaacuacgagaguugcaagcugcuaaaagaggaacaaucucucauguuugcggacaaccacgagacgauagauguggccaaugugcgccaccuguugggggaccugcaguucaaguuaaugcucggagaccugcgauauaagagcuuugcugaaaacccagaucuugagauugaagcaaagugugucggcugccccuccuguuucaccucauacucuugcagcuucaaaaucguuaguaauaucgacacugugugcuccauugaggggccuuguacaaccuuucauaaccggcugaugaucacuagcacaaagcaggauuauggaauuaagaugucuugcaaaaccaagccaggccccacggaagaguuccagauauguaaaaagacuuacaccaucuuguuuacaaccguagagaaaaaugacaagauugaaaucucaacuggugaucaaacauccuucauccaggagaaggacgaucguugcaaaaccuggcucuguagagugagggacgaagggauuagugucauauuugagccgauccgcgccuucuuuggaagcuacuucucgauugcuuuuuauaucgugauuggcaucauaguucuguuccuagugaucuacauuuuucugccuaugaucuucaaacuucgggauguccucaaaagaaacgaauaucuguacuugcaggagauuaagcacaaauga

SEQ ID NO: 10891 - RNA, 4305 nt, Artificial Sequence
  derived and/or modified CDS sequence (opt3) from BATV(ON-7/B/01)__AB257765.1__GP
augcugcuccuucugguguuguuaauccccugcugugucagcgccuccccuguuauuaccagaugcuuccacggcgggcagcugauagcugagaggaagucucaagcagccaucucagaauuuugucuaaaagacgaugugaguacaauuaagagcgagaucauuuacgaaaagaacgacacuggacucuucgcgcauaauaagguacugcggaacuggaucauaaaagauuggaagaauugcaacccagugccgacggcugguggcuccaucaaugucauugaggugaacaccgaccuuucucugacaacuaagaccuauguuuguucgcgcgauugcacaaucaccguggacaaagaagaugcccagauuaucuuucagacugagaaguugaaucacuucgaggucucagggacaacccucagcaguggaugguuuaaaacgaaggcauccgugacucuggaccgaaccugugaacauauaaaaguaacaugcggcaagaagacucugcaguuccacgccuguuuuaaacaucacaugucuugcauucguuucuuucacgguaccauccuccccgggacaauggcuaccagcauuugucaaaacaucgaguuaaucauuauaaucucccugacgcuuauuaucuucauauugaugguuauucugacuaagacauacaucugcuaucuacucaugccucuguuuaugccaaucgcauacuucuauggauggucauacaauaaaaguugcaagaaaugucccugcuguggccuugccuaucauccuuuuaccaacugcggcagccacugugugugcgggcugaaguucgaggcuucugauagaaugaggauucaucgggaguccggauugugucaggguuacaaaucacuccgcgucgccagacuguuaugcaagagcaagggcaguucucugaucauuuccauacuccuuagcaugcugaucuugucguucgugacuccaauugaggggacacuaaccaauuaccccgaaucuaggaaauaugaccuggaggaaaucgcggaugugcucgagggauuuaucgucgaaaagggcauuaaagaguacguuguguucuauacguccauauuuggugcacuguuccuucugaucgccuugauuguaaucauugcucucaaccgggugaccgaguaccugacaaauaucaacgucuuauauugucacgaaugcucaauguaccacaguaagaaaaauauaaaguauaucggggacuuuacuaacaaguguggauucuguaccugcggcgagcuggaagaucaggagggccuaaaaauucauaaggugagccgcaaaugcaucuacaaguaccagcucacaugguccaaaguuauuaugaugauccuggugugccuuuugauagcccaaaacacuauucugaucgucgcagcuucugacgacuguuggaccaaaaagagccucgaaauggggugcauuggaccucugcaacagguggauacaugugacgauaaagccucacgaaguuauuccggugaggcgaagaaacuuguaagagccagcaagaucucugaccuggaugcagcucagguuggccaguuggggucaaccauagagagugccaucgcuagcauuaggcggcagcguacuuacuccacgaugcaccuccuggaaucuguguuuuuaggaaaacauugcgacuauuacaaggucuucgagcacaauucgggcuauagccaggccaaguggcgccugacagcaaaaacccaucacuuugauaucuguuccagacacucaacucaucacuucuguaggugcauuagugacgguaccaagugccaaaacggggauugggacuuugccggcgaaaugaacucuacauaccagagcaaacgggauuucuuugagcaugacuucaaucuauucuguacccucaucgaaaaugcuuuuccaggaacuacagagucccuguucuaugagaugcuuucaaagaaaaacacgaccggcauaacuaaguugcuggacaaacucacaaagaaguuugggaauaacaauauguucgugggaauuuggaaauuuggucaguaccugaucagcuuaccguacgucaacgaaaccucucugucccccacacagcuugcgaagguguugguugugacugaucaacaccaccgaaguaucagcggccgccaggagucucucgcauccgccaccccugggucaaaaaguagcgaaugcggacaugcuaagaaaguaucgugcauuuccccaagauucggcguccccauggagggucugauggccugugggucuagcccuaauuauaagaucuacaagacgccagcaaaacuauauaagucaaacaauaaaggcgagguguggugcaguggagacguucacuguuuucaggaucugauucccgccucccaggaaucuguggacaggauaaagcaaaugaccugcuuccucacagagccggaagucaacgaugacguguuuagcaucgcuauugccauguguaaaguacaggauaagggcgugugcacuaucaaugaggaccgguggaaccugauuaagugugauuccgggcuuaucuacuauaccgaccagcgcgaaggacaggauacagguaacgacuucggcgaguacugcuugucacauaauuguaaaauggagagauuuccuauaaaccccgcaaucauuagcgauugccugugggaauaucacaguaggaagucuaaauacaucacuuccuuagaccucgagagccuggaagaguucaagcgugcgauuucggaaaaacuuucacauacccugguugucuacaauuuuaagccaacggcuaacuugccucacaucaagcccguguauaaauacauaacagugcaaggggucgaaaauucugacggaguugauagugccuauauuaccgcauccaugccagcccucagcggcacuucuaucgguuacaacaucaugagccgggacaauuucccccuguucgauauuauaaucuuuauuaaguccgcuaucauuaaagccacauauaaccacaucuacgacaccgggccuacuauaggcaucaaugugaugcaugaugagcacuguaccggacagugcccaacagacauuccgcauaaggaaaacuggaucacguucgcacaggagcgaaccucaagauggggcugcgaagaguuugggugucuagcugugaauacuggaugcguauucggcaguugucaggauauuaucaggcccgaaacaaaagucuaucgcaaggccguggaggagagcguucugcucaccgugugcauaacauacccugguaaaacuuuuuguaccgaaauuaacgcgaucgagccaaagaucacggacgaacuggagcuucaauucaagacagucgauaccaaaacuuugcccaauauucuggccgugcagaaccacaaguuauacucugggcagaucaaugaccucggauccuuuucacaaggcugcgguaacauacagaaaaccaaccugaguauuaucggcacagggacugcuaaguucgauuauguuugucauggagcaagccggaaagacauuaucgugagaaggugcuacaauaacaauuaugaguccuguaaacuucugaaggaggaacagucucuaauguuugccgauaaccacgaaaccauagacguagcuaauguccgccaccuccugggcgacuugcaguucaagcugauguuaggggaucuccgauacaagucguuugccgagaacccugaccuggaaauugaggcaaaaugcgugggauguccaagcugcuucacaucauauuccugcaauuucaagaucgugaguaacaucgauacggucuguucuauugagggccccugcaccacuuuucauaaucggcuuaugaucacaagcgcgaaacaagacuacgguauuaagauguccuguaagaccaaaccggggcugacugaagaguuccagauaugcaagaaaacauauaccguuuuguuugccacgguggaaaagaacgaugagaucgaaauuucaacuggagaccagaccucuuucauccaggagcgugaugacagauguaaaacauggcucugcaggguacgcgaugagggcaucagcgugauuuuugaaccuauacgggcuuucuuugguaguuacuucuccaucgccuuuuacauugucaucggcauuaucgugcuguuccuaguuauauauaucuuucugccaaugguguucaaacuuagagacguccucaagaggaaugaguaccuguauuugcaagaaauuaagcacaaguga

SEQ ID NO: 10892 - RNA, 4305 nt, Artificial Sequence
  derived and/or modified CDS sequence (opt3) from BATV(UgMP-6830)__DQ436460.1__GP
augcugcuccuucugguguuguuaauccccugcuacgucagcgccuccccuguugugaccagauguuuccacggcgggcagcugauugcugagaagaaaucucaaacagcaguaucagaauuuugccuaaaggacgaugugaguacuauaaaaagcgagaucacguaugaaaagaacaauaccggacucuucgcccauaacaaaguccugaggaauuggauuaucaaggacuggaagaacuguaauccagugccgacagcggguggcuccauuaacguuaucgaggugaauacugaucuuucucugaccacaaaaaccuacgucugcucgcgggacuguacuauaacaguggauaaggaagacgcucagaucauuuuucagaccgagaaauugaaccacuucgagguaucagggacgacucucagcaguggaugguuuaagaccaaagccuccguuacacuggaucgcacuugcgaacauaucaaggugaccuguggcaagaaaacacugcaguuccacgcaugcuuuaagcaucacaugucuuguauucgauucuuucacgguaccauccuccccgggacgauggccacuagcauaugccaaaauauugaguuaaucauuaucaucucccugacacuuauuauauucaucuugauggucauucugaccaaaacuuauaucuguuaccuacucaugccucuguuuaugccaauagcuuauuucuacggauggucauauaacaagaguugcaaaaagugcagcuguugcggccuugcauaccaucccuuuacaaauuguggcucucacugcgugugugggcugaaauucgaagccuccgaccguaugaggauucauagagagucaggauugugccaggguuacaagagccuccggguggcucgccuguuauguaagaguaaaggcagcucccugaucaucagcauucuccuuucgaugcugaucuugucuuucgucaccccuauugaggggacgcuaaccaacuauccagaauccagaaaguacgaucuggaggaaauagccgacguucucgagggauuuaucguggaaaaaggcauuaaggaguauguaguguucuacacaucaaucuuuggugcgcuguuccuucugauggcauuggucaucauuauagcccucaauaaagugacugaguaucugaccaacaucaauguuuuauacugccacgaauguaguauguaucacagcaagaagaacauuaaauacaucggggauuuuacaaacaagugcggauucuguacuugcggcgagcuggaagaccaggagggccuaaaaauucauaagguguccaggaaaugcaucuacaaguaucagcucaccuggucuaagauaaucaugaugauucuggucugucuuuugaucgcucaaaauacaauucugaucguggccgcaagcgaugacugcuggaccaaaaagucacucgaaauggaguguauagggccccugcagcagguagacacuugcgaugacaaaaguucccggagcuacucuggagaggcuaagaaacuuguucgcgccucaaagauuagugaucugaacgcggcccagguggguuugcucggcagcacgaucgaauccgcaauugcuucuauccgaaagcaaagaacauauucgaccaugcaccuguuagagagcgucuuucuggggaaacauugugacuacuauaaggccuucgaacacaauuccggauacucacaggcuaaauggaggcuaacugccaagacccaucacuuugauauaugcagucggcacucuacacaucacuucugucguugcaucagcgacggcaccaaaugucagaacggugauugggacuuugcaggggagaugaacuccacuuaucaaucaaagaaagauuucuuugaacaugaccucaagcuguucugcacacuuguggagaaugccuucccuggcacgaccgagagcuuguuuuacgaaaugcugucuaagaaaaauacuacaggagucaagaaacuccuggauaaguuaaccaaaaaguucggcaacaauaacauguuuguggggauuuggaaguucggacaguaccugaugucccuuccauauguuaaugagacaaguuugacuccggcucagcucgcgaaaauccuggaagugaccgaccagcaccaccgcagcauuucugguagacaagagucccuagcaucagccacgcccggcaguaagagcaaagagugugggcaugcuaagaaaguaucgugcaucuccccuagguuuggagucccaauggaaggccugcucgccugcggugacucucccaacuacaagauauauaagaccccugcaaaacuguacaagagcaauaacaaaggggaggugugguguucaggcgauguucacugcagucaggaacuuuccccagccucucaggagagcguggaccggauuaagcagaucacauguuucuugacugaacccgaggucuccgaugacguguuuucaaucgcuauuucuaccugcaaaguacaagauaagggaguguguacaguuaaugaggaccgauggaacgucaucaagugcgauaguggccugauuuauuacacugaccagcgcgaugggcaggacaccggaaacgauuucggugaauauuguuuaucucauuccugcagaauagagagguuuccgaucaauccugccauuaucagcgacugucucugggaauaccacucgcggaaaucaaaguacauuacgucucuggaucuugagagucuggaagaguucaaacgcgcaaucuccgagaaguugagccauacacucauaguguauaacuuuaaacccaccgcgaaucugccacacaucaagccuauuuacaaauauaucacugugcagggcgucgaaaacucugacgggguugacagcgcuuacauuacagccuccaugcccgcacuaucaggaaccaguaucggcuauaauauaaugagcagagauaacuucccacuguuugacauuaucaucuucauuaagucugccauaaucaaggcuacuuacaaucacauuuaugauaccggucccacaaucgggauuaacgugaugcaugacgagcacugcacgggccaauguccuaccgauaucccacauaaagaaaauuggauaacuuucgcccaggagaggacaucccguuggggaugcgaagaguuuggcugccucgcagugaacaccggguguguauucggaucaugccaggacaucauucggccggagacaaaggucuaccgaaaagcuguggaagagaguguucugcuuacuguguguaucaccuaccccggcaagacguuuugcacagaaauuaaugccaucgagccuaaaauaaccgaugaguuggaacugcaguucaagacugucgacaccaagacauuaccaaacauucucgcggugcaaaaucacaaacuguauagcggucagaucaacgaucuuggguccuuuucucagggauguggcaauauccaaaagacuaacucgagcauuaucgguaccggcacagccaaauucgacuacguuugccauggggcuucaagaaaggauauaauugugaggcgcuguuauaacaauaacuacgaguccugcaaacugcuaaaggaggaacagagucucauguuugcagacaaucacgaaacgaucgauguagccaacguccggcaccuguugggagaccugcaguucaaguuaaugcucggcgaccugagauauaaaucuuuugcugagaaucccgaucuugagauugaagccaaguguguggggugcccuagcuguuucaccuccuacucaugcucuuuuaaaaucgugagcaacauagacacugucugcaguauugagggaccauguacaaccuuccauaauaggcugaugaucacuuccacaaagcaggauuauggcaucaaaaugagcugcaagaccaagcccgaagagacggaagaguuccaaauuuguaaaaagacuuacaccguuuuguuuacaaccguggagaaaaacgacaagaucgaaauuucuacuggugaucagacaucauucauacaggagcgcgacgaucgaugcaaaaccuggcucugucggguacgugacgaagggaucuccgugauuuuugagccgaucagagcauucuuuggaaguuacuucagcaucgcguuuuaugucgugguuucgauuauagugcuguuccuagccaucuacauuuuucugccuauggucuucaaacuuagggaugugcucaagaagaaugaauaucuguacuugcaggagaucaagcacaaauga

SEQ ID NO: 10893 - RNA, 4305 nt, Artificial Sequence
  derived and/or modified CDS sequence (opt3) from BATV(ZJ2014)__KU746870.1__GP
augcuggugcuccuuguccuguugauccccugcuguguuagcgccuccccugcuauuaccagaugcuuccacggcgggcaguuaauagcagagaggaagucucaaacagccaucucagaauuuugucugaaagacgaugugaguacuauuaagagcgagaucauuuacgagaaaaacgacacgggacuauucgcgcauaauaagguacuccggaacuggaucauaaaagauuggaagaauugcaacccagugccgaccgcugguggcuccaucaaugucauugaggugaacacagaccugucucuuacuaccaagacauauguuuguucgcgcgauugcaccaucacuguggacaaagaagaugcccagauuaucuuucagacagagaagcugaaucacuucgaggucucagggaccacguugagcaguggaugguuuaaaacuaaggcauccgugacccucgaccgaacaugugaacauauaaaaguaacuugcggcaagaagacccugcaguuccacgccuguuuuaaacaucacaugucuugcauucguuucuuucacgguacaauccugcccgggaccauggcuacgagcauuugucaaaacaucgagcucaucauuauaaucuccuuaacucugauuaucuucauacuuaugguuauuuugacaagaaccuacaucugcuaucugcuaaugccucucuuuaugccaaucgcauacuucuauggauggucauacaauaagaguugcaaaaagugucagugcuguggccuggccuaucaucccuuuacuaacugcggcagccacugugugugcgggcuuaaauucgaggcuucugauaggaugcggauucaucgcgaauccggacugugucaggguuacaagucauugagagucgccaggcuccugugcaaaagcaagggcaguucuuuaaucauuuccauacugcucagcaugcuuauccugucguucgugacaccuauugaggggaccuugacgaauuacccagaaucucggaaguaugaccuagaggaaaucgcggaugugcuggagggauuugucguugaaaaaggcaucaaggaguacgugguauucuauaccuccauuuuuggugcacucuuccugcuuauggcccugauagugaucauugcuuugaaccgcgucacagaguaccucacuaauaucaacguguuuuauugucacgaaugcucaauguaccacaguaaaaagaauauuaaauauaucggggacuucaccaacaaguguggauuuugcacaugcggcgagcuggaagaucaggagggcuuaaagauacauaaaguuagccgaaaguguaucuacaaauaccaacugacuugguccaagauuaucaugaugauucuagugugccuccugaucgcccagaacaccauacuuauugucgcagcuucugacgacuguuggaccaaaaagagcuuggaaauggggugcaucggaccccugcaacagguggauacaugugacgauaagacuucaagaaguuauuccggugaggccaaaaagcucguaagggcgagcaaaauuucugaccuggaugccgcacagguuggccuucuggggucaacgaucgagagugcuauagccagcauccggaagcagcguacauacuccaccaugcacuugcucgaaucuguguuccugggaaaauauugcgacuacuauaaggucuuugagcauaauucgggcuacagccaggcuaaguggcgcuuaacugccaaaacccaccauuucgauauuuguuccagacacucaacacaccauuuuuguaggugcaucagugacgguaccaagugccaaaacggggauugggacuucgcaucugaaaugaauagcacuuaucaguccaaacgggauuucuucgagcacgacuucaagguguuuuguacacugauugaaaacgccuucccuggcacgaccgagucacuauuuuacgagaugcucagcaaaaagaauacuacaggaaucaccaaacugcuugacaaguugacaaagaaauucggcaacaauaacauguuugucgggauauggaaguucggacaguaccugaugucucucccauaugugaaugaaacuucccugaguccgacccaguuagcuaaaguucuggaggugacggaucaucaccaccgaagcauuucuggucgccaagaaucccuugcgucagcagcccccggcaguaagagcucggagugcgaccaugcuaaaaagguauccugcaucucuccuagauuuggggucccaaucgagggauugaccgccuguggcagcucacccaacuacaagauuuauaaaacuccugcaaagcucuacaaaaguaauuccaagggugaaguguggugcucuggggauguucacugucugcaggagcuaaucccagccagccaggaauccguggacaggauuaaacagaugacaugcuuccugaccgagcccggcgucaacgaugacauauuuucaaucgcuauuagcauguguaaggugcaagauaagggaguaugcacaaucaaugaagaccgguggaacgugguuaaaugugauaguggccucauuuauuacacugaccagcgcgaggggcaggauaccggaaaugacuucggugaguauugccugucucauuccuguagaaucaagagguuuccgauaaacccugccaucauuaacgauugccuuugggaauaccacagccguaaaucgaaguacaucacgucauuggaccuggagucuuuagaagaguucaaacgggcaauuagugaaaagcucucccauacacugaucgucuauaauuuuaagcccaccgcgaaccuuccacacauaaaaccuguguacaaguauauuacugugcagggcgucgagaauagcgacgggguugauucugcuuacaucacagccagcaugcccgcacuguccggaaccucaaucggcuauaacauuaugagucgagacaauuucccauuguucgauauaaucauuuuuaucaaaagcgccauuaucaaggcuacuuacaaccacauauaugacaccggucccacaaucgggauuaaugugauccaugaugagcacuguacgggccaaugcccuaccgacauuccacauaaagaaaacuggaucacuuucgcccaggagagaacaucuagguggggaugcgaagaguuuggcugucucgcaauaaauaccgggugcguguucggauccugucaggauauuauccgcccggaaacaaagguauaccggaaagcugucgaggagucagugcugcuaacuguuugcaucaccuaccccggcaagacguuuuguacagaaauuaacgccaucgagccuaagauaaccgacgaacuggagcuccaguucaaaacuguggauaccaagacacugccaaauauucuugcgguccaaaaccacaaauuguauaguggucagaucaaugaccuggggagcuuuucccagggaugcggcaacauucaaaagacuaauucuucgaucauagguaccggcacagccaaauucgauuacgugugucauggggcuagcagaaaggacauuaucguuaggcgcugcuauaacaacaauuacgagucauguaaguuacucaaagaagaacagucccugauguuugcagauaaccacgaaacgaucgacguggccaauguacgacaccuucugggagaccuacaguucaagcucaugcugggcgauuugcgguauaaaaguuuugcugagaaccccgaccuggaaauugaggccaagugcgucggguguccuucuugcuucaccagcuacuccugcucauucaaaaucgugucuaauauugauacuguguguagcauagacggaccaugcacaaucuuucauaaccguuuaaugauuaccaguacuaagcaggauuauggcaucaagauguccuguaaaacaaagcccgguccgaccgaggaauuucaaaucugcaaaaagacguacacuauucucuuuaccacaauagagaaaaaugacaagaucgaaauuagcaccggggaucagacuucuuucauccaggagagagacgauaggugucgcacauggcugugccgggucagagacgaaggaauuucaguuaucuuugagccuauaagggcauucuuuggcuccuacuucaguaucgcguuuuauauugugaucgguauuaucauacuuuuccugguaauuuacaucuuuuugccaaugguguucaagcuccgagauguccugaaacgcaacgaguaucuauaccugcaggaaauuaagcacaaauga

SEQ ID NO: 10894 - RNA, 4305 nt, Artificial Sequence
  derived and/or modified CDS sequence (opt3) from CVV__AF082576.1__GP
augcuguuccuccuuauccuggccuuuuugggcuucagcaccuccaaccccauugcuacaagaugcuuucacgggggacaguuaauagcagagucuaagucagccacuuccaucagcgaguucugucugaaagacgauguguccaugcuaaagucugaagucguuuacauuaaaaaugacacgggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauuaccagcaugugucagaauaucgaauuaauuaucauccugggccuuacauuggccauuuucauacugauggugaugcuaaccaaaacguacaucugcuaucuccugaugcccauuuucaugccuaucgcuuaccuuuauggcugggcauacaacaagucuuguaaaaagugcaauugcugugggcuggccuaucauccauuuacuaacugcggaucccacuguguaugcgguuugaaauucgaggcuucagaucguaugagaauacauagggaaagcggccucugucaaggguacaagagucugcggauugcccgcuuacugugcaagucuaaaggauccagccucguuaucucgggccuucugucuauguugauccuauccuuugugacacccauugaggguaccaucacuucauacccugagaguagaaaguauacacuggaagagauuaccgacgucguggaagggcucgugagcgagcagaauauaaaagaauacaucgucuucuauacgucccuguuuggaucucuuauucuguugcucgcguucaucaugagcaucacccugucaaagauuacaaguauauuagcaaaaaggaacguuaucuacugugaggagugcuccauguaucacagcaagcggggcauuaaguacaauggcgauuuuacuaacaaauguggguucugcaccuguaacgaacaggaggacacagaaggacuggugauccacaagguaucuaaacgcugcacuuauaaguaccagcuaaaaugggccaaggugcucaugauuacccugguccuuuugcugaucgcucaaaauacaauacucaucguggccgcagagaccgauugcuggacuaagaaaucacuggacauugacuguaucgguccaaugcuugauauuggcaguugcacgaacaagaauacacgaagcuacgacgcugaagcccagaaacugguuucccagucuaagaucucgcaguuggaugcggaccaagccagccuccuggggaacuccauagauucagcaauuaaagcuaucagagcccagaagaccuaucccacuaugcauuuacuggagaccauuuuucuaaugaagaauugugacuacuauacaaguuucaaccacaauucuggauacagccaggcuaaauggaggcucaucgccaagaccggccauuuugauauaugcucccggcacucaacucaucacuucugucaaugcaucaacgacgguacaaaaugucagaauggggauugggacuuugcaggcgagaugaacgaaacguauaauagcaagaacgauuucuacucucacgaccugaaucuuuucuauaccauuuuugagaacgccuucccuggaacuacagaauccuuguuuuaccagcugauccagaaaaagaauaccacaggcgcuaguaaagugcucgggaagcugauuacuaaguacggaaacaacaauauguucgucgguaucuggaaauuuggccaauauuuacugacccuuccauacauaaacaauacggaguugagccagaaccgucgccucaccauucuggcgacacaggaacuacugucuagaucccauucagggaggcaggagaguaugagcaaugcaauccaaggaucgaucacuaaggagugccacaacgccaaaggcguggguuguauuuccccgcaguucgggauccccauuggcaaucucaccgcuugcggagacucuccuaacuauaagauauacaaaacaccagaaaagcuguauaagagcaauaacaaaggcgagguaugguguucaaaugauguucauugccuuaacgacuuugaacccgccgaugaggagguggucaauaagaucaaaaaguugacuugcuuccugaccgacgugagugucgaaguggauauuuuuaguguugcagccucuacguguaaaauggcugacaagggggugugcacaguaaacggagccaaguggaauaucauuaaaugugauagcgguuuauacuauuucaccgaccaccgggagggccaggauacugggaacgacuuuggagaauacugcaucucccacucauguaacacagagcgauucccuauaaauccagauacccucaaggacugcacuugggaauuucauagccgcaaaaguaaguacaucucuaccauuucccuggagagccuugaggaguucagaagggcaauggcggaaaaacugucgcacacauugacgaucuauaacuucaagcccaccgcuaaucucccgcauauucggccuacuuacaaguuuaucacagccaacggcgucgaaaauucagaugguauagagucugcauauauucugaguuccauccccgcccuagggggcaucagcgugggauacaacguucagaccaaagacaauuucccacugcucgacauuauaguguuuaucaagucugcugucauucgcacaacuuauaaccacaucuacgauaccggcccuacgauugggaucaauacacaacaugacgaacacuguaccggacccugcccagccgugguaccccacaaagagaacuggaugacuuucagccaggagagaaccuccagguggggcugugaagaguuugguugccuggcaauaaauacaggguguguguucggaucaugccaggauaucauucauccugaaacuaagguuuaucguaaagcugucgaggaagagguggugcuuaccgucugcaucaacuuuccaggcaauaacuacuguacagagauuaaugccaucgaaccgaagauaacggacgagauugaauugcaguucaaaaccguugauacuaagacacugcccaacuuacucgcggugcaaaaccacaagcuguacaguggucagaucaaugaccuuggcagcuuuucucaggggugcggaaacgugcagaaaaccaaucauuccauccugggcauggggacuguaaaguucgauuaugucugucacggagccucacggaaagacgugauuguucgaagaugcuacaacaauaacuuugauaguuguaagcuacucaaagaggagacaagccugaucuucgcugacaaucaugaaaccuuggagguggcacacacgaagcaccugauaggcgaauuacaauucaagauuaugcucggugauaucagguauaaauccuuugccgagucuccugaacuggagauugacgcuaagugcgucggguguccaucgugcuucgagagcuacucauguaacuuucagaucguguccaauauagauacuguuugcaguguggaaggacccuguacccuuuuccauaaccgcauuaucaucucugccaauaaacagagcuauggccugaagauguccugccaaacaaaaccuaaccagaaugaggaauuuauuaucugcaaccggaaguacucaguauuguucaccacuauugacaagaaugacaaaauagaggucaacacaggugaucagaccucuuauaucuacgaaaaggacagcagauguaaaacauggcucugcagggugcgcgaugagggcauuagugugcuguuugagccacuaaaggcauucuuuggguccuacuucagcaucaucuuuuaugucguugugggaauuauaguacuguuccuuaucauuuacaucuuucuccccauguucuucaaacugaaggacguguugaagcgaaaugaauaucuguacuuacaggagcucaaacacaaguga

SEQ ID NO: 10895 - RNA, 4305 nt, Artificial Sequence
  derived and/or modified CDS sequence (opt3) from CVV(Montgomery County/VA/2015 4b)__KX583998.1__GP
augcuguuccuccuuauccuggccuuuuugggcuucagcaccuccaaccccauugcuacaagaugcuuucacgggggacaguuaauagcagagucuaagucagccacgaguaucagcgaauuuugucugaaagacgauguguccaugcuaaagucugaggucguuuacacuaaaaaugacaccggucucuuuggccauaacaagguguucaggucguggacaauuaaagauuggaagcugugcaauccuaucccaacugcugggggaaccauuaacguaaucgaagugaauaaggaccuuucacugaugacaaaaaccuauauauguagccgggauugcacuaucacaauugacaaggaggaagcgcaaaucauuuuucagaccgauaaauugaaccacuucgaggucaguggcacgacucucaauuccgguugguuuaagucuaaagccagcgugacccuggaccgcacaugugagcauguuaaggugacuugcgggaagaaaucccugcaguuccacgcauguuuuaagcaucacaugucaugcguccgauucuuucacaacaccauccucccgggaaauaugauaaacaguaugugucagaauauugaauuaaucauuauccugggccuuacauuggccaucuucauucugauggugaugcuaaccaaaacguacauaugcuaucuccugaugcccaucuucaugccuauugcuuaccuuuauggcugggcauacaacaagagcuguaaaaagugcaauugcugugggcuggccuaucauccauuuacuaacugcggaucucacuguguaugcgguuugaaauucgaggcuuccgaucguaugagaauccauagggaaucaggccucugucaaggguacaagagccugcggauagcccgcuuacugugcaagaguaaaggaucuucccucguuauuagcggccuucugucgauguugauccuaucuuuugugacacccaucgaggguaccauuacuuccuacccugagucaagaaaguauacacuggaagagaucaccgacgucguggaagggcucgugagugagcagaauauuaaagaauacauagucuucuauacgagccuguuuggaucccuuauccuguugcucgcguucauuaugucuaucacccugagcaagaucacaucaauuuuagcaaggcggaacguuauauacugugaggagugcaguauguaucacuccaaacgcggcaucaaguacaacggcgauuuuacuaauaaguguggguucugcaccuguaacgaacaggaggacgccgaaggacuggugauucacaaaguaagcaagcgaugcacauauaaauaccagcuaaagugggcuaaagugcucauggucacucuggugcuuuugcugaucgcccaaaauaccauucucaucguugcagcugguacagauugcugggccaagaagucucuggacauggacuguauaggcccaaugcuugauaucgggucaugcaccaacaaaaauacuagaaacuacgacacggaggcgcagaagcuggugagucagagcaaagucucccaguuggaugccgaccaagcaucucuccugggaaauucgauugauagcgcuaucaaggccauuagggcucagaaaacauaucccaccaugcauuuacuggaaacuaucuuucuaaugaagaacugugacuacuauaccuccuucaaucacaacucaggcuacagucaggccaaguggcggcucauagcaaaaacaggucauuuugauauuugcucucgucacagcacccaucacuucugucgcugcaucaaugacgggacuaagugucaaaacggcgauugggacuuugccggagagaugaaugagacauauaacuccaaaaaugauuucuacucacacgaccugaaccuuuucuauacgauuuuugaaaacgcuuucccuggcaccacugagagcuuguuuuaccagcugauccagaagaaaaauacaaccggggcgucuaagauacucggaaaacugaucacaaaguacgguaacaauaacauguucgugggcguauggaaguuugggcaguauuuacugacucuuccauacauuaauaacaccgaauugucccaaaauagaaggcagacgauccucgcaacccaggagagucugagccggucucauuccggacgacaggaaucaaugaguagcgccauucaaggcucgguuacaaaagagugccacaacgcuaaggacguggguuguaucuccccgcgcuucgggauacccauuggcaaucuaacugccugcggagauucuccuaacuauaaaaucuacaagaccccagagaaacuguauaagagcaauaacaagggcgaagucugguguucaaaugacgugcauugccucaacgauuuugagcccgcagacgaagaggucgugaauaaaguuaagaaacugacaugcuuccuuacugaugugaguguaaagaccgacaucuuuuccgucgccgugucuacguguaaaauggcugauaaggggacaugcaccguuaaggacgccaaauggaacauuaucaagugugauagcggauuguacuauuucacugaccacagagagggucaggauacaggcaacgacuuuggggaauacugcauuucccacucauguaauaccgagagguucccuauaaacccagauauccugaaagacugcacuugggaauuucauagccggaagaguaaauacauuucuaccaucuccuuagagagccucgaagaguuccgcagagcaaugacagagaagcugucgcacacgcuuaccauuuauaauuucaagcccacugcgaaccugccgcauaucaggccuacauacaaauuuauaaccgcuaauggaguggaaaacucagacggcaucgagucugccuauauuuugaguuccauccccgcacucggugggauuagcgucggcuacaaugugcagacaaaggauaacuucccacugcuagacaucauaguauuuauuaaaucugccgugauccguacuaccuauaaucacaucuacgauacgggaccuacaauuggcauaaacacccagcaugacgaacacuguacugggcccugcccagcuguugucccccacaaggagaauuggaucaccuucagccaagaacggacaucccgauggggaugugaggaguuuggcugccuggccauuaacacugguuguguguucgggucaugccaggauaucauucauccugaaaccaaaguguauagaaaggcagucgaggaagagguugugcucacagugugcaucaauuuuccaggaaacaauuacuguacggaaauaaacgcuguagagccgaaaaucaccgacgagauugaacugcaguucaagacugucgauacaaagacccuucccaacuugcuggccgugcagaauaggaaauuauacaguggccaaaucaacgaccucgguagcuuuucucagggcugcgggaauguucagaagacuaaccacuccauucugggaaugggcacagcgaaauucgauuaugugugucauggggccucacgcaaggacgucaucgugcggagaugcuacaauaacaauuuugauaguuguaggcuucugaaagaggaaaccagccuaauauucgcugacaaccacgagacgcucgagguugcacauacuaagcaccugauuggagaauugcaauucaagaucaugcugggcgauauccgcuauaaauccuuugccgagucuccugaauuagagauugacgcuaagugcguggguuguccaucgugcuucgaaagcuacucauguaauuuucagaucguaaccaacauagacacagucugcuccguggaggggcccuguacccucuuccacaaucgaauuaucauuagugccaacaaacagucuuauggacugaagaugagcugccagacuaaaccuaaucaaaacgaggaauuuaucauaugcaaucggaaguacuccgugcuuuucacaaccauugauaagaacgacaaaaucgaggucaauacaggcgaucagacuucauauaucuacgaaaaggacucucguuguaaaaccuggcugugcagaguuagggaugaggguauuagcguguuguuugaaccacucaaggcauucuuuggcaguuacuucuccaucauuuucuauguaguggucgggauaaucgugcuguuccuaauuaucuacaucuuucugcccauguucuucaaacuuaaggacguucucaagcgcaacgaguaucuguacuugcaggagcugaaacauaaguga

SEQ ID NO: 10896 - RNA, 4305 nt, Artificial Sequence
  derived and/or modified CDS sequence (opt3) from CVV(Montgomery County/VA/2015 K)__KX583999.1__GP
augcuguuccuccuuauccuggccuuuuugggcuucagcaccuccaaccccauugcuacaagaugcuuucacgggggacaguuaauagcagagucuaagucagccacgaguaucagcgaauuuugucugaaagacgauguguccaugcuaaagucugaggucguuuacacuaaaaaugacaccggucucuuuggccauaacaagguguucaggucguggacaauuaaagauuggaagcugugcaauccuaucccaacugcugggggaaccauuaacguaaucgaagugaauaaggaccuuucacugaugacaaaaaccuauauauguagccgggauugcacuaucacaauugacaaggaggaagcgcaaaucauuuuucagaccgauaaauugaaccacuucgaggucaguggcacgacucucaauuccgguugguuuaagucuaaagccagcgugacccuggaccgcacaugugagcauguuaaggugacuugcgggaagaaaucccugcaguuccacgcauguuuuaagcaucacaugucaugcguccgauucuuucacaacaccauccucccgggaaauaugauaaacaguaugugucagaauauugaauuaaucauuauccugggccuuacauuggccaucuucauucugauggugaugcuaaccaaaacguacauaugcuaucuccugaugcccaucuucaugccuauugcuuaccuuuauggcugggcauacaacaagagcuguaaaaagugcaauugcugugggcuggccuaucauccauuuacuaacugcggaucucacuguguaugcgguuugaaauucgaggcuuccgaucguaugagaauccauagggaaucaggccucugucaaggguacaagagccugcggauagcccgcuuacugugcaagaguaaaggaucuucccucguuauuagcggccuucugucgauguugauccuaucuuuugugacacccaucgaggguaccauuacuuccuacccugagucaagaaaguauacacuggaagagaucaccgacgucguggaagggcucgugagugagcagaauauuaaagaauacauagucuucuauacgagccuguuuggaucccuuauccuguugcucgcguucauuaugucuaucacccugagcaagaucacaucaauuuuagcaaggcggaacguuauauacugugaggagugcaguauguaucacuccaaacgcggcaucaaguacaacggcgauuuuacuaauaaguguggguucugcaccuguaacgaacaggaggacgccgaaggacuggugauucacaaaguaagcaagcgaugcacauauaaauaccagcuaaagugggcuaaagugcucauggucacucuggugcuuuugcugaucgcccaaaauaccauucucaucguugcagcugguacagauugcugggccaagaagucucuggacauggacuguauaggcccaaugcuugauaucgggucaugcaccaacaaaaauacuagaaacuacgacacggaggcgcagaagcuggugagucagagcaaagucucccaguuggaugccgaccaagcaucucuccugggaaauucgauugauagcgcuaucaaggccauuagggcucagaaaacauaucccaccaugcauuuacuggaaacuaucuuucuaaugaagaacugugacuacuauaccuccuucaaucacaacucaggcuacagucaggccaaguggcggcucauagcaaaaacaggucauuuugauauuugcucucgucacagcacccaucacuucugucgcugcaucaaugacgggacuaagugucaaaacggcgauugggacuuugccggagagaugaaugagacauauaacuccaaaaaugauuucuacucacacgaccugaaccuuuucuauacgauuuuugaaaacgcuuucccuggcaccacugagagcuuguuuuaccagcugauccagaagaaaaauacaaccggggcgucuaagauacucggaaaacugaucacaaaguacgguaacaauaacauguucgugggcguauggaaguuugggcaguauuuacugacucuuccauacauuaauaacaccgaauugucccaaaauagaaggcagacgauccucgcaacccaggagagucugagccggucucauuccggacgacaggaaucaaugaguagcgccauucaaggcucgguuacaaaagagugccacaacgcuaaggacguggguuguaucuccccgcgcuucgggauacccauuggcaaucuaacugccugcggagauucuccuaacuauaaaaucuacaagaccccagagaaacuguauaagagcaauaacaagggcgaagucugguguucaaaugacgugcauugccucaacgauuuugagcccgcagacgaagaggucgugaauaaaguuaagaaacugacaugcuuccuuacugaugugaguguaaagaccgacaucuuuuccgucgccgcuucuacguguaaaauggccgauaaggggacaugcaccgugaacgacgcaaaguggaacauuaucaaaugugauagcggauuguacuauuucacugaccacagagagggucaggauacaggcaaugacuuuggggaauacugcauuucccacucauguaacaccgagagguucccuauaaauccagauauccugaaggacugcacuugggaauuucauagccggaaaaguaaguacauuucuaccaucuccuuagagagccucgaagaguuccgcagagcgaugacagagaaacugucgcacacgcuuaccauuuauaacuucaagcccacugcuaaucugccgcauaucaggccuacauacaaguuuauaaccgccaacggaguugaaaauucagacggcaucgagucugcauauauuuugaguuccauccccgcccucggugggauuagcgugggcuacaacguccagacaaaagauaauuucccacugcuagacaucauaguguuuauuaagucugcuguaauccguacuaccuauaaccacaucuacgauacgggaccuacaauuggcauaaauacccagcaugacgaacacuguacugggcccugcccagccgugguuccccacaaagagaacuggaucaccuucagccaagaacggacaucccgauggggaugugaggaguuuggcugccuggcaauuaauacugguugugucuucgggucaugccaggauaucauucauccugaaaccaagguguauagaaaagcuguggaggaagaggucguucucacagugugcaucaacuuuccaggaaauaacuacuguacggaaauaaacgccguggagccgaagaucaccgacgagauugaacugcaguucaaaacuguagauacaaagacccuucccaauuugcuggcgguccagaaccacaaguuauacaguggccaaaucaaugaccucgguagcuuuucucagggcugcgggaacgugcagaaaacuaaucauuccauucugggaaugggcacagccaaguucgauuauguuugucacggggcuucaaggaaagacgugaucguccgccggugcuacaacaauaacuuugauaguuguagacuucugaaggaggaaaccagccuaauauucgcagacaaucaugagacgcucgagguggcccacacuaaacaccugauuggagaauugcaauucaagaucaugcugggcgauaucagguauaaguccuuugcugagucuccugaauuagagauugacgccaaaugcguugguuguccaucgugcuucgaaagcuacucauguaacuuucagaucgugaccaauauagacacaguaugcuccgucgaggggcccuguacccucuuccauaaccgcauuaucauuagugcaaauaagcagucuuauggacugaaaaugagcugccagacuaagccuaaccaaaaugaggaauuuaucauaugcaaccgaaaauacuccgugcuuuucacaaccauugauaagaaugacaagaucgaggugaacacaggcgaucagacuucauauaucuacgaaaaagacucucgguguaagaccuggcugugccgugucagagaugaggguauuagcguuuuguuugaaccacucaaagcguucuuuggcaguuacuucuccaucauuuucuaugugguaguggggauaaucguccuguuccuaauuaucuacaucuuucugcccauguucuucaaacuuaaggacgugcucaagaggaacgaguaucuguacuugcaggagcugaagcacaaauga

SEQ ID NO: 10897 - RNA, 4305 nt, Artificial Sequence
  derived and/or modified CDS sequence (opt3) from CVV(1156)__EU583730.1__GP
augcuguuccuccuuauccuggccuuuuugggcuucagcaccuccaaccccauugcuacaagaugcuuucacgggggacaguuaauagcagagucuaagucagccacgaguaucagcgaguucugucugaaagacgauguguccaugcuaaagucugaagucguuuacauuaaaaaugacacuggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauuaccagcaugugucagaauaucgaauuaauuaucauccugggccuuacauuggccauuuucauacugauggugauccuaaccaaaacguacauuugcuaucuccugaugcccaucuucaugccuauagcuuaccuuuauggcugggcauacaacaagucuuguaaaaagugcaauugcugugggcuggccuaucauccauuuacuaacugcggaucccacuguguaugcgguuugaaauucgaggcuucagaucguaugaggauucauagagaaagcggccucugucaaggguacaagagucugcggaucgcccgcuuacugugcaagucuaaaggauccagccucguuaucucgggccuucugucuauguugauucuauccuuugugacacccaucgaggguaccauuacuucauacccugagaguagaaaguauacacuggaagagauaaccgacgucguggaagggcucgugagcgagcagaauaucaaagaauacauugucuucuauacgucccuguuuggaucucuuauccuguugcucgcguucaucaugagcauuacccugucaaagauaacaaguaucuuagcaaaaaggaacguuauuuacugugaggagugcuccauguaucacagcaagcggggcaucaaguacaauggcgauuuuacuaacaaauguggguucugcaccuguaacgaacaggaggacacagaaggacuggugauucacaagaucucuaaacgcugcacuuauaaguaccagcuaaaaugggccaagguacucaugauaacccuggugcuuuugcugaucgcucaaaauacaauucucaucgucgccgcagagaccgauugcuggacuaagaaaucacuggacauugacuguaucgguccaaugcuugauauaggcaguugcacgaacaagaauacacgaagcuacgacgcugaagcccagaaacuggugucccagucuaagauuucgcaguuggaugcggaccaaguuagccuccuggggaacuccaucgauucagccauuaaagcaaucagagcucagaagaccuaucccacuaugcauuuacuggagaccauauuucuaaugaagaauugugacuacuauacaaguuucaaccacaauucuggauacagccaggccaaauggaggcucaucgcuaagaccggccauuuugauauuugcucccggcacucaacucaucacuucugucguugcaucaacgacgguacaaaaugucaaaauggggauugggacuuugccggcgagaugaacgaaacguauaauagcaagaacgauuucuacucucacgaccugaaucuuuucuauaccauuuuugagaacgcauucccuggaacuacagaauccuuguuuuaccagcugauccagaaaaagaauaccacaggcgccaguaaagugcucgggaagcugauaacuaaguacggaaacaacaauauguucgucgguguguggaaauuuggccaguauuuacugacccuuccauacauuaacaauacggaguugagccaaaaccgcagacucaccauccugacaacucaggaacuacugucuaggucccauucagggcggcaggagaguaugagcaaugcuauccagggaucgauuaccaaggagugccacaacgcgaaaggcguagguuguaucuccccgcgauucgggauucccauaggcaaucucacagcaugcggagacucuccuaacuauaagaucuacaaaacuccagaaaagcuguauaagagcaauaacaaaggcgagguuugguguucaaaugaugugcauugccuuaacgacuuugaacccgccgaugaggaggucgugaauaagauuaaaaaguugaccugcuuccugacggacgucaguguggaaguugauaucuuuuccguggcugccucuacauguaaaauggcagacaaggggguaugcaccgucaacggagccaaguggaauauuaucaaaugugauagcgguuuauacuauuucacugaccaccgcgagggccaagauacagggaacgacuuuggagaauacugcauaucccacucauguaacaccgagagauucccuaucaauccagauauucucaaggacugcacuugggaauuucauagcaggaaaaguaaguacaucucuaccauuucccuggagagccuugaggaguuccggcgcgcuauggccgaaaaacugucgcacacauugacgaucuauaacuucaagcccaccgcaaaucucccgcauauaagaccuacuuacaaguuuauuacagcgaacggcguggaaaauucagaugguaucgagucugcuuauauccugaguuccauucccgcccuagggggcauaagcguuggauacaacgugcagaccaaagacaauuucccacugcucgacaucauugucuuuaucaagucugcagugauuaggacaacuuauaaccacaucuacgauaccggcccuacgauagggaucaauacacagcaugacgaacacuguaccggacccugcccagccguagugccccacaaagagaacuggaugacuuucagccaggagcguaccucccgguggggcugugaagaguuugguugccuggcuauuaauacaggguguguuuucggaucaugccaagauaucauucauccugaaacuaaggucuaucgaaaagccguggaggaagaggugguccuuaccguuugcaucaacuuuccaggcaauaacuacuguacagagauaaaugcaauugaaccgaagaucacggacgagaucgaauugcaguucaaaaccguggauacuaagacacugcccaacuuacucgcugugcagaaccacaagcuguacaguggucagauuaaugaccuuggcagcuuuucucaagggugcggaaacguacagaaaaccaaucauuccauccugggcauggggacugucaaguucgauuaugugugucacggagccucaagaaaagacguuauagugaggcgcugcuacaacaauaacuuugauaguuguaagcuacucaaagaggagacaagccugauuuucgcggacaaucaugaaaccuuggaggucgcccacacgaagcaccugaucggcgaauuacaguucaagauuaugcucggugauauccgguauaaauccuuugcugagucuccugaacuggagauagacgcaaagugcgugggguguccaucgugcuucgagagcuacucauguaacuuucaaauuguuacuaauaucgauaccgugugcuccguagaaggacccuguacacuuuuccauaacagaaucauuaucagugccaauaaacagucuuauggccugaagaugagcugccagaccaaaccuaaccagaaugaggaauuuauuauaugcaacaggaaguacuccgucuuguucacuacaaucgacaagaaugacaaaauugaggugaacaccggugaucaaacaucauauaucuacgaaaaggacucucgcuguaaaacuuggcucugccgagugcgggaugagggcaucagcguccuguuugagccacuaaaggcuuucuuugggaguuacuucuccauuauauuuuauguugugaucggaauuaucguacuguuccuuauuaucuacauauuucuccccauguucuucaaacugaaggacguguugaagcguaaugaauaucuguacuuacaggagcucaaacacaaguga

SEQ ID NO: 10898 - RNA, 4305 nt, Artificial Sequence
  derived and/or modified CDS sequence (opt3) from CVV(6V633)__KX100134.1__GP
augcuguuccuccuuauccuggccuuuuugggcuucagcaccuccaaccccauugcuacaagaugcuuucacgggggacaguuaauagcagagucuaagucagccacuuccaucagcgaguucugucugaaagacgauguguccaugcuaaagucugaagucguuuacauuaaaaaugacacgggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauuaccagcaugugucagaauaucgaauuaauuaucauccugggccuuacauuggccauuuucauacugauggugaugcuaaccaaaacguacaucugcuaucuccugaugcccauuuucaugccuaucgcuuaccuuuauggcugggcauacaacaagucuuguaaaaagugcaauugcugugggcuggccuaucauccauuuacuaacugcggaucccacuguguaugcgguuugaaauucgaggcuucagaucguaugagaauacauagggaaagcggccucugucaaggguacaagagucugcggauugcccgcuuacugugcaagucuaaaggauccagccucguuaucucgggccuucugucuauguugauccuauccuuugugacacccauugaggguaccaucacuucauacccugagaguagaaaguauacacuggaagagauuaccgacgucguggaagggcucgugagcgagcagaauauaaaagaauacaucgucuucuauacgucccuguuuggaucucuuauucuguugcucgcguucaucaugagcaucacccugucaaagauuacaaguauauuagcaaaaaggaacguuaucuacugugaggagugcuccauguaucacagcaagcggggcauuaaguacaauggcgauuuuacuaacaaauguggguucugcaccuguaacgaacaggaggacacagaaggacuggugauccacaagguaucuaaacgcugcacuuauaaguaccagcuaaaaugggccaaggugcucaugauuacccugguccuuuugcugaucgcucaaaauacaauacucaucguggccgcagagaccgauugcuggacuaagaaaucacuggacauugacuguaucgguccaaugcuugauauuggcaguugcacgaacaagaauacacgaagcuacgacgcugaagcccagaaacugguuucccagucuaagaucucgcaguuggaugcggaccaagccagccuccuggggaacuccauagauucagcaauuaaagcuaucagagcccagaagaccuaucccacuaugcauuuacuggagaccauuuuucuaaugaagaauugugacuacuauacaaguuucaaccacaauucuggauacagccaggcuaaauggaggcucaucgccaagaccggccauuuugauauaugcucccggcacucaacucaucacuucugucguugcaucaacgacgguacaaaaugucaaaauggggauugggacuuugcaggcgagaugaacgaaacguauaauagcaagaacgauuucuacucucacgaccugaaucuuuucuauaccauuuuugagaacgccuucccuggaacuacagaauccuuguuuuaccagcugauccagaaaaagaauaccacaggcgcuaguaaagugcucgggaagcugauuacuaaguacggaaacaacaauauguucgucgguaucuggaaauuuggccaguauuuacugacccuuccauacauaaacaauacggaguugagccaaaaccgcagacucaccauucuggcgacacaggaacuacugucuaggucccauucagggcggcaggagaguaugagcaaugcaauccagggaucgaucacuaaggagugccacaacgccaaaggcguggguuguauuuccccgcgauucgggauccccauuggcaaucucaccgcuugcggagacucuccuaacuauaagauauacaaaacaccagaaaagcuguauaagagcaauaacaaaggcgagguaugguguucaaaugauguucauugccuuaacgacuuugaacccgccgaugaggagguggucaauaagaucaaaaaguugacuugcuuccugaccgacgugagugucgaaguggauauuuuuaguguugcagccucuacguguaaaauggcugacaagggggugugcacaguaaacggagccaaguggaauaucauuaaaugugauagcgguuuauacuauuucaccgaccaccgcgagggccaagauacugggaacgacuuuggagaauacugcaucucccacucauguaacacagagagauucccuauaaauccagauacccucaaggacugcacuugggaauuucauagcaggaaaaguaaguacaucucuaccauuucccuggagagccuugaggaguuccggcgcgcaauggcggaaaaacugucgcacacauugacgaucuauaacuucaagcccaccgcuaaucucccgcauauuagaccuacuuacaaguuuaucacagccaacggcgucgaaaauucagaugguauagagucugcauauauucugaguuccauccccgcccuagggggcaucagcgugggauacaacguucagaccaaagacaauuucccacugcucgacauuauaguguuuaucaagucugcugucauuaggacaacuuauaaccacaucuacgauaccggcccuacgauugggaucaauacacagcaugacgaacacuguaccggacccugcccagccgugguaccccacaaagagaacuggaugacuuucagccaggagcguaccucccgguggggcugugaagaguuugguugccuggcaauaaauacaggguguguguucggaucaugccaagauaucauucauccugaaacuaagguuuaucgaaaagcugucgaggaagagguggugcuuaccgucugcaucaacuuuccaggcaauaacuacuguacagagauuaaugccaucgaaccgaagauaacggacgagauugaauugcaguucaaaaccguugauacuaagacacugcccaacuuacucgcggugcagaaccacaagcuguacaguggucagaucaaugaccuuggcagcuuuucucaagggugcggaaacgugcagaaaaccaaucauuccauccugggcauggggacuguaaaguucgauuaugucugucacggagccucaagaaaagacgugauuguuaggcgcugcuacaacaauaacuuugauaguuguaagcuacucaaagaggagacaagccugaucuucgcugacaaucaugaaaccuuggagguggcacacacgaagcaccugauaggcgaauuacaguucaagauuaugcucggugauauccgguauaaauccuuugccgagucuccugaacuggagauugacgcuaagugcgucggguguccaucgugcuucgagagcuacucauguaacuuucaaaucgugacuaauauagauaccguuugcuccguggaaggacccuguacacuuuuccauaacagaauuaucaucagugccaauaaacagucuuauggccugaagaugagcugccagaccaaaccuaaccagaaugaggaauuuauuaucugcaacaggaaguacuccguauuguucacuacaauugacaagaaugacaaaauagaggucaacaccggugaucaaacaucauauaucuacgaaaaggacucucgcuguaaaacuuggcucugccgagugcgggaugagggcauuagcgugcuguuugagccacuaaaggcauucuuugggaguuacuucuccaucaucuuuuaugucguugugggaauuauaguacuguuccuuaucauuuacaucuuucuccccauguucuucaaacugaaggacguguugaagcguaaugaauaucuguacuuacaggagcucaaacacaaguga

SEQ ID NO: 10899 - RNA, 4305 nt, Artificial Sequence
  derived and/or modified CDS sequence (opt3) from CVV(807270)__AF186243.1__GP
augcuguuccuccuuauccuggccuuuuugggcuucagcaccuccaaccccauugcuacaagaugcuuucacgggggacaguuaauagcagagucuaagucagccacuuccaucagcgaauuuugucugaaagacgauguguccaugcuaaagucugaggucguuuacauuaaaaaugacacgggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauuaccagcaugugucagaauaucgaauuaauuaucauccugggccuuacauuggccauuuucauacugauggugauccuaaccaaaacguacauuugcuaucuccugaugcccaucuucaugccuauagcuuaccuuuauggcugggcauacaacaagucuuguaaaaagugcaauugcugugggcuggccuaucauccauuuacuaacugcggaucccacuguguaugcgguuugaaauucgaggcuucagaucguaugaggauucauagagaaagcggccucugucaaggguacaagagucugcggaucgcccgcuuacugugcaagucuaaaggauccagccucguuaucucgggccuucugucuauguugauucuauccuuugugacacccaucgaggguaccauuacuucauacccugagaguagaaaguauacacuggaagagauaaccgacgucguggaagggcucgugagcgagcagaauaucaaagaauacauugucuucuauacgucccuguuuggaucucuuauccuguugcucgcguucaucaugagcauuacccugucaaagauaacaaguaucuuagcaaaaaggaacguuauuuacugugaggagugcuccauguaucacagcaagcggggcaucaaguacaauggcgauuuuacuaacaaauguggguucugcaccuguaacgaacaggaggacacagaaggacuggugauucacaagguaucuaaacgcugcacuuauaaguaccagcuaaaaugggccaaggugcucaugaucacccugguccuuuugcugauagcucaaaauacaauccucauuguggccgcagagaccgauugcuggacuaagaaaucacuggacaucgacuguauugguccaaugcuugauaucggcaguugcacgaacaagaauacacgaagcuacgacgcugaagcccagaaacugguuucccagucuaagauaucgcaguuggaugcggaccaagugagccuccuggggaacuccauugauucagccaucaaagcaauuagagcucagaagaccuaucccacuaugcauuuacuggagaccaucuuucuaaugaagaauugugacuacuauacaaguuucaaccacaauucuggauacagccaggccaaauggaggcucauagcuaagaccggccauuuugauaucugcucccggcacucaacucaucacuucugucaaugcauuaacgacgguacaaaaugucagaauggggauugggacuuugccggcgagaugaacgaaacguauaauagcaagaacgauuucuacucucacgaccugaaucuuuucuauaccaucuuugagaacgcauucccuggaacuacagaauccuuguuuuaccagcugauucagaaaaagaauaccacaggcgccaguaaaguccucgggaagcugaucacuaaguacggaaacaacaauauguucguggguguauggaaauuuggccaauauuuacugacccuuccauacauaaacaauacggaguugagccagaaccgucgccucaccauucuggcuacacaggaacuacugucuagaucccauucagggaggcaggagaguaugagcaaugcgauccaaggaucgaucacuaaggagugccacaacgcaaaaggcguugguuguauuuccccgcgguucgggauccccauuggcaaucucaccgccugcggagacucuccuaacuauaagauauacaaaacaccagaaaagcuguauaagagcaauaacaaaggcgaggugugguguucaaaugauguccauugccuuaacgacuuugaacccgcugaugaggagguggucaauaagaucaaaaaguugacuugcuuccugaccgacgugaguguugaaguggauauuuuuaguguagccgcaucuacguguaaaauggccgacaagggggucugcacagugaacggagcuaaguggaauaucauuaaaugugauagcgguuuauacuauuucaccgaccaccgagagggccaggauacugggaacgacuuuggagaauacugcaucucccacucauguaacacagagcgcuucccuauaaauccagauauccucaaggacugcaccugggaauuucauagcagaaaaaguaaguacauuucuacuaucucccuggagagccuugaggaguucaggcgggccauggcagaaaaacugucgcacaccuugacaauuuauaacuucaagcccacggcgaaucucccgcauauccgcccuaccuacaaguuuauaacugcuaacggcguugaaaauucagaugguauugagucugccuauauccugaguuccauccccgcacuagggggcauuagcgugggauacaacguccagacaaaagacaauuucccacugcucgacauaaucguguuuauuaagucugccguaaucagaaccacauauaaccacauuuacgauacuggcccuaccaucgggauaaauacgcagcaugacgaacacuguacaggacccugcccagcugugguuccccacaaagagaacuggaugaccuucagccaagagaggacuucccguuggggcugugaagaguuugguugccuggccaucaauaccgggugugucuucggaucaugccaggauauuauccauccugaaacaaagguguaucggaaagcaguggaggaagaggucguucuuacugugugcauuaacuuuccaggcaauaacuacuguaccgagaucaaugcuauagaaccgaagauuacagacgagaucgaauugcaguucaaaacgguggauaccaagacucugcccaacuuacucgccguacagaaccacaagcuguacaguggucaaaucaaugaccuuggcagcuuuucucaggggugcggaaacguccagaaaacaaaucauuccauucugggcauggggaccgugaaguucgauuauguuugucacggagcgucacgaaaagacgugaucgucagaaggugcuacaacaauaacuuugauaguuguaagcuacucaaagaggagacuagccugauauucgccgacaaucaugaaacauuggagguggcucacaccaagcaccugauuggcgaauuacaauucaagaucaugcucggugauauucgcuauaaauccuuugcagagucuccugaacuggagaucgacgccaagugcguuggguguccaucgugcuucgagagcuacucauguaacuuucagauagugacgaauauugauacuguaugcuccgucgaaggacccuguacccuuuuccauaaccggaucaucauuagugcuaauaaacagucuuauggccugaagaugagcugccagacaaaaccuaaccaaaaugaggaauuuaucauuugcaacagaaaguacuccguguuguucaccacuauagacaagaaugacaaaaucgaggugaacacaggugaucagaccucauauauuuacgaaaaggacucuagguguaaaacauggcucugccgcguccgagaugagggcaucagcguucuguuugagccacuaaaggccuucuuugggaguuacuucuccaucauuuucuaugugguagugggaauaaucguccuguuccuuauuaucuacauuuuucuccccauguucuucaaacugaaggacguguugaagcggaaugaauaucuguacuuacaggagcucaaacacaaguga

SEQ ID NO: 10900 - RNA, 4305 nt, Artificial Sequence
  derived and/or modified CDS sequence (opt3) from CVV(856 clone 1)__EU583732.1__GP
augcuguuccuccuuauccuggccuuuuugggcuucagcaccuccaaccccauugcuacaagaugcuuucacgggggacaguuaauagcagagucuaagucagccacgaguaucagcgaguucugucugaaagacgauguguccaugcuaaagucugaagucguuuacauuaaaaaugacacuggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauugccagcaugugucagaauaucgaauuaauuaucauccugggccuuaccuuggcuauuuucauacugauggugauccuaacaaaaaccuacauuugcuaucuccugaugcccaucuucaugccuauagcauaccuuuauggcugggccuacaacaagucuuguaaaaagugcaauugcugugggcuggcuuaucauccauuuacgaacugcggaucccacuguguaugcgguuugaaauucgaggccucagaucguaugaggauucauagagaaagcggccucugucaaggguacaagagucugcggaucgcgcgcuuacugugcaagucuaaaggauccagccucguuaucucgggccuucugucuauguugauucuauccuuugugacucccaucgaggguacaauuaccucauacccugagaguagaaaguauacucuggaagagauaacagacgucguggaagggcucgugagcgagcagaauaucaaagaauacauugucuucuauaccucccuguuuggaucucuuauccuguugcucgcauucaucaugagcauuacgcugucaaagauaaccaguaucuuagccaaaaggaacguuauuuacugugaggagugcuccauguaucacagcaagcggggcaucaaguacaauggcgauuuuacaaacaaauguggguucugcacuuguaacgaacaggaggacaccgaaggacuggugauucacaagguaucuaaacgcugcacauauaaguaccagcuaaaaugggcuaaggugcucaugaucacucugguccuuuugcugauagcccaaaauaccauccucauuguggcagcugagacagauugcuggaucaagaaaucacuggacauugacuguaucgguccaaugcuugauauaggcaguugcaccaacaagaauacucgaagcuacgacgccgaagcgcagaaacugguuucccagucuaagauuucgcaguuggaugccgaccaagugagccuccuggggaacuccaucgauucagcaauuaaagcuaucagagcccagaagacguaucccacaaugcauuuacuggagaccauauuucuaaugaagaauugugacuacuauaccaguuucaaccacaauucuggauacagccaggcuaaauggaggcucaucgccaagacuggccauuuugauauuugcucccggcacucaacacaucacuucugucguugcaucaacgacgguaccaaaugucaaaauggggauugggacuuugcaggcgagaugaacgaaacuuauaauagcaagaacgauuucuacucucacgaccugaaucuuuucuauacaauuuuugagaacgccuucccuggaacgaccgaauccuuguuuuaccagcugauccagcgcaaaaauacuacaggcgcuaguaagguccucgggaaacugauaaccaaguacggaaacaacaauauguucguggguguauggaaguuuggccaguauuuacugacacuuccauacauuaacaauacugaguugagccaaaacagaaggcucaccauccugacgacccaggaacuacugucucggucccauucagggcgacaggagaguaugagcaaugcgauccagggaucgauuacaaaagagugccacaacgcaaagggcguugguuguaucuccccgcgcuucgggauucccauaggcaaucucacugccugcggagacucuccuaacuauaaaaucuacaagaccccagaaaaacuguauaagagcaauaacaagggcgaggugugguguucaaaugauguccauugccuuaacgacuuugaacccgcugaugaggagguggucaauaaaauuaagaaauugacaugcuuccugacugacgugaguguugaaguggauaucuuuuccguagccgcaucuaccuguaagauggccgacaaaggggucugcacggugaacggagcuaaguggaauauuaucaagugugauagcgguuuauacuauuucacagaccacagagagggccaagauaccgggaacgacuuuggagaauacugcauaucccacucauguaacacugagagguucccuaucaauccagauauucucaaagacugcacaugggaauuucauagccggaagaguaaauacaucucuaccauuucccuggagagccuugaggaguuccgcagagccauggcagaaaagcugucgcacacuuugaccaucuauaacuucaaacccacagcgaaucucccgcauauaaggccuacguacaaguuuauuaccgcuaacggcguugaaaauucagaugguaucgagucugccuauauccugaguuccauucccgcacuagggggcauaagcgugggauacaacguccagacuaaggacaauuucccacugcucgacaucauuguguuuaucaaaucugccguaauucguacaaccuauaaccacaucuacgauacaggcccuacuauagggaucaauacccagcaugacgaacacuguacgggacccugcccagcugugguuccccacaaggagaacuggaugacauucagccaggagcggaccucccgauggggcugugaagaguuugguugccuggccauuaauacugggugugucuucggaucaugccaagauaucauucauccugaaaccaaaguguauagaaaggcaguggaggaagaggucguucuuacagugugcaucaacuuuccaggcaauaacuacuguacugagauaaaugcuauugaaccgaaaaucaccgacgagaucgaauugcaguucaagacaguggauacgaaaacccugcccaacuuacucgccguacagaaccacaagcuguacaguggucagauuaaugaccuuggcagcuuuucucaagggugcggaaacguccagaagacuaaucauuccauccugggcauggggacagugaaauucgauuauguuugucacggagcgucaaggaaggacgugauaguccgccggugcuacaacaauaacuuugauaguuguaaacuacucaaggaggagaccagccugauuuucgccgacaaucaugaaacuuuggagguggcucacacaaaacaccugaucggcgaauuacaguucaagauuaugcucggugauaucagauauaaguccuuugcagagucuccugaacuggagauagacgccaaaugcguuggguguccaucgugcuucgagagcuacucauguaacuuucaaauugugaccaauaucgauacgguaugcuccgucgaaggacccuguacucuuuuccauaacaggaucauuaucagugcuaauaagcagucuuauggccugaaaaugagcugccagaccaagccuaaccagaaugaggaauuuauuauaugcaaccgcaaauacuccguguuguucacaaccaucgacaagaaugacaagauugaggugaacacuggugaucaaacaucauauaucuacgaaaaagacucucgauguaagaccuggcucugccggguccgugaugagggcaucagcguucuguuugagccacuaaaagccuucuuugggaguuacuucuccauuauauuuuaugugguaaucggaauuaucgugcuguuccuuauuaucuacauauuucuccccauguucuucaagcugaaagacgucuugaagagaaaugaauaucuguacuuacaggagcucaagcacaaauga

SEQ ID NO: 10901 - RNA, 4305 nt, Artificial Sequence
  derived and/or modified CDS sequence (opt3) from CVV(856 clone 3)__EU583731.1__GP
augcuguuccuccuuauccuggccuuuuugggcuucagcaccuccaaccccauugcuacaagaugcuuucacgggggacaguuaauagcagagucuaagucagccacgaguaucagcgaguucugucugaaagacgauguguccaugcuaaagucugaagucguuuacauuaaaaaugacacuggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauugccagcaugugucagaauaucgaauuaauuaucauccugggccuuaccuuggcuauuuucauacugauggugauccuaacaaaaaccuacauuugcuaucuccugaugcccaucuucaugccuauagcauaccuuuauggcugggccuacaacaagucuuguaaaaagugcaauugcugugggcuggcuuaucauccauuuacgaacugcggaucccacuguguaugcgguuugaaauucgaggccucagaucguaugaggauucauagagaaagcggccucugucaaggguacaagagucugcggaucgcgcgcuuacugugcaagucuaaaggauccagccucguuaucucgggccuucugucuauguugauucuauccuuugugacucccaucgaggguacaauuaccucauacccugagaguagaaaguauacucuggaagagauaacagacgucguggaagggcucgugagcgagcagaauaucaaagaauacauugucuucuauaccucccuguuuggaucucuuauccuguugcucgcauucaucaugagcauuacgcugucaaagauaaccaguaucuuagccaaaaggaacguuauuuacugugaggagugcuccauguaucacagcaagcggggcaucaaguacaauggcgauuuuacaaacaaauguggguucugcacuuguaacgaacaggaggacaccgaaggacuggugauucacaagguaucuaaacgcugcacauauaaguaccagcuaaaaugggcuaaggugcucaugaucacucugguccuuuugcugauagcccaaaauaccauccucauuguggcagcugagacagauugcuggaucaagaaaucacuggacauugacuguaucgguccaaugcuugauauaggcaguugcaccaacaagaauacucgaagcuacgacgccgaagcgcagaaacugguuucccagucuaagauuucgcaguuggaugccgaccaagugagccuccuggggaacuccaucgauucagcaauuaaagcuaucagagcccagaagacguaucccacaaugcauuuacuggagaccauauuucuaaugaagaauugugacuacuauaccaguuucaaccacaauucuggauacagccaggcuaaauggaggcucaucgccaagacuggccauuuugauauuugcucccggcacucaacacaucacuucugucguugcaucaacgacgguaccaaaugucaaaauggggauugggacuuugcaggcgagaugaacgaaacuuauaauagcaagaacgauuucuacucucacgaccugaaucuuuucuauacaauuuuugagaacgccuucccuggaacgaccgaauccuuguuuuaccagcugauccagcgcaaaaauacuacaggcgcuaguaagguccucgggaaacugauaaccaaguacggaaacaacaauauguucguggguguauggaaguuuggccaguauuuacugacacuuccauacauuaacaauacugaguugagccaaaacagaaggcucaccauccugacgacccaugaacuacugucucggucccacucagggcgacaggagaguaugagcaaugcgauccagggaucgauuacaaaagagugccauaacgcaaagggcguugguuguaucuccccgcgcuucgggauucccauaggcaaucucacugccugcggagacucuccuaacuauaaaaucuacaagaccccagaaaaacuguauaagagcaauaacaagggcgaggugugguguucaaaugauguccacugccuuaacgacuuugaacccgcugaugaggagguggucaauaaaauuaagaaauugacaugcuuccugacugacgugaguguugaaguggauaucuuuuccguagccgcaucuaccuguaagauggccgacaaaggggucugcacggugaacggagcuaaguggaauauuaucaagugugauagcgguuuauacuauuucacagaccacagagagggccaggauaccgggaacgacuuuggagaauacugcauaucccauucauguaacacugagagguucccuaucaauccagauauucucaaagacugcacaugggaauuucacagccggaagaguaaauacaucucuaccauuucccuggagagccuugaggaguuccgcagagccauggcagaaaagcugucgcauacuuugaccaucuauaacuucaaacccacagcgaaucucccgcacauaaggccuacguacaaguuuauuaccgcuaacggcguugaaaauucagaugguaucgagucugccuauauccugaguuccauucccgcacuagggggcauaagcgugggauacaacguccaaacuaaggacaauuucccacugcucgacaucauuguguuuaucaaaucugccguaauucguacaaccuauaaccauaucuacgauacaggcccuacuauagggaucaauacccagcacgacgaacacuguacgggacccugcccagcugugguuccccauaaggagaacuggaugacauucagccaggagcggaccucccgauggggcugugaagaguuugguugccuggccauuaauacugggugugucuucggaucaugccaggauaucauucacccugaaaccaaaguguauagaaaggcaguggaggaagaggucguucuuacagugugcaucaacuuuccaggcaauaacuacuguacugagauaaaugcuauugaaccgaaaaucaccgacgagaucgaauugcaauucaagacaguggauacgaaaacccugcccaacuuacucgccguacagaaccauaagcuguacaguggucagauuaaugaccuuggcagcuuuucucaggggugcggaaacguccaaaagacuaaucacuccauccugggcauggggacagugaaauucgauuauguuugucauggagcgucaaggaaggacgugauaguccgccggugcuacaacaauaacuuugauaguuguaaacuacucaaggaggagaccagccugauuuucgccgacaaucacgaaacuuuggagguggcucacacaaaacaucugaucggcgaauuacaguucaagauuaugcucggugauaucagauauaaguccuuugcagagucuccugaacuggagauagacgccaaaugcguuggguguccaucgugcuucgagagcuacucauguaacuuucagauugugaccaauaucgauacgguaugcuccgucgaaggacccuguacucuuuuccacaacaggaucauuaucagugcuaauaagcaaucuuauggccugaaaaugagcugccagaccaagccuaaccagaaugaggaauuuauuauaugcaaccgcaaauacuccguguuguucacaaccaucgacaagaaugacaagauugaggugaacacuggugaucagacaucauauaucuacgaaaaagacucucgauguaagaccuggcucugccggguccgugaugagggcaucagcguucuguuugagccacuaaaagccuucuuugggaguuacuucuccauuauauuuuaugugguaaucggaauuaucgugcuguuccuuauuaucuacauauuucuccccauguucuucaagcugaaagacgucuugaagagaaaugaauaucuguacuuacaagagcucaagcauaaauga

SEQ ID NO: 10902 - RNA, 4305 nt, Artificial Sequence
  derived and/or modified CDS sequence (opt3) from CVV(CK102)__AF186242.1__GP
augcuguuccuccuuauccuggccuuuuugggcuucagcaccuccaaccccauugcuacaagaugcuuucacgggggacaguuaauagcagagucuaagucagccacaaguaucagcgaguucugucugaaagacgauguguccaugcuaaagucugaagucguuuacauuaaaaaugacacgggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauuaccagcaugugucagaauaucgaauuaauuaucauccugggccuuacauuggccauuuucauacugauggugauccuaaccaaaacguacauuugcuaucuccugaugcccaucuucaugccuauagcuuaccuuuauggcugggcauacaacaagucuuguaaaaagugcaauugcugugggcuggccuaucauccauuuacuaacugcggaucccacuguguaugcgguuugaaauucgaggcuucagaucguaugaggauucauagagaaagcggccucugucaaggguacaagagucugcggaucgcccgcuuacugugcaagucuaaaggauccagccucguugugucgggccuucugucuauguugauccuauccuuugucacacccauugaggguaccaucacuucauacccugagaguagaaaguauacacuggaagagauuaccgacgugguggaagggcucgucagcgagcagaauauaaaagaauacaucguuuucuauacgucccuguuuggaucucuuauucuguugcucgcguucaucaugagcaucacccugucaaagauuacaaguauauuagcaaaaaggaacgugaucuacugugaggagugcuccauguaucacagcaagcggggcauuaaguacaauggcgauuuuacuaacaaauguggguucugcaccuguaacgaacaggaggacacagaaggacugguaauccacaaggugucuaaacgcugcacuuauaaguaccagcuaaaaugggccaagguccucaugauuacccuggugcuuuugcugaucgcucaaaauacaauacucaucguugccgcagagaccgauugcuggacuaagaaaucacuggacauugacuguaucgguccaaugcuugauauuggcaguugcacgaacaagaauacacgaagcuacgacaccgaagcucagaaacuggugucccagucuaagaucucgcaguuggaugccgaccaagucagccuccuggggaacuccauagauucagcgauuaaagccaucagagcacagaagacuuaucccaccaugcauuuacuggagacaauuuuucuaaugaagaauugugacuacuauaccaguuucaaccacaauucuggauacagccaggcuaaauggaggcucaucgccaagacuggccauuuugauauaugcucccggcacucaacacaucacuucugucguugcaucaacgacgguacgaaaugucaaaauggggauugggacuuugcuggcgagaugaacgaaaccuauaauagcaagaacgauuucuacucucacgaccugaaucuuuucuauacuauuuuugagaacgccuucccuggaacaaccgaauccuuguuuuaccagcugauccagaaaaagaauacaacuggcgcaaguaaagugcucgggaagcugauuaccaaguacggaaacaacaauauguucguagguguuuggaaauuuggccaguauuuacugacgcuuccauacaucaacaauaccgaguugagccaaaaccgcagacucacaauacuggccacucaggaacuacugucuaggucccauucagggcggcaggagaguaugagcaaugcuauucagggaucgaucaccaaggagugccacaacgcgaaaggcguggguuguaucuccccgcgauucgggauucccaucggcaaucucacagcaugcggagacucuccuaacuauaagauuuacaaaacuccagaaaagcuguauaagagcaauaacaaaggcgaggucugguguucaaaugaugugcauugccuuaacgacuuugaacccgccgaugaggaggucgugaauaagauaaagaaguugaccugcuuccugacggacguuaguguggaaguagauaucuuuuccgucgcugccucuacauguaaaauggcagacaagggggugugcaccguuaacggagccaaguggaauauuaucaaaugugauagcgguuuauacuauuucacugaccaccgcgagggccaagauacagggaacgacuuuggagaauacugcauuucccacucauguaacaccgagagauucccuaucaauccagauauacucaaggacugcacuugggaauuucauagcaggaaaaguaaguacaucucuaccauuucccuggagagccuugaggaguuccggcgcgcuauggccgaaaaacugucgcacacauugacgaucuauaacuucaagcccaccgcaaaucucccgcauauuagaccuacuuacaaguuuaucacagcgaacggcguggaaaauucagaugguauagagucugcuuauauucugaguuccauccccgcccuagggggcaucagcgucggauacaacgugcagaccaaagacaaucugccacuccuggacauuauaguauucaucaagucugcagugauuaggacaacuuauaaccacaucuacgauaccggcccuacgauugggaucaauacacagcaugacgaacacuguaccggacccugcccagccguugucccccacaaagagaacuggaugacuuuuagccaggagcguaccucccgguggggcugugaagaguucgguugccuugcuauaaauacaggguguguguuuggaucaugccaagauaucauucauccugaaacuaagguguaucgaaaagccgucgaggaagagguuguguugaccgugugcaucaacuucccaggcaauaacuacuguacagagauuaaugcaaucgaaccgaagauaacggacgagauugaacugcaguuuaaaaccguagauacuaagacauuacccaaccuccuggcuguccagaaccacaaacuuuacaguggucagaucaaugaccugggcagcuucucucaagggugcggaaacgugcagaaaaccaaucauuccauccuaggcauggggacuguuaaguuugauuaugugugucacggagccucaagaaaagacgucauugugaggcgcugcuacaacaauaacuucgauaguuguaagcuccugaaagaggagacuagcuugaucuuugcggacaaucaugaaacccuggagguugcccacacgaagcacuuaauaggcgaacuccaguucaagauuaugcugggugauauccgguauaaauccuucgcugagucuccugaacuugagauugacgcaaagugcgugggguguccaucgugcuuugagagcuacucauguaacuuccaaaucguaacuaauauagauaccgucugcuccguggaaggacccuguacacuguuucauaacagaauuaucaucagugccaauaaacagucuuauggcuugaagaugagcugccagaccaaaccuaaccagaaugaggaguucauuaucugcaacaggaaguacuccgugcucuuuacuacaauugacaagaaugacaaaauagaagucaacaccggugaucaaacaucauauaucuacgaaaaggacucucgcuguaaaacuuggcugugccgaguucgggaugagggcauuagcgugcuauucgagccacugaaggcuuuuaguggguccuacuucagcaucaucuuuuauguaguggucggaauuauagugcuuuuccucaucauuuacaucuuucugcccauguucuuuaaauugaaggacguucugaagcguaaugaauauuuauaccuccaggagcugaaacacaaguga

SEQ ID NO: 10903 - RNA, 4305 nt, Artificial Sequence
  derived and/or modified CDS sequence (opt3) from CVV(CK-102)__KX100146.1__GP
augcuguuccuccuuauccuggccuuuuugggcuucagcaccuccaaccccauugcuacaagaugcuuucacgggggacaguuaauagcagagucuaagucagccacaaguaucagcgaguucugucugaaagacgauguguccaugcuaaagucugaggucguuuacauuaaaaaugacacgggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcucaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauuaccagcaugugucagaauaucgaauuaauuaucauccugggccuuacauuggccauuuucauacugauggugauccuaaccaaaacguacauuugcuaucuccugaugcccaucuucaugccuauagcuuaccuuuauggcugggcauacaacaagucuuguaaaaagugcaauugcugugggcuggccuaucauccauuuacuaacugcggaucccacuguguaugcgguuugaaauucgaggcuucagaucguaugaggauucauagagaaagcggccucugucaaggguacaagagucugcggaucgcccgcuuacugugcaagucuaaaggauccagccucguugugucgggccuucugucuauguugauccuauccuuugucacacccauugaggguaccaucacuucauacccugagaguagaaaguauacacuggaagagauuaccgacgugguggaagggcucgucagcgagcagaauauaaaagaauacaucguuuucuauacgucccuguuuggaucucuuauucuguugcucgcguucaucaugagcaucacccugucaaagauuacaaguauauuagcaaaaaggaacgugaucuacugugaggagugcuccauguaucacagcaagcggggcauuaaguacaauggcgauuuuacuaacaaauguggguucugcaccuguaacgaacaggaggacacagaaggacugguaauccacaaggugucuaaacgcugcacuuauaaguaccagcuaaaaugggccaagguccucaugauuacccuggugcuuuugcugaucgcucaaaauacaauacucaucguugccgcagagaccgauugcuggacuaagaaaucacuggacauugacuguaucgguccaaugcuugauauuggcaguugcacgaacaagaauacacgaagcuacgacaccgaagcucagaaacuggugucccagucuaagaucucgcaguuggaugccgaccaagucagccuccuggggaacuccauagauucagcgauuaaagccaucagagcacagaagacuuaucccaccaugcauuuacuggagacaauuuuucuaaugaagaauugugacuacuauaccaguuucaaccacaauucuggauacagccaggcuaaauggaggcucaucgccaagacuggccauuuugauauaugcucccggcacucaacacaucacuucugucguugcaucaacgacgguacgaaaugucaaaauggggauugggacuuugcuggcgagaugaacgaaaccuauaauagcaagaacgauuucuacucucacgaccugaaucuuuucuauacuauuuuugagaacgccuucccuggaacaaccgaauccuuguuuuaccagcugauccagaaaaagaauacaacuggcgcaaguaaagugcucgggaagcugauuaccaaguacggaaacaacaauauguucguagguguuuggaaauuuggccaguauuuacugacgcuuccauacaucaacaauaccgaguugagccaaaaccgcagacucacaauacuggccacucaggaacuacugucuaggucccauucagggcggcaggagaguaugagcaaugcuauucagggaucgaucaccaaggagugccacaacgcgaaaggcguggaauguaucuccccgcgauucgguauucccaucgggaaucucacagcaugcggcgacucuccuaacuauaagauuuacaaaacuccagagaagcuguauaagagcaauaacaaaggagaagucugguguucaaaugaugugcauugccuuaacgacuuugagcccgccgaugaggaagucgugaauaagauaaagaaguugaccugcuuccugacggacguuaguguggagguagauaucuuuuccgucgcugccucuacauguaaaauggcagacaagggcgugugcaccguuaacggggccaaguggaauauuaucaaaugugauagcggauuauacuauuucacugaccaccgcgaaggucaagauacaggcaacgacuuuggggaguacugcauuucccacucauguaacaccgaaagauucccuaucaauccagauauacucaaggacugcacuugggaguuucauagcaggaaaaguaaguacaucucuaccauuucccuggagagccuugaagaguuccggcgcgcuauggccgaaaaacugucgcacacauugacgaucuauaacuucaagcccaccgcaaaucucccgcauauuagaccuacuuacaaguuuaucacagcgaacggaguggaaaauucagauggcauagaaucugcuuauauucugaguuccauccccgcccuaggugggaucagcgucggcuacaacgugcagaccaaagacaaucugccacuccuggacauuauaguauucaucaagucugcagugauuaggacaacuuauaaccacaucuacgauaccggaccuacgauuggcaucaauacacagcaugacgagcacuguaccgggcccugcccagccguugucccccacaaagagaacuggaugacuuuuagccaggaacguaccucccgguggggaugugaggaguucggcugccuugcuauaaauacagguuguguguuugggucaugccaagauaucauucauccugaaacuaagguguaucgaaaagccgucgaagaggagguuguguugaccgugugcaucaacuucccaggaaauaacuacuguacagaaauuaaugcaaucgagccgaagauaacggacgaaauugagcugcaguuuaaaaccguagauacuaagacauuacccaaccuccuggcuguccagaaccacaaacuuuacaguggccagaucaaugaccuggguagcuucucucaaggcugcgggaacgugcagaaaaccaaucauuccauccuaggaaugggcacuguuaaguuugauuaugugugucacggggccucaagaaaagacgucauugugaggcgcugcuacaacaauaacuucgauaguuguaagcuccugaaagaggaaacuagcuugaucuuugcggacaaucaugagacccuggaaguugcccacacgaagcacuuaauaggagagcuccaguucaagauuaugcugggcgauauccgguauaaauccuucgcugaaucuccugagcuugagauugacgcaaagugcguggguuguccaucgugcuuugaaagcuacucauguaacuuccaaaucguaacuaauauagauaccgucugcuccguggaggggcccuguacacuguuucauaacagaauuaucaucagugccaauaaacagucuuauggauugaagaugagcugccagaccaaaccuaaccagaaugaagaguucauuaucugcaacaggaaguacuccgugcucuuuacuacaauugacaagaaugacaaaauagaagucaacaccggcgaucaaacaucauauaucuacgagaaggacucucgcuguaaaacuuggcugugccgaguucgggaugaggguauuagcgugcuauucgaaccacugaaggcguuuuucggcaguuacuuuuccaucaucuucuauguaguggucgggauuauagugcuuuuucucaucauuuacaucuuccugcccauguuuuucaaauugaaggacguucugaagcguaaugaguauuuauaccuccaggaacugaaacacaaguga

SEQ ID NO: 10904 - RNA, 4305 nt, Artificial Sequence
  derived and/or modified CDS sequence (opt3) from CVV(MI80-1-450)__AF186241.1__GP
augcuguuccuccuuauccuggccuuuuugggcuucagcaccuccaaccccauugcuacaagaugcuuucacgggggacauuuaauagcagagucuaagucagccacuuccaucagcgaauuuugucugaaagacgauguguccaugcuaaagucugaggucguuuacauuaaaaaugacacgggucucuuuggccacaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcagauuaucuuucaaacagauaaauugaaccauuucgaggucaguggcaccacgcucuccucugguugguuuaagagcaaagccuccgugacucuggaccgcaccugugagcacguuaaggugacaugcgggaagaaaucacugcaguuccaugcauguuuuaagcaccacaugaguugcguccgauucuuucauaauacuauacucccgggaaacaugauuaccagcaugugucagaauaucgaauuaauuaucauccugggccuuacauuggccauuuucauacugauggugauccuaaccaaaacguacauuugcuaucuccugaugcccaucuucaugccuauagcuuaccuuuauggcugggcauacaacaagucuuguaaaaagugcaauugcugugggcuggccuaucacccauuuacuaacugcggaucccauuguguaugcgguuugaaauucgaggcuucagaucguaugaggauucacagagaaagcggccucugucagggguacaagagucugcggaucgcccgcuuacugugcaagucuaaaggauccagccucguuaucucgggccuucugucuauguugauucuauccuuugugacacccaucgaggguaccauuacuucauacccugagaguagaaaguauacacuggaagagauaaccgacgucguggaagggcucgugagcgagcaaaauaucaaagaauacauugucuucuauacgucccuguuuggaucucuuauccuguugcucgcguucaucaugagcauuacccugucaaagauaacaaguaucuuagcaaaaaggaacguuauuuacugugaggagugcuccauguaucacagcaagcggggcaucaaguacaauggcgauuuuacuaacaaauguggguucugcaccuguaacgaacaggaggacacagaaggacuggugauucauaagguaucuaaacgcugcacuuauaaguaccagcuaaaaugggccaaggugcucaugaucacccugguccuuuugcugauagcucagaauacaauccucauuguggccgcagagaccgauugcuggacuaagaaaucacuggacaucgacuguauugguccaaugcuugauaucggcaguugcacgaacaagaauacacgaagcuacgacgcugaagcccaaaaacugguuucccagucuaagauaucgcaguuggaugcggaccaggugagccuccuggggaacuccauugauucagccaucaaagcaauuagagcucaaaagaccuaucccacuaugcacuuacuggagaccaucuuucuaaugaagaauugugacuacuauacaaguuucaaccauaauucuggauacagccaggccaaauggaggcucauagcuaagaccggccacuuugauaucugcucccggcauucaacucaccacuucugucguugcauuaacgacgguacaaaaugucagaaugggaacugggauuuugccggcgagaugaaugaaacguauaacagcaagaaugacuucuacucucaugaucugaaccuuuucuauaccaucuuugagaaugcauucccuggaacuacagaauccuuguuuuaccaacugauucagaaaaagaacaccacaggcgccagucagguccucgggaaacugaucacuaaguacggaaacaauaacauguucguggguguauggaaguuuggccaguauuuacugacccuuccauacauaaauaacacggaguugagccaaaaucgcagacucaccauucuggcuacacaggaacuacugucuaggucccacucagggcggcaggagaguaugagcaacgcgauccagggaucgaucacuaaagagugccauaaugcaaagggcguugguuguauuuccccgcgauucgggauccccauuggcaaccucaccgccugcggagacucuccuaauuauaaaauauacaagacaccagaaaaacuguauaagagcaacaauaagggcgaggugugguguucaaacgacguccacugccuuaaugauuuugaacccgcugacgaggagguggucaacaaaaucaagaaauugacuugcuuccugaccgaugugaguguugaaguggacauuuuuaguguagccgcaucuacguguaagauggccgauaaaggggucugcacagugaauggagcuaaguggaacaucauuaagugugacagcgguuuauacuauuucaccgaucaccgcgagggccaagacacugggaacgauuuuggagaauacugcaucucccauucauguaauacagagagauucccuauaaacccagacauccucaaagauugcaccugggaauuucacagcaggaagaguaaauacauuucuacuaucucccuggagagccuugaggaguuccggcgcgccauggcagaaaagcugucgcauaccuugacaauuuauaauuucaaacccacggcgaaccucccgcacaucagaccuaccuacaaguuuauaacugcuaauggcguugaaaacucagacgguauugagucugccuauauccugaguuccauccccgcacuagggggcauuagcgugggauacaauguccagacaaaggauaacuucccacugcucgacauaaucguguuuauuaaaucugccguaaucaggaccacauauaaucauauuuacgacacuggcccuaccaucgggauaaacacgcagcacgaugaacacuguacaggacccugcccagcugugguuccccauaaggagaauuggaugaccuucagccaggagcguacuucccgguggggcugugaagaguuugguugccuggccaucaacaccgggugugucuucggaucaugccaagacauuauccacccugaaacaaaaguguaucgaaaggcaguggaggaagaggucguucuuacugugugcauuaauuuuccaggcaacaauuacuguaccgagaucaacgcuauagaaccgaaaauuacagaugagaucgaauugcaguucaagacgguggacaccaaaacucugcccaacuuacucgccguacagaaucauaagcuguacaguggucagaucaacgaucuuggcagcuuuucucaagggugcggaaauguccagaagacaaaccacuccauucugggcauggggaccgugaaauucgacuauguuugucauggagcgucaagaaaggaugugaucgucaggcgcugcuacaauaacaauuuugacaguuguaaacuacucaaggaggagacuagccugauauucgccgauaaccacgaaacauuggagguggcucacaccaaacaucugauuggcgaauuacaguucaagaucaugcucggugacauucgguauaaguccuuugcagagucuccugaacuggagaucgaugccaaaugcguuggguguccaucgugcuucgagagcuacucauguaauuuucaaauagugacgaacauugacacuguaugcuccgucgaaggacccuguacccuuuuccacaauagaaucaucauuagugcuaacaagcagucuuauggccugaaaaugagcugccagacaaagccuaaucagaacgaggaauuuaucauuugcaauaggaaauacuccguguuguucaccacuauagauaagaacgacaagaucgaggugaauacaggugaccaaaccucauauauuuacgaaaaagauucucgcuguaagacauggcucugccgaguccgggacgagggcaucagcguucuguuugagccacuaaaagccuucuuugggaguuacuucuccaucauuuucuaugugguagugggaauaaucguccuguuccuuauuaucuacauuuuucuccccauguucuucaagcugaaagauguguugaagcguaacgaauaucuguacuuacaggagcucaagcauaaauga

SEQ ID NO: 10905 - RNA, 4305 nt, Artificial Sequence
  derived and/or modified CDS sequence (opt3) from CVV(MI80-1-450)__KX100149.1__GP
augcuguuccuccuuauccuggccuuuuugggcuucagcaccuccaaccccauugcuacaagaugcuuucacgggggacaguuaauagcagagucuaagucagccacuuccaucagcgaauuuugucugaaagacgauguguccaugcuaaagucugaggucguuuacauuaaaaaugacacgggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauuaccagcaugugucagaauaucgaauuaauuaucauccugggccuuacauuggccauuuucauacugauggugauccuaaccaaaacguacauuugcuaucuccugaugcccaucuucaugccuauagcuuaccuuuauggcugggcauacaacaagucuuguaaaaagugcaauugcugugggcuggccuaucauccauuuacuaacugcggaucccacuguguaugcgguuugaaauucgaggcuucagaucguaugaggauucauagagaaagcggccucugucaaggguacaagagucugcggaucgcccgcuuacugugcaagucuaaaggauccagccucguuaucucgggccuucugucuauguugauucuauccuuugugacacccaucgaggguaccauuacuucauacccugagaguagaaaguauacacuggaagagauaaccgacgucguggaagggcucgugagcgagcagaauaucaaagaauacauugucuucuauacgucccuguuuggaucucuuauccuguugcucgcguucaucaugagcauuacccugucaaagauaacaaguaucuuagcaaaaaggaacguuauuuacugugaggagugcuccauguaucacagcaagcggggcaucaaguacaauggcgauuuuacuaacaaauguggguucugcaccuguaacgaacaggaggacacagaaggacuggugauucacaagguaucuaaacgcugcacuuauaaguaccagcuaaaaugggccaaggugcucaugaucacccugguccuuuugcugauagcucaaaauacaauccucauuguggccgcagagaccgauugcuggacuaagaaaucacuggacaucgacuguauugguccaaugcuugauaucggcaguugcacgaacaagaauacacgaagcuacgacgcugaagcccagaaacugguuucccagucuaagauaucgcaguuggaugcggaccaagugagccuccuggggaacuccauugauucagccaucaaagcaauuagagcucagaagaccuaucccacuaugcauuuacuggagaccaucuuucuaaugaagaauugugacuacuauacaaguuucaaccacaauucuggauacagccaggccaaauggaggcucauagcuaagaccggccauuuugauaucugcucccggcacucaacucaucacuucugucguugcauuaacgacgguacaaaaugucaaaaugggaacugggauuuugccggcgagaugaaugaaacguauaacagcaagaaugacuucuacucucacgaucugaaccuuuucuauaccaucuuugagaaugcauucccuggaacuacagaauccuuguuuuaccagcugauucagaaaaagaacaccacaggcgccagucagguccucgggaaacugaucacuaaguacggaaacaauaacauguucguggguguauggaaguuuggccaauauuuacugacccuuccauacauaaauaacacggaguugagccagaaucgcagacucaccauucuggcuacacaggaacuacugucuaggucccauucagggcggcaggagaguaugagcaacgcgauccaaggaucgaucacuaaagagugccacaaugcaaagggcguugguuguauuuccccgcgauucgggauccccauuggcaaccucaccgccugcggagacucuccuaauuauaaaauauacaagacaccagaaaaacuguauaagagcaacaauaagggcgaggugugguguucaaacgacguccauugccuuaaugauuuugaacccgcugacgaggagguggucaacaaaaucaagaaauugacuugcuuccugaccgaugugaguguugaaguggacauuuuuaguguagccgcaucuacguguaagauggccgauaaaggggucugcacagugaauggagcuaaguggaacaucauuaagugugacagcgguuuauacuauuucaccgaucaccgcgagggccaggacacugggaacgauuuuggagaauacugcaucucccacucauguaauacagagagauucccuauaaacccagacauccucaaagauugcaccugggaauuucauagcaggaagaguaaauacauuucuacuaucucccuggagagccuugaggaguuccggcgcgccauggcagaaaagcugucgcacaccuugacaauuuauaauuucaaacccacggcgaaccucccgcauaucagaccuaccuacaaguuuauaacugcuaauggcguugaaaacucagacgguauugagucugccuauauccugaguuccauccccgcacuagggggcauuagcgugggauacaauguccagacaaaggauaacuucccacugcucgacauaaucguguuuauuaaaucugccguaaucaggaccacauauaaucacauuuacgacacuggcccuaccaucgggauaaacacgcagcaugaugaacacuguacaggacccugcccagcugugguuccccacaaggagaauuggaugaccuucagccaagagcguacuucccgguggggcugugaagaguuugguugccuggccaucaacaccgggugugucuucggaucaugccaggacauuauccauccugaaacaaaaguguaucgaaaggcaguggaggaagaggucguucuuacugugugcauuaauuuuccaggcaacaauuacuguaccgagaucaacgcuauagaaccgaaaauuacagaugagaucgaauugcaguucaagacgguggacaccaaaacucugcccaacuuacucgccguacagaaucacaagcuguacaguggucaaaucaacgaucuuggcagcuuuucucaggggugcggaaauguccagaagacaaaccauuccauucugggcauggggaccgugaaauucgacuauguuugucacggagcgucaagaaaggaugugaucgucaggcgcugcuacaauaacaauuuugacaguuguaaacuacucaaggaggagacuagccugauauucgccgauaaccaugaaacauuggagguggcucacaccaaacaccugauuggcgaauuacaauucaagaucaugcucggugacauucgguauaaguccuuugcagagucuccugaacuggagaucgaugccaaaugcguuggguguccaucgugcuucgagagcuacucauguaauuuucagauagugacgaacauugacacuguaugcuccgucgaaggacccuguacccuuuuccauaauagaaucaucauuagugcuaacaagcagucuuauggccugaaaaugagcugccagacaaagccuaaucaaaacgaggaauuuaucauuugcaauaggaaauacuccguguuguucaccacuauagauaagaacgacaagaucgaggugaauacaggugaccagaccucauauauuuacgaaaaagauucucgcuguaagacauggcucugccgaguccgggacgagggcaucagcguucuguuugagccacuaaaagccuucuuugggaguuacuucuccaucauuuucuaugugguagugggaauaaucguccuguuccuuauuaucuacauuuuucuccccauguucuucaagcugaaagauguguugaagcguaacgaauaucuguacuuacaggagcucaagcacaaauga

SEQ ID NO: 10906 - RNA, 4305 nt, Artificial Sequence
  derived and/or modified CDS sequence (opt3) from CVV(MNZ-92011)__KC436107.1__GP
augcuguuccuccuuauccuggccuuuuugggcuucagcaccuccaaccccauugcuacaagaugcuuucacgggggacaguuaauagcagagucuaagucagccacgaguaucagcgaguucugucugaaagacgauguguccaugcuaaagucugaagucguuuacacuaaaaaugacaccggucucuuuggccauaacaagguguucaggucguggacaauuaaagauuggaagcugugcaauccuaucccaacugcugggggaaccauuaacguaaucgaagugaauaaggaccuuucacugaugacaaaaaccuauauauguagccgggauugcacuaucacaauugacaaggaggaagcgcaaaucauuuuucagaccgauaaauugaaccacuucgaggucaguggcacgacucucaauuccgguugguuuaagucuaaagccagcgugacccuggaccgcacaugugagcauguuaaggugacuugcgggaagaaaucccugcaguuccacgcauguuuuaagcaucacaugucaugcguccgauucuuucacaacaccauccucccgggaaauaugauaaacaguaugugucagaauauugaauuaaucauuauccugggccuuacauuggccaucuucauucugauggugaugcuaaccaaaacguacauaugcuaucuccugaugcccaucuucaugccuauugcuuaccuuuauggcugggcauacaacaagagcuguaaaaagugcaauugcugugggcuggccuaucauccauuuacuaacugcggaucucacuguguaugcgguuugaaauucgaggcuuccgaucguaugagaauccauagggaaucaggccucugucaaggguacaagagccugcggauagcccgcuuacugugcaagaguaaaggaucuucccucguuauuagcggccuucugucgauguugauccuaucuuuugugacacccaucgaggguaccauuacuuccuacccugagucaagaaaguauacacuggaagagaucaccgacgucguggaagggcucgugagugagcagaauauuaaagaauacauagucuucuauacgagccuguuuggaucccuuauccuguugcucgcguucauuaugucuaucacccugagcaagaucacaucaauuuuagcaaggcggaacguuauauacugugaggagugcaguauguaucacuccaaacgcggcaucaaguacaacggcgauuuuacuaauaaguguggguucugcaccuguaacgaacaggaggacgccgaaggacuggugauucacaaaguaagcaagcgaugcacauauaaauaccagcuaaagugggcuaaagugcucauggucacucuggugcuuuugcugaucgcccaaaauaccauucucaucguugcagcugguacagauugcugggccaagaagucucuggacauggacuguauaggcccaaugcuugauaucgggucaugcaccaacaaaaauacuagaaacuacgacacggaggcgcagaagcuggugagucagagcaaagucucccaguuggaugccgaccaagcaucucuccugggaaauucgauugauagcgcuaucaaggccauuagggcucagaaaacauaucccaccaugcauuuacuggaaacuaucuuucuaaugaagaacugugacuacuauaccuccuucaaucacaacucaggcuacagucaggccaaguggcggcucauagcaaaaacaggucauuuugauauuugcucucgucacagcacccaucacuucugucgcugcaucaaugacgggacuaagugucaaaacggcgauugggacuuugccggagagaugaaugagacauauaacuccaaaaaugauuucuacucacacgaccugaaccuuuucuauacgauuuuugaaaacgcuuucccuggcaccacugagagcuuguuuuaccagcugauccagaagaaaaauacagcgggggcaucuaagauacucggaaaacugaucaccaaguacgguaacaauaacauguucgugggcguauggaaguuugggcaguauuuacugacacuuccauacauuaauaacacugaauugucccaaaauagaaggcagaccauccucgccacgcaggagagucugagccggucucauuccggacgacaggaaucaaugaguagcgcuauucaaggcucgguuaccaaagagugccacaacgccaaggacguggguuguaucuccccgcgcuucgggauacccauuggcaaucuaacagcaugcggagauucuccuaacuauaaaaucuacaagacuccagagaaacuguauaagagcaauaacaagggcgaagucugguguucaaaugacgugcauugccucaacgauuuugagcccgccgacgaagaggucgugaauaaaguuaagaaacugaccugcuuccuuacagaugugaguguaaagacugacaucuuuuccgucgcugccucuaccuguaaaauggcagauaaggggauuugcacggugaacgacgcgaaguggaacaucauuaaaugugauagcggauuguacuauuucacagaccacagagagggucaggauaccggcaaugacuuuggggaauacugcauaucccacucauguaacacugagagguucccuaucaauccagauauucugaaggacugcacaugggaauuucauagccggaaaaguaaguacaucucuaccauuuccuuagagagccucgaagaguuccgcagagcuaugacugagaaacugucgcacacccuuacaaucuauaacuucaagcccacggccaaucugccgcauauaaggccuaccuacaaguuuaucacugcaaacggaguugaaaauucagacggcauugagucugccuauaucuugaguuccauucccgcucucggugggaucagcgugggcuacaacguccagacaaaagauaauuucccacugcuagacauaauuguguuuaucaagucugccguaauccguaccacauauaaccacauuuacgauacuggaccuaccauaggcaucaauacgcagcaugacgaacacuguacagggcccugcccagcagugguuccccacaaagagaacuggauuaccuucagccaagaacggacuucccgauggggaugugaggaguuuggcugccuggcuaucaauaccgguugugucuucgggucaugccaggauauuauccauccugaaacaaagguguauagaaaagccguggaggaagaggucguucucacugugugcauaaacuuuccaggaaauaacuacuguaccgaaaucaacgcgguggagccgaagauuacagacgagaucgaacugcaguucaaaacgguagauaccaagacucuucccaauuugcuggccguccagaaccacaaguuauacaguggccaaauuaaugaccucgguagcuuuucucagggcugcgggaacgugcagaaaacaaaucauuccauccugggaaugggcaccgcuaaguucgauuauguuugucacggggcaucaaggaaagacgugauaguccgccggugcuacaacaauaacuuugauaguuguagacuucugaaggaggaaacuagccuaauuuucgccgacaaucaugagacacucgagguggcucacaccaaacaccugaucggagaauugcaauucaagaucaugcugggcgauauuagguauaaguccuuugccgagucuccugaauuagagaucgacgcaaaaugcguugguuguccaucgugcuucgaaagcuacucauguaacuuucagauagugacgaauauugacacuguaugcuccgucgaggggcccuguacccucuuccauaaccgcaucauuaucagugcgaauaagcagucuuauggacugaaaaugagcugccagacaaagccuaaccaaaaugaggaauuuauaauuugcaaccgaaaauacuccgugcuuuucaccacuaucgauaagaaugacaagaucgaggugaacacaggcgaucagaccucauauauuuacgaaaaagacucucgguguaagacauggcugugccgugucagagaugaggguaucagcguuuuguuugaaccacucaaagccuucuuuggcaguuacuucuccauuauauuuuaugugguaguggggaucauuguccuguuccuaaucaucuacauuuuucugcccauguucuucaaacuuaaggacgugcucaagaggaacgaguaucuguacuugcaggagcugaagcacaaauga

SEQ ID NO: 10907 - RNA, 4305 nt, Artificial Sequence
  derived and/or modified CDS sequence (opt3) from CVV(MPB1-1551)__KX100143.1__GP
augcuguuccuccuuauccuggccuuuuugggcuucagcaccuccaaccccauugcuacaagaugcuuucacgggggacaguuaauagcagagucuaagucagccacgaguaucagcgaauuuugucugaaagacgauguguccaugcuaaagucugaggucguuuacauuaaaaaugacacuggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauuaccagcaugugucagaauaucgaauuaauuaucauccugggccuuacauuggccauuuucauacugauggugaugcuaaccaaaacguacaucugcuaucuccugaugcccauuuucaugccuaucgcuuaccuuuauggcugggcauacaacaagucuuguaaaaagugcaauugcugugggcuggccuaucauccauuuacuaacugcggaucccacuguguaugcgguuugaaauucgaggcuucagaucguaugagaauacauagggaaagcggccucugucaaggguacaagagucugcggauugcccgcuuacugugcaagucuaaaggauccagccucguuaucucgggccuucugucuauguugauccuauccuuugugacacccauugaggguaccaucacuucauacccugagaguagaaaguauacacuggaagagauuaccgacgucguggaagggcucgugagcgagcagaauauaaaagaauacaucgucuucuauacgucccuguuuggaucucuuauucuguugcucgcguucaucaugagcaucacccugucaaagauuacaaguauauuagcaaaaaggaacguuaucuacugugaggagugcuccauguaucacagcaagcggggcauuaaguacaauggcgauuuuacuaacaaauguggguucugcaccuguaacgaacaggaggacacagaaggacuggugauccacaagguaucuaaacgcugcacuuauaaguaccagcuaaaaugggccaaggugcucaugauuacccugguccuuuugcugaucgcucaaaauacaauacucaucguggccgcagagaccgauugcuggacuaagaaaucacuggacauugacuguaucgguccaaugcuugauauuggcaguugcacgaacaagaauacacgaagcuacgacgcugaagcccagaaacugguuucccagucuaagaucucgcaguuggaugcggaccaagccagccuccuggggaacuccauagauucagcaauuaaagcuaucagagcccagaagaccuaucccacuaugcauuuacuggagaccauuuuucuaaugaagaauugugacuacuauacaaguuucaaccacaauucuggauacagccaggcuaaauggaggcucaucgccaagaccggccauuuugauauaugcucccggcacucaacucaucacuucugucguugcaucaacgacgguacaaaaugucaaaauggggauugggacuuugcaggcgagaugaacgaaacguauaauagcaagaacgauuucuacucucacgaccugaaucuuuucuauaccauuuuugagaacgccuucccuggaacuacagaauccuuguuuuaccagcugauccagaaaaagaauaccacaggcgcuaguaaagugcucgggaagcugauuacuaaguacggaaacaacaauauguucgucgguguguggaaauuuggccaguauuuacugacccuuccauacaucaacaauacggaguugagccaaaaccgcagacucaccauacuggcgacacaggaaauucuaucuaggucccauucagggcggcaggagaguaugagcaaugcaauccagggaucgaucacuaaggagugccacaacgccaaaggcguagguuguauuuccccgcgauucgggauccccauuggcaaucugaccgcuugcggagacucuccuaacuauaagauauacaaaacaccagaaaagcucuauaagagcaauaacaaaggcgagguuugguguucaaaugaugugcauugccugaacgacuuugaacccgccgaugaggaggucaucaauaagauuaaaaagcugacuugcuucuugaccgacgugagugucgaaguggauaucuuuuccguugcagccucuacguguaaaauggcugacaagggggugugcacaguaaacggagccaaguggaauauuaucaaaugugauagcggucuguacuauuucaccgaccaccgcgagggccaagauacugggaacgacuuuggagaauacugcauaucccacucauguaacacagagagauucccuaucaauccagauaccuuaaaggacugcacuugggaauuucauagcaggaaaaguaaguacauuucuaccaucucccucgagagccuggaggaguuccggcgcgcaauggcggaaaaacuuucgcacacacugacgauuuauaacuucaagcccaccgcuaauuugccgcauaucagaccuacuuacaaguuuauaacagccaacggcgucgaaaauucagaugguauugagucugcauauauccucaguuccauccccgcccuugggggcauuagcgugggauacaacguucagaccaaagacaauuucccacuacuggacauaaucguguuuauuaagucugcugucaucaggacaacuuauaaccacauuuacgauaccggcccuacgaucgggauaaauacacagcaugacgaacacuguaccggacccugcccagccgugguaccccacaaagagaacuggaugacuuucagccaggagcguaccucccgguggggcugugaagaguuugguugccucgcaaucaauacaggguguguguucggaucaugccaagauauuauccauccugaaacuaagguuuaucgaaaagcugucgaggaagagguggugcugaccgucugcauuaacuuuccaggcaauaguuacuguacagagaucaacgccauagaaccgaagauuacggacgagaucgaacuucaguucaaaaccguugauacuaagacauugcccaaucuguuagcggugcagaaccacaagcucuacagcggucagaucaacgaccugggcucuuuuucccaagggugcggaaaugugcagaaaaccaaccauucaauucuuggcauggggacuguaaaguucgauuaugucugucacggagccaguagaaaagacgugaucguuaggcgcugcuacaauaacaauuuugauagcuguaagcugcuaaaagaggagacaucccucauauucgcugacaaccaugaaacccuggagguggcacacacgaagcacuugauuggcgaacugcaguucaagaucauguuaggugauauucgguauaaaucuuuugccgagucgccugaacucgagaucgacgcuaagugcgucggguguccaagcugcuucgagucauacuccuguaauuuucaaauagugacuaacauugauaccguuugcaguguggaaggacccuguacacuguuccauaauagaaucaucauuucugccaacaaacagagcuauggccuuaagauguccugccagaccaaaccuaaucagaacgaggaauuuaucauuugcaauaggaaguacucaguacuguucacuacaauagacaagaacgacaaaaucgaggucaauaccggugaucaaacaucuuauauuuacgaaaaggacagccgcuguaaaacuugguugugccgagugcgggaugagggcaucagugugcucuuugagccacugaaggcauucuuuggguccuacuucagcaucauuuucuaugucguugugggaauaaucguacuauuccugauuaucuacauuuuucuucccauguucuucaaacucaaggacgugcugaagcguaacgaauauuuguaccugcaggaguuaaaacacaaguga

SEQ ID NO: 10908 - RNA, 4305 nt, Artificial Sequence
  derived and/or modified CDS sequence (opt3) from CVV(W308-67)__KX100140.1__GP
augcuguuccuccuuauccuggccuuuuugggcuucagcaccuccaaccccauugcuacaagaugcuuucacgggggacaguuaauagcagagucuaagucagccacgaguaucagcgaauuuugucugaaagacgauguguccaugcuaaagucugaggucguuuacauuaaaaaugacacuggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauuaccagcaugugucagaauaucgaauuaauuaucauccugggccuuacauuggccauuuucauacugauggugacccuaacgaaaacuuacaucugcuaucuccugaugcccauuuucaugccuaucgcuuaccuuuauggcugggcauacaacaagucuuguaaaaagugcaauugcugugggcuggccuaucauccauuuacaaacugcggaucccacuguguaugcgguuugaaauucgaggcuucagaucguaugagaauacauagggaaagcggccucugucaaggguacaagagucugcggauugcccgcuuacugugcaagucuaaaggauccagccucguuaucucgggccuucugucuauguugauccuauccuuugugacccccauugaggguacuaucacaucauacccugagaguagaaaguauacccuggaagagauuacggacgucguggaagggcucgugagcgagcagaauauaaaagaauacaucgucuucuauaccucccuguuuggaucucuuauucuguugcucgcguucaucaugagcaucacacugucaaagauuaccaguauauuagcaaaaaggaacguuaucuacugugaggagugcuccauguaucacagcaagcggggcauuaaguacaauggcgauuuuacuaacaaauguggguucugcacauguaacgaacaggaggacacugaaggacuggugauccacaagguaucuaaacgcugcaccuauaaguaccagcuaaaaugggccaaggugcucaugauuacacugguccuuuugcugaucgcucaaaauaccauacucaucguggccgcagagacugauugcuggacgaagaaaucacuggacauugacuguaucgguccaaugcuugauauuggcaguugcacaaacaagaauacccgaagcuacgacgcugaagcccagaaacugguuucccagucuaagaucucgcaguuggaugcggaccaagccagccuccuggggaacuccauagauucagcaauuaaagcuaucagagcccagaagacuuaucccaccaugcauuuacuggagacaauuuuucuaaugaagaauugugacuacuauaccaguuucaaccacaauucuggauacagccaggcuaaauggaggcucaucgccaagacuggccauuuugauauaugcucccggcacucaacacaucacuucugucguugcaucaacgacgagacgaaaugucaaaauggugauugggacuuugcaggggaaaugaacgagaccuauaagagcaaaaaugauuucuacucucacgaccugaaccuuuucuauacuauuuuugaaaaugccuucccuggcacaaccgaguccuuguuuuaccagcugauccagaagaaaaacacaacuggagcuaguaaggugcucggcaagcugauuaccaaauacgggaauaacaacauguucgucggaguguggaaguuuggucaguauuuacugacgcuuccauacaucaauaacaccgaauugagccaaaaucgcagacucacaauacuggcgacucaggagauucuaucuagguccuauucaggccggcaggagaguaugagcaacgcaauccaggggucgaucaccaaagaaugccauaaugccaagggaguaggcuguauuuccccgcgauucgguauccccauugggaaccugacagcuugcggcgacucuccuaauuacaaaauauauaagacuccagagaagcucuacaaaagcaacaauaagggagaaguuugguguucaaacgaugugcacugccugaaugacuuugagcccgccgaugaggaagucaucaacaaaauuaagaaacuuaccugcuucuugacggacgugagugucgagguggauaucuuuuccguugcagccucuacauguaagauggcugacaagggcgugugcaccguaaauggggccaaauggaacauuaucaagugugauagcggacuguauuacuucacugaccaucgcgaaggucaagauacaggcaaugacuuuggggaguacugcauaucccacucauguaacaccgaaagauucccuaucaacccagauacuuuaaaagacugcaccugggaguuucacagcaggaagaguaaauauauuucuacaaucucccucgagagccuggaagaguuccggcgcgcaauggcggaaaaacuuucgcauacgcugaccauuuacaauuucaagcccacugcuaacuugccgcacaucagaccuacauauaaguuuauaaccgccaauggagucgagaacucagauggcauugaaucugcauacauccucaguuccauccccgcccugggugggauuagcgugggcuauaauguucagacaaaggacaacuucccacuacuggacauaaucguguuuauuaaaucugcugucaucaggacuaccuacaaucauauuuaugauacgggaccuacaaucggcauaaacacccagcacgacgagcauuguacugggcccugcccagccgugguaccccacaaggagaauuggaugaccuucagccaggaacguacaucccgguggggaugugaggaauuuggcugccucgcaaucaacacugguuguguguucgggucaugccaagauauuauccacccugagaccaaaguuuaccgaaaggcugucgaagaggagguggugcugacagucugcauuaauuuuccaggaaacaauuacuguacggaaaucaacgccauagagccgaaaauuaccgacgaaaucgagcuucaguucaagacuguugauacaaagaccuugcccaaucuguuagcggugcagaaccauaaacucuauaguggccagaucaacgaccuggguagcuuuucucaaggcugcgggaaugugcagaagacuaaccacuccauucuuggaaugggcacaguaaaauucgauuacgucugucauggggccucaagaaaggacgugaucguuaggcgcugcuauaauaacaauuuugauaguuguaaacugcuaaaggaggaaaccagccucauauucgcugacaaccacgagacgcuggaaguggcacauacuaagcacuugauuggagagcugcaguucaaaaucauguuaggcgauauucgguacaaguccuuugccgaaucuccugagcucgagaucgacgcuaaaugcgucgguuguccaucgugcuucgaaagcuauucauguuacuuucaaauagugaccaauauugauacaguuugcuccguggaggggcccuguacccuguuccacaacagaaucaucauuagugccaauaagcagucuuauggacuuaaaaugagcugccagacuaagccuaaccagaaugaagaguuuaucauuugcaacaggaaguacuccguacuguucacaaccauagacaaaaaugacaagaucgaagucaacacaggcgaucaaacuucauacauuuaugagaaagacucucgcuguaagaccugguugugccgagugcgggaugaggguaucagcgugcucuuugaaccacugaaagcauucuuuggcaguuacuucuccaucauuuucuaugucguuguggggauaaucguacuauuccugauuaucuacauuuuucuucccauguucuucaagcucaaggacgugcugaaacguaaugaguauuuguaccugcaggaauuaaagcauaaauga

SEQ ID NO: 10909 - RNA, 4305 nt, Artificial Sequence
  derived and/or modified CDS sequence (opt3) from CVV(W728-67)__KX100137.1__GP
augcuguuccuccuuauccuggccuuuuugggcuucagcaccuccaaccccauugcuacaagaugcuuucacgggggacaguuaauagcagagucuaagucagccacgaguaucagcgaguucugucugaaagacgauguguccaugcuaaagucugaagucguuuacauuaaaaaugacacuggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauuaccagcaugugucagaauaucgaauuaauuaucauccugggccuuacauuggccauuuucauacugauggugaugcuaaccaaaacguacaucugcuaucuccugaugcccauuuucaugccuaucgcuuaccuuuauggcugggcauacaacaagucuuguaaaaagugcaauugcugugggcuggccuaucauccauuuacuaacugcggaucccacuguguaugcgguuugaaauucgaggcuucagaucguaugagaauacauagggaaagcggccucugucaaggguacaagagucugcggauugcccgcuuacugugcaagucuaaaggauccagccucguuaucucgggccuucugucuauguugauccuauccuuugugacacccauugaggguaccaucacuucauacccugagaguagaaaguauacacuggaagagauuaccgacgucguggaagggcucgugagcgagcagaauauaaaagaauacaucgucuucuauacgucccuguuuggaucucuuauucuguugcucgcguucaucaugagcaucacccugucaaagauuacaaguauauuagcaaaaaggaacguuaucuacugugaggagugcuccauguaucacagcaagcggggcauuaaguacaauggcgauuuuacuaacaaauguggguucugcaccuguaacgaacaggaggacacagaaggacuggugauccacaagguaucuaaacgcugcacuuauaaguaccagcuaaaaugggccaaggugcucaugauuacccugguccuuuugcugaucgcucaaaauacaauacucaucguggccgcagagaccgauugcuggacuaagaaaucacuggacauugacuguaucgguccaaugcuugauauuggcaguugcacgaacaagaauacacgaagcuacgacgcugaagcccagaaacugguuucccagucuaagaucucgcaguuggaugcggaccaagccagccuccuggggaacuccauagauucagcaauuaaagcuaucagagcccagaagaccuaucccacuaugcauuuacuggagaccauuuuucuaaugaagaauugugacuacuauacaaguuucaaccacaauucuggauacagccaggcuaaauggaggcucaucgccaagaccggccauuuugauauaugcucccggcacucaacucaucacuucugucguugcaucaacgacgguacaaaaugucaaaauggggauugggacuuugcaggcgagaugaacgaaacguauaauagcaagaacgauuucuacucucacgaccugaaucuuuucuauaccauuuuugagaacgccuucccuggaacuacagaauccuuguuuuaccagcugauccagaaaaagaauaccacaggcgcuaguaaaauucucgggaagcugaucacuaaguacggaaacaacaauaugguggucgguguguggaaauucggccaguauuuacugacccuuccauacauaaacaauacggaguugagccaaaaccgcagacucaccauucuggcgacacaggaacuacugucuaggucccauucagggcggcaggagaguaugagcaaugcaauccagggaucgaucacuaaggagugccacaacgccaaaggcguagguuguauuuccccgcgauuugggauccccauuggcaaucucaccgcuugcggagacucuccuaacuauaagauauacaaaacaccagaaaagcuguauaagagcaauaacaaaggcgagguuugguguucaaaugaugugcauugccuuaacgacuucgaacccgccgaugaggaggucgugaauaagaucaaaaaguugacuugcuuucugaccgacgucaguguggaaguugauauuuucuccguggcagccucuacguguaaaauggcugacaaggggguaugcacagucaacggagccaaguggaauaucauuaaaugugauagcgguuuauacuauuuuaccgaccaccgcgagggccaagauacugggaacgacuucggagaauacugcaucucccacucauguaacacagagagauuuccuauaaauccagauacccucaaggacugcacuugggaguuccauagcaggaaaaguaaguacaucucuaccauuucccuggaaagccuugaggaauuucggcgcgcaauggcggagaaacugucgcacacauugacgaucuauaacuucaagcccaccgcuaaucucccgcauauuagaccuacuuacaaguucaucacagccaacggcguggaaaauucagaugguauagagucugcauauauucugaguuccauccccgcccuagggggcaucagcguuggauacaacgugcagaccaaagacaauuuuccacugcucgacauuauagucuucaucaagucugcugugauuaggacaacuuauaaccacaucuacgauaccggcccuacgauugggaucaauacacagcaugacgaacacuguaccggacccugcccagccguagugccccacaaagagaacuggaugacuuuuagccaggagcguaccucccgguggggcugugaagaguucgguugccuggcaauaaauacaggguguguuuuuggaucaugccaagauaucauucauccugaaacuaaggucuaucgaaaagcuguggaggaagaggugguccuuaccguuugcaucaacuucccaggcaauaacuacuguacagagauuaaugccaucgaaccgaagauaacggacgagauugaauugcaguuuaaaaccguggauacuaagacacugcccaacuuacucgcggugcagaaccacaagcuguacaguggucagaucaaugaccuuggcagcuucucucaagggugcggaaacguacagaaaaccaaucauuccauccugggcauggggacugucaaguuugauuaugugugucacggagccucaagaaaagacguuauugugaggcgcugcuacaacaauaacuucgauaguuguaagcuacucaaagaggagacaagccugaucuuugcugacaaucaugaaaccuuggaggucgcacacacgaagcaccugauaggcgaauuacaguucaagauuaugcucggugauauccgguauaaauccuucgccgagucuccugaacuggagauugacgcuaagugcgugggguguccaucgugcuuugagagcuacucauguaacuuccaaaucguuacuaauauagauaccgugugcuccguagaaggacccuguacacuuuuucauaacagaauuaucaucagugccaauaaacagucuuauggccugaagaugagcugccagaccaaaccuaaccagaaugaggaguucauuaucugcaacaggaaguacuccgucuuguuuacuacaauugacaagaaugacaaaauagaagugaacaccggugaucaaacaucauauaucuacgaaaaggacucucgcuguaaaacuuggcucugccgagugcgggaugagggcauuagcguccuguucgagccacuaaaggcauuuuucgggaguuacuuuuccaucaucuucuauguugugguaggaauuauagugcuguuucuuaucauuuacaucuuccuccccauguuuuucaaacugaaggacgucuugaagcguaaugaauaucuguacuuacaggagcucaaacacaaguga

SEQ ID NO: 10910 - RNA, 4305 nt, Artificial Sequence
  derived and/or modified CDS sequence (opt3) from CVV(WI-03BS7669)__KX100152.1__GP
augcuguuccuccuuauccuggccuuuuugggcuucagcaccuccaaccccauugcuacaagaugcuuucacgggggacaguuaauagcagagucuaagucagccacgaguaucagcgaguucugucugaaagacgauguguccaugcuaaagucugaagucguuuacauuaaaaaugacacuggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauuaccagcaugugucagaauaucgaauuaauuaucauccugggccuuacauuggccauuuucauacugauggugauccuaaccaaaacguacauuugcuaucuccugaugcccaucuucaugccuauagcuuaccuuuauggcugggcauacaacaagucuuguaaaaagugcaauugcugugggcuggccuaucauccauuuacuaacugcggaucccacuguguaugcgguuugaaauucgaggcuucagaucguaugaggauucauagagaaagcggccucugucaaggguacaagagucugcggaucgcccgcuuacugugcaagucuaaaggauccagccucguuaucucgggccuucugucuauguugauucuauccuuugugacacccaucgaggguaccauuacuucauacccugagaguagaaaguauacacuggaagagauaaccgacgucguggaagggcucgugagcgagcagaauaucaaagaauacauugucuucuauacgucccuguuuggaucucuuauccuguugcucgcguucaucaugagcauuacccugucaaagauaacaaguaucuuagcaaaaaggaacguuauuuacugugaggagugcuccauguaucacagcaagcggggcaucaaguacaauggcgauuuuacuaacaaauguggguucugcaccuguaacgaacaggaggacacagaaggacuggugauucacaagguaucuaaacgcugcacuuauaaguaccagcuaaaaugggccaaggugcucaugaucacccugguccuuuugcugauagcucaaaauacaauccucauuguggccgcagagaccgauugcuggaucaagaaaucacuggacauugacuguaucgguccaaugcuugauauaggcaguugcacuaacaagaauacgcgaagcuacgacacagaagcucagaaacugguuucccagucuaagauuucgcaguuggaugccgaccaagugagccuccuggggaacuccaucgauucagcgauuaaagccaucagagcacagaagaccuauaguacuaugcauuuacuggagaccauauuucuaaugaagaauugugacuacuauacaucuuucaaccacaauagcggauacucccaggcuaaauggaggcucaucgccaagaccggccauuuugauauuugcucacggcacagcacucaucacuucugucguugcaucaacgacgguacaaaaugucaaaauggggauugggacuuugcuggcgagaugaacgaaacguauaauucuaagaacgauuucuacucccacgaccugaaucuuuucuauaccauuuuugagaacgccuuccccggaacuacagaaaguuuguuuuaccagcugauccagaaaaagaauaccacaggcgcaagcaaaguccucgggaagcugauaacuaaguacggaaacaacaauauguucguggguguauggaaauuuggccaguauuuacugacccuuccuuacauuaacaauacggaguugucucaaaaccgcagacucaccauccugacaacucaggaacuacuguccaggucacauagugggcggcaggagagcaugucgaaugccauccagggauccauuaccaaggagugccacaacgcuaaaggcguugguuguaucucuccacgauucgggauuccgauaggcaaucucacagcgugcggagacagccccaacuauaagaucuacaaaacuccugaaaagcuguauaagucaaauaacaaaggcgaggugugguguaguaaugauguccauugccuuaacgacuuugaaccagcagaugaggagguggucaauaagauuaaaaaguugaccugcuuccugacggacguguccguugaaguggauaucuuuucuguagccgcuagcacauguaaaauggccgacaagggggucugcaccgugaacggagcaaaguggaauauuaucaaaugugauuccgguuuauacuauuucacugaccaccgcgagggccaagauacagggaacgacuuuggagaauacugcauaucacacagcuguaacaccgagagauuccccaucaauccugauauucucaaggacugcacuugggaauuucauaguaggaaaucuaaguacaucuccaccauuagccuggagucgcuugaggaguuccggcgcgccauggcugaaaaacugucacacacauugacgaucuauaacuucaagccaaccgccaaucucccccauauaagaccgacuuacaaguuuauuacagcaaacggcguugaaaauucugaugguaucgagagugcguauauccuguccagcauuccugcucuagggggcauaucugugggauacaacguccagaccaaagacaauuucccccugcucgacaucauuguguuuaucaagagcgccguaauuaggacaacuuauaaccacaucuacgauaccggcccaacgauagggaucaauacacagcaugacgaacacuguaccggaccuugccccgcagugguuccacacaaagagaacuggaugacuuucucccaggagcguaccucacgguggggcugugaagaguuugguugccuggccauuaauacagggugugucuucggaaguugccaagauaucauucaucccgaaacuaagguguaucgaaaagcuguggaggaagaggucguucuuaccgugugcaucaacuuuccuggcaauaacuacuguacagagauaaaugccauugaaccaaagaucacggacgagaucgaauugcaguucaaaaccguggauacuaagacacugccgaacuuacucgcaguacagaaccacaagcuguacagcggucagauuaaugaccuuggcucuuuuucccaagggugcggaaacguccagaaaaccaaucauucaauccugggcauggggacugugaaguucgauuauguuugucacggagcuaguagaaaagacgugauagucaggcgcugcuacaacaauaacuuugauagcuguaagcuacucaaagaggagacaucccugauuuucgccgacaaucaugaaaccuuggagguggcgcacacgaagcaccugaucggcgaauuacaguucaagauuaugcucggugauauccgguauaaaucuuuugccgagucgcccgaacuggagauagacgcuaagugcguuggguguccuagcugcuucgagucauacuccuguaacuuucaaauugugacuaauaucgauaccguaugcagugucgaaggaccauguacacuuuuccauaacagaaucauuaucucugcaaauaaacagagcuauggccugaagauguccugccagaccaaacccaaccagaaugaggaauuuauuauaugcaacaggaaguacucaguguuguucacuacaaucgacaagaaugacaaaauugaggugaacaccggugaucaaacaucuuauaucuacgaaaaggacagccgcuguaaaacuuggcucugccgaguccgggaugagggcaucaguguucuguuugagccucuaaaggccuucuuuggguccuacuucagcauuauauuuuaugugguagugggaaucauuguccuguuccuuaucauuuacaucuuucucccaauguucuucaaacugaaggacguguugaagcguaaugaauaucuguacuuacaggagcucaaacacaaguga

SEQ ID NO: 10911 - RNA, 4317 nt, Artificial Sequence
  derived and/or modified CDS sequence (opt3) from CHLV(CHLV-Mex07)__JN808310.1__GP
auggagcccagcaucaagcuguuccucauucuugccauagcugcagccgcggugcacucccugccugcuucuagaugcuuuucagaaggcaucgucauuaaagagaagcaggacaguaaagccguuagcgaguucuguuugaaggaugacguguccaugaucaaaucucauguaguguacucgaagaacgaaucagggauuuuugcaaauagccaaaucuuaaggaaguggauaaucaaagauuggaagcugugcaguccacuaccgaccgccggaggucagauuaacgucaucgaaauuaaucacgaccucacacuguccacuaaaacguauguguguaccacagauugcacuaucggcauagacaaggagaacgcucagauuaccuuccagacaaauaaacuuaacuacuuugagguuucugggaccacuaucagcuccggaugguucaagucaaagacaagugugagccuggaucaaaccugugaacauuugaaagucucuugcggcaagaaauccaugcaguuucacgcauguuucaagcagcauaugucaugcauucgguaucuccaccgcacggcccugcccgguuacauggcugccagcaucuguaguaauaucgagcugauuauaaugacuacccucacauuagcgaucuuuauucugcuuugcaucauaacuaaaaccuauauuuguuacuugcugaugccucuauucaugccaaucgcauauaucuacggguggcucuacaacaagucuugcaaaaagugcaauuguugcggacuguccuaucaccccuuuacaaacuguggcagcuacugcguguguggcgccaaguucgaaaccucggaccgaaugcguauucauagagagucugggcuuugccagggauauaaaucccugaggguagcucggaaguuguguaaaucaaaggguaguagccucguuaucuccauuacgcugucuguguuuauauucagcuucaucacuccuauuggcggggccaucaucaaugauaaauuaucagaggaaaaguacaguauuaaccaaaugauggacgcaauagucgaucuggagaauuuuucccacaacgugagcggaacacaacaggugaucucugucauuuuccuccuuaucucaugccuguuuuugcuacugaccuaucaucucaauaagauuauccagcaccuggcucgcuucggccuucuguuuugugaagagugcaguauguaccacagcaaaaaggacauaaaauauaacggugauuucacuaacaaguguggguuuugcacaugcggacaaccagaagaccccgagggcuugaaucuccauauccugucccagaacuguaccuacaaacagcaauucaaguggguuaagauuaucauuucuaucuuacugucgcuaauaauuaucgagaauagcaugauucucgccgcggccgaaacggacugcuuuuccgagaaacagaucucagaguucugucugggcccucuuuugaguauaucuagcugcgaagauaagaacuccagaaccuuuaaaggggaagcacagaagcugguggcucucaaaaagaucacaucagacgaggccaugcugauugagagcaugggagcuaauguagaaggugcccuugagaugauccaggcacaaaagucuccagauuccauguacacuauggaauauguguuccugaacaccuacugugacuauuacaguuuguuugagcacaauagcggcuauucucaggucaaauggagguacauucucaagacacaucaguucgaugccugcgcucggcacuccaacucacauuucugucgcugcaugagugacgggaugcacuguccgagcucggauugggacaucgcggaugaacuggacaauacuuauauaaccaaacccaacuuuuucaagcacgauuacaauuuacugcuagacgugauuacagcagccuuuccuggaaccggcgcuguuuucgugaucgacgccugcaaaaaggcaaacgccacugcuaucaaaacguuuuccaauaacauuaucgcccgauucccauacaauaaccuccugaagggugucaugaaguuucuucaguauauuucuaaacaucccagcuucaagaaauaccaaccugauacaagacacuaugacuugauaccaguggcacccaccgcgagggggcggucacugggccguaguaacuccuacaauaacgcucagaucggaucuccgacuaaggauugucagaugcucaaagagguaggcugccugagcccuaaguuuggguuaccccuggaguccauuaucucaugcggaagcaguccaaauuauaaguuauacaaaaagccucagaaauauuacaagucuaacaauaaagaaaacaccugguguuccaaggacguucauugcuugcacgauuucgagcccauuacagaagacgugcucgagaaggucaaagugaugaccuguugggagaucgaaccagguacuauagaggauaucuuuacaauugccagcgaaacgugcaagaucaaugaccgcggcgucugugaggugaacgcagccaaauggaagauuguuaaaugcgaaaccgggcuguacuauuacacugaucacagagagggagacgauacaggcucggaccuaggucauuauugucugacccacaagugcgcugggggcagguaccccaucaauccugagauacuccaaaacugugugugggaguuccauucacagaagucucaguauauuaaucagguagaucuggaacaaaucgaagaguacaaaaaggcccuuacagaaaaauugacucacacccugaaccauuauaauuuucuuccaacgaagaaccucccgcacaucagucccaauuacaaauacgucacccugaacggacaggagacauccgacggcauugagaacagcuauauagugucugaaaucccugcaauugcugggacuagcaucggacuuaagguucagaccaaaacaaaugacgauauuuucgaccugaucauauacgugaagcgggccgauaucauugcguccuauaaccacaucuacgacacugguccaaccauuggccauaaugucgagcacgaagaguugugcacggggcaauguccccagcauaucccugccaaggcuaacuggcucacauucucacaggaacgaaccagucgcuggggaugcgaggaguuuggcugccuggcaauaaauacugguuguguguaugggagcugccaggauauuaucaaaccaguagccaagguguacagaaaaucuacagaagagaagguugaacuagagcuguguaucguccuccccgacaaaaacuucugcaccacucugaaugcucuugagccgaagauuaccgaagagaucgaauugcaauuuaagacaauagaucagaugucccugccuaacauuguguuacucagggaccacaaacuguucaagggccagaucaaugaucuuggaacguuuggccagaacugugggaaugugcaaaagaccaaccagucaauucugggagccggcacuguccgguucgacuaucuaugccauagugcaagccgcaaggauaucauaauuagaagguguuacaauaacaauuacgacuccugcaaccaccuccagcuggcggagucuuugaucuuucuggauaaccacgaaacauuagagguucguaaaccaaaucauauccucgguacccugucgaugaaacuuaugcugggggacuuccaguauaagacauuugccaaagacauugaguuggauuucacuggacggugugugggcugcaucgguuguuuugaaggcuucgugugcgagaugcacauuaccacgacaguagaagcuaccugcaaccucgaggccagcugucaauucuuucauaaucagcugcacauaaagcccgacguccuaaaauacuauacuaagaugaccugccagacagaugaauacaucccuucaaaaauuaagaucuguaacaaggaguauaaaaucacuguggggaagguucagaaaaaugacaagauugagauagauaacuccgaccagaccaguuacaucaaagaaaaggaugagcgaugcaagacauggcuguguagagugagggacgaaggaauuucugucaucuucgagccccuucucaauauuuuuggcaacuaugggcgcaucgcaguggcuguuauaagcgccauccuggcauugauuauccugguguacauuuuaaugccaaucugcaugcggauaagagauauucucaaaacgaaugaaagggaguuccugaucgaguccaaguacaaauga

SEQ ID NO: 10912 - RNA, 4305 nt, Artificial Sequence
  derived and/or modified CDS sequence (opt3) from FSV(86MSP18)__KX100131.1__GP
augcugagccuccuuauccuggccuuguuaggccuguccaccucuaaccccauugcuacaagaugcuuccacgggggacagcuaauagcagagucaaagagugccacuagcaucuccgaauuuugucucaaagacgaugugucuaugcugaagucggaggucauuuacacgaaaaaugacaccggucuuuucggccauaacaagguuuuuaggucauggacaaucaaagauuggaagcugugcaauccuauuccaacugcugggggaaccaucaacgugauagaaguaaauaaggacuugagccucaugacaaaaaccuauaucuguagucgggauugcacuauuacaaucgacaaggaggaagcucaaauuaucuuccagaccgauaaacugaaccacuuugagguguccggcacgacucugucuagcgguugguucaaguccaaagccucagucacccucgaccgcacaugugagcaugugaagguuacuugcgggaagaaaaguuuacaguuucacgcauguuucaagcaucacaugagcugcgugcgauuuuuccacaauaccauacugccgggaaacaugauuacaucuaugugucagaauaucgaacuuauuaucaucuugggccugacccuagccauuuuuauacucauggucaugaucacgaaaacuuacauuugcuaucugcuuaugcccaucuucaugccuauagcuuaccuguauggcugggcauacaacaaguccuguaaaaagugcaauugcuguggguuggccuaucauccauuuacaaacugcggaucacacugugugugcggucucaaauucgaggcuagcgaucguaugaggauucauagagaaaguggccugugucaaggguacaagucuuuacggaucgcccgccugcucugcaaguccaaaggaagcucgcuuguaaucucuggccuguuguccaugcuaauucugucauucguuacccccaucgaggguacuauuacaaauuacccugacaguagaaaguauacccucgaggaaauaacggauguggucgaggggcugaucagcgaacagaacauuaaagaguacaucguguuuuauaccucccuuuucggaucucugaucuugcuccuggcguuuauuaugagcauaacauuaucaaagaucaccaguauucuggcaaggcggaaugugaucuacugugaagagugcuccauguaucacagcaaacgcggcauuaaguacaacggcgacuucacuaacaaguguggguuuugcacauguaaugagcaggaagaugccgagggagucguuauccacaaagugucuaagcgaugcacuuauaaauaccagcuaaagugggcuaaaguacucaugauaacccuggugcuuuugcugaucgcccaaaacacaauucucaucgucgcagcugaaaccgacugcugggccaagaagucacuggacauuaauuguaucgguccaaugcuuaacauaggcaguugcacuaauaaaaacacgagaagcuacgauacagaggcgcagaagcuggugucccagucuaaaguuucgcaguuggacgccgaucaagcaagccuccugggguccucaauugacagugcuaucaaggccauuagggcucagaaaaccuaucccgccaugcauuuacuggaaacuaucuuccuaaugaagaauugugauuacuauaccucuuuuaaccacaauagcggauacucccaggcaaaguggcggcucauagccaaaacaggccauuucgacaucugcucacgucacagcacccaucacuuuugucgcugcauuaacgaugguacuaagugucaaaauggggacugggauuucgcuggcgagaugaacgagacauauaauucuaaaaacgacuuuuaccugcacgaucuuaauuuguucuauacgaucuuugaaaacgcguucccuggaaccacugagucccuguucuaccagcucauucagaagagaaacacaaucggcgcaaguaaagugcuggggaaguuaauaaccaaauacggagacaauaacauguuugucgguguguggaaguucggccaguaucugcuuacauugccauacauuaauaacacugaacucagccaaaauaggcggcagaccauccuggccgcucaggagcuaucuucccgaucacauccggggcgccaggaaaguaugagcucggccauccaaggauccguaacgaaggagugccacaacgcaaaagacguuggcuguauuucucccagauuugguaucccuauugggaaucugaccgccugcggcgauagcccaaacuauaagauauacaaaacacccgagaagcucuauaaaucaaauaacaagggagaagugugguguaguaaugacguccauugccugaacgauuucgagccugcugacgaagagguggucaauaaggugaaaaagcucacuugcuuuuugaccgauguuuccgugaaaacagacaucuucucuguagccgcaagcacuuguaagauggcggauaaaggcgucugcaccgugaacgacgcuaaguggaauauuaucaagugugauuccgggcuguacuauuuuacggaccacagggagggacaggauacagguaacgacuucggcgaauacugcauuucacacagcuguaacaccgagcgguuuccaaucaaucccgauauauuaaaagacugcacuugggaguuccauagucgcaagucuaaauacaucuccacaauuagccucgaaucgcuggaagaguuuagaagggccaugaccgagaaacuuucacacacucugaccaucuauaacuucaagccgacagcaaauuugccucauauucgucccacguacaaguuuaucaccgccaacgggguugaaaauucugacggaauagagagugcuuauauucucuccagcaucccagcccugggcgguaucucugugggguacaacguccagacuaaggauaauuucccucuacuggacauuauaguguucguaaaaagcgcagugauccggacaaccuauaaccacauuuacgauacaggccccacuaucggaauuaauacccagcaugacgaacacuguacgggcccaugccccgcuguugucccucacaaggagaacuggaucacauuuucccaagaacgaaccucaagaugggggugugaggaguucggaugccucgccauaaauacuggcuguguguuugguaguugccaggauaucauucauccagaaaccaaaguguauaggaaggcggucgaggaagagguugugcugacagugugcaucaacuucccggggaauaacuacuguacugaaauuaaugccaucgagcccaaaauaaccgacgagauugaacuucaguuuaagacaguagauacgaaaaccuugccuaaccuguuagcuguccagaaccacaagcucuacagcggacaaaucaaugaccugggcucuuucucccaggguugcggcaacgugcagaagacuaaucauucaauccuugggaugggaacagcaaaauuugauuauguuugucacggcgccagucgcaaggacgugauuguccggagaugcuacaacaauaacuucgauagcuguaaacugcuaaaggaggaaaccucccucguguuugcugacaaucaugagacucuggagguugcccacacaaaacacuugaucggggaacugcaauucaagauaauguuaggagauauuagguauaagucuuuugcagagucgccagaacucgagaucgacgcgaaaugcgugggcugucccagcugcuucgaaucauacuccuguaacuuccagauuguaaccaauaucgacacggucugcaguguggaggguccuuguacucuguuucauaaccgcauaauuaucucugccagcaagcaguccuaugggcuuaaaaugucaugccagaccaagccaucucaaaaugaggaguucaucauuugcaaccgaaaauacagcgugcuguuuacaaccaucgauaagaaugacaagauugaagucaacacuggagaucagacaaguuauauauacgaaaaagacucccgguguaagaccugguugugcaaaguucgugaugagggcaucagcgugcuuuucgaaccccugaaggcguuuuucgguucuuacuuuucaauuaucuucuauguaguggucggcaucauugugcuauuucugguuauauacaucuuccuuccgauguuuuucaaacucaaggacgugcugaagaaaaaugaguauuuguaccugcaggaguuaaagcacagauga

SEQ ID NO: 10913 - RNA, 4314 nt, Artificial Sequence
  derived and/or modified CDS sequence (opt3) from GERV__M21951.1__GP
auggccaucagcaccucccugcucauuguggcacuucugauaaaguugugcuuagucaacacagcucccccuaucucuaaauguuuccaggacggcauucugaucgccgagcuaaagucaaguagcgggauuuccgaauuuugcaucaaagaugacauaucuauccucaagucggagauuacuuacucaaagaaugauacgggaaucuucaugcacagcaagguuuuuagacauuggaccguggcggacuggaagcaauguaaccacacaagugcugguggcuccacuaauguacuggaaguggauaaaaaccuuaaucuggucgccaagaacuauaugugcaccaggccaugugugauuacaaucgacaaagagaaugcacagcucuuguuccagaccgaacagcugaaccaauuugagguuacugggacaaccauaucuacgggaugguucaagagcaaaacuuccgugucacuggauaauaccugcgagcauauuaaggucacauguggcaagaaaagucuccaguuucacgccugcuucaagcagcauaugagcugugugcgguuuuuacaccgcucuguacugccggguuacauggcuuccucaaucugccagaacauugaacuuaucaucauuauaaucuugacucuggcaauuuucaucuuuauguguauaauuacccgaacauauaucugcuaccuaaugcucccccuguucgccccuaucgcuuaucuuuacggguggcuguauaaucguagcugcaaaaaguguauuugcuguggauuggccuaccacccauuuaccaacugcggcaguuacuguguuugcggcucuagauucgagacguccgacaggaugcggcuccaucgcgaaagcgggcugugucaaggauucaaaucguuaagaguggcgaggucucugugcaaguccaaagguucaagucucgucaucagcauucuuacugcaaugcugauauuguccuuuaucacaccccuagaggccaugaccacuaauuauccugaugacaagaaguucacacugaaagaggugaacgauauugugcucggccgggacauggaacaggagcugaagucuagcauccuuauccugaugucaauuugugggauaggaaucauuuugaucuuuuucggccucaccguccuguuagaaauuguucuggagcuaaucgcuaaacgcaguacgauauuuugcaaggaauguaaucucauccacgauaaaaaguccaugaccuaccgaggugacuucacaaacaagugcggguuuugcccauguggagagcuggaggaccccgaaggccuugugauucauacuaccagaaaaagcugcacauauuacaucaagauuaggaacuugaaacugaucaugcucauauucucuauuguaauccugaugcagaaugccacuaugcuuguggucgcaggcgagaacuguuggaccaauacagaaauuaaggcugauugcguggggccucugaucggaccaucagccuguaccaacaaagguaguaagacuuauaagacgguugcgcaggaguuggugacagccagcaaaauaacccaacucgacgcagauaaguacguccuguuaggcgacacuaucgaauccgcucuggaugccauuaccucucagaaacacuauucggcuaugcaccuacucgagacaauguuucugaugaagcauugcgacuacuacaaaguguaugagcacaauagcggguacucccagaccaaguggcggcuuaucgccauugcaaacucauucgauaucuguacuaauacaccgacgcccaacuuuugcaaguguuugagugacucuagcugcuccaccacuacacugaauuucgccaccucaaugaacgcuacauauacuagcaaaguagaauuuuucaaucaugauuucacccucuuucuggacauauucgaggcggcauuuccuggaucugccacggcuuucuuauuuaagaaaauuaaggagaaaaacccauaccaagccuucgaaaugaugggcaagaucgcaaauaaauaucccaacaauaagcugcuuguugugaucuugaaguacggucaguauauggucgggcucucccacgccaguaccuaccagcugaaacaggaauggguggcuaagagccuaucucugacacgugcccaacgcacuggccucaaaauguccauggcaaacgcggagccuggaccagcuaccaaggaguguucagaugccaaaacaauugcaugccugacucccaaguuucaggucgaagugaacaaucuuaugaguugcggcgccagcccgaacuucaagaucuacguuaaaaccggggaguuguauaaggcucaugacagaaauucgguguggugucugaacgacaugcacugcuuaacgccuuacacacccgccaaugcagaaauuauaaccacuaugaaaaagauggauuguuggcaggacaacccaaaacagccuacagaugaguaugcuauccccaagagguccugccaaaugaaggaccggggacucuguaauucuggugccgauaaauggaagauuaucaaaugcgacaaccacaagcuguuuuacaccgaugcgcuugagcgacgcgacccagccagcauuguaggcucaaaucauuguuucagugaaaaaugccagaucgagagauaucccauaaacccuacuucccugaccaauugugaaugguuguacagggcuguccggccagaguauaucaagaagcucucucugcagacaauugaagaguacaaaaaggcaaucgccgauaaacuaacgcacacccugcagcucuaccauuuugcuccgcugcuugagaacuugccccacauuaagccuacuuauaaauacaucacagcccaagggaccuauacagcagacggaauagaaggcgcgagcauuacuaccuccaucccagcccugucagguacgagcgugggguucaagaucaaugcuaaagauggcacagacuuacucgauauuguuguguacauaaaggccagugucgugaagucuaucuauaaccacauuuacgacaccggacccacuaucaauauuaacuccaaacaugacgagcugugcaccggccaguguccuaagaaaaucccagcagaucccaacuggcuuacauuuagccaggaacgcacuucgagaugggggugcgaggaauuuggaugccuggcuauaaauaccgguuguguauauggcucaugccaggacgugaucaggacagagacgaagguuuaccguaaagccaacgaggaaaccgucaugcuaacuguguguauuacauacccggggcacaccuucugcacugaugugaaugcacaugagccuaagaucacagacgaacucgagcugcaauuuaagaccauugauaucaaaucuuugccaaaccuggucgccguuacgaaucacaaguuauauacuggacagauaaacgaccucggcaccuucggucagaugugugggaaugugcagaaaacaaacaccagucauacuggcgcuggaacacccaaguuugauuauaccugcuacuccgcgagccggaaagacauuaucauccgaagauguuacaauaacaauuaugauucuugcaggcugcuuaaccaagaaagcgaccuguuguucgaugacaaucacgagacacucgugguauacaacaauaagcgccugaacggcgagcuagcccugaaacuucuccugggggauauucaguauaaauuguacacugaaaacauggagcuggaauuagaggcaaagugugucggaugcgugggcuguuuugaguccuaccagugcaaucuccaaaucaccucaagucuggacgaaacggcucuuuaucugguuccugugagccacuuccaugaccggauacagauuaaaacaaccaagaaagauuacgccaugaagaucucuugcacuagagaccccggugauaaggccuccuuuagggucugugggaaaucauaugacuucaacuuucacaccgugccaaagaaugauaaaauugagguuaacgugggagacgaaacaaguuacaucaaggagaaagauaaucgcugcggccgaugguugugucggguacgugacgaaggucucagcgucauauucgagccucugaacaauuucuucggcaacuaucuaaauauguuccuguacauucuugggggaaucauccuccuguuuuuggcuuuauauauucugaugcccaugugcgcaagacucagggaugagcugaagcgcaacgaacggcuucaucagauggagaugaagaaaagauga

SEQ ID NO: 10914 - RNA, 4260 nt, Artificial Sequence
  derived and/or modified CDS sequence (opt3) from IACOV(BeAn314206)__JN572066.1__GP
augagagugaucgcccuguuccaccucgucaugguuauuaccgcuaaccccguguuucauaggugcuuccagggcgggcaacuuauacuggagaagaaaagccacguauccaugucugaauuuuguuugaaggacgaugugucaauggucaaaagugugguugaguacgaaaagacaaauaacagcaucgugggaacuaauaaagucuaucggcagugggugguauccgacuggaaguuaugccauccuauuaaggcagaggguggcgggaucaacauuaucgaaguugagaaagaucugacgauaaagucuaauaccuacaucuguacaacugacugcaccauuacaguggauaaagagaacgcccagaucauuuuccagaccucgaagcuaaaucacuuugaagucacuggaacaacccucucaacgggcugguucaaaacuaaggcggcugugacccuggaccaaacaugugagcauauccgcgugagcugcgguaagaaaaguauacaguuucacgccuguuuccgacagcacaugacuugcguccguuuucuucauagaucccuguugccagggucuauggcaaacagcauuugucagaauguugaacucaucauuaucaucgugcugacccugcucauuuucauaguauuaaacaucauugccaagacauauaucugcuaccugaugcuuccgauauuuaugcccauugcuuauaucuacggauggaucuauaauagguccuguaaaaagugcgugaacugcggcuuggcauaccacccuuucucaaauuguggcagucauugcgucuguggggccauuuuucaaaccagcgaucggaugcgcaugcacagagagucuggacugugcuccgguuucaaaucacuaaggguggcucggguucucuguaagagcaaaaguucuucccuggugaucgccauucuuagcucgcuguugauacucucuuucgucacgccaaucgagggccuggacuuagaagagaagaaguacucccugucagaucuccccgacauuuauacuaaagaacuuaacacacugagugagaagaucgcgaucaauuuuuacauuagcauaaccaacauguugaucacuauuauccuacugauuguggcauucugcucccacuguaucacaaacaaaauaguaaaguauaaagccuuucucugcaccgaaugugauauguaccauacguauaagaauauccgcuacaacggggacuucugcaauaaguguggaucuuguaccugcggcacaauggaggauccuaacuauacuaccaugcacaaaguuagcgaccugugccuugcugagccaaagcgaauuauccagaaaaagcugaugauuaucuugauaauuuuugugaucauugaaaauggugccugccucgcaucagcugaggaaaaauguuucaaggagcaugacuacaacaucgaaugcauagggccccugaucacaaugagaccuuguacuaagaaaaccauucaggaggucgccaggacauuagugaccgauaagcagaucgcgcaagaggacacugaaaagauugagcugcuaccagauaguaucguccaggccuggaauaugauagacaaccagcucaauuacgaucaaauguuucugauggaauaugcauuccuuaagcgggagugcuccuuuuucgaagaguuugagcacaacagcggagugaaucagauuauguggcguacgaucgcuaaaacaggccauuucgacaucugugccauuagaucuucacagcgcuuuugcaaguguaugagugaaagcguuuacugcaaggaugcuaacugggacaucgccaaugagaugaacgauaccuauuccuucaaaccguuguucuacaggcacgacgugaagcuguauucuaaaauuuuuaaggcagccuuccagggcacuacccucaaaacauacgaaaaguuucugaaugcuaaaaacaagaccgagcuuauaaacaugcugaagaaauuggggaagcgguuccccuauaauaaccuccugaugggauuuuuaaaauucggugagcugcuauuugaucucacucuguucgacgcgcuuccuaaggacaaaacaucgcgaacgagcuccaccacugcaaagcgcgaauacgagaauuugcaagaugccaagguaggcgaaccaacaucagaguguaaagacaugaagcugcuccagugcaucagucccagauaccaggucucuguggggagcguuauuaaaugcggagauaccgaaaagaaaaucuaugacuuucacacaccuguguacaagcuggcuacugaugagaccaagugguguagguucgacaaacauugcuuacacgagugggucccaauugauaacgcccggcuggaaaugcuuaagaaauugaauuguugguauacggaccccaccgagaugguggauaucuacacaacuucccgcaagucaugcagaaugauaaacaaaggcaccuguaauaucaagaacgcaccgaugacaguaaugcagugcgacgaugaccucauuuucuauacugaucauaggagcucugccgacacccaaggugacaucggggaauacugucugucccagaauugcgaugugagucguuauccuauuaacguuauggacggcaugacguguacaugggaguacaauaccgucaagcccaaauaccuaagcaagacugaacugaaaacacucgaggaguauaagcggacccugcaggauaaacuuucucacaacuuggaaguguaccacuuccauaugacugcuaauuuuccacacaucaagccuguguauaaauacauaaccgccggaggcgucgagacauccgacgggauugaaggagcauucauccugguugauuuacccgcgcucucagguacgagugugggccugaccgugcuuagcaaggacgauguaccacugauggacgucaucauuuauauaaagucggcugugaucaaagccacuuacaaccauauuuaugauacagggcccaccaucggaauuaauguuaagcacgaggaauugugcacaggcccuuguccacagaacaucccgcaucaagagcaguggcucacuuucucccaggagcgaaccucuagaugggguugcgaagaguuugggugccuggcagugggcgaaggaugugucuacggcagcugccaggacauaaucaaaaaggagacgaggguguacaaaaagguuucagaggaaauuaacgagaucacauucuguauuaucuuucaaaccaauacuuauugccagaccaugaacgccauagaaccccagauuacaccuagucuagaggugcaacuggaagggcucgauacuaagauccugccaaauauccuugcuuugcagaaccacaaacuguacuccggacagauuaaugacuuagguucuuucggccucgccugugggaacguacagcaagucaauaagaccaucuauggagcaggccagcccaaauuugauuaccugugccacggugcuaagcgcaaagacauaauugugcggaaguguuauaacaauaacuucgggagcugcaaacuucugacaaucgaggacaaucuaauuguggaggauaacuacaauacgaucaacgucauaaauaccaaacaucucauuggcacuguuaaguccaaacugaacuugggagacaucagauauaagcuguuuaacaaaaagccugaauuugaguuagaagcccacugugugggcugcguaggguguuuugcgaauuacaacugcgagaucaagauugaaucaacaaucgauaugaccugcccaauuagcggacccugugaguucuuucauaauaacauauucauccaggccgagcacacuaaauacgcuaugaagaugauuugcaaaaagcagccggaccaaacaaccgaguucacgaucugugauaaaaaguaucauuuuaucauugacacuguggaaaagcacgaucagauagaaaucgacgucggcgaucagaccaguuacauucucgagaaagacaauaggugcgguacauggauguguaaggugcuggaugaagggcuuucuguuaucuucgagccucugaaauugcuccugggaaacuauuuucacauggcaauugugaucauaaucggccuaauugcccuggcugucaucauuuacauccuucucccaauguucaugaagcugcgcgacaccuugaaagccaaugagauagcauaucagaaggaaaugaaaauuaaguga

SEQ ID NO: 10915 - RNA, 4305 nt, Artificial Sequence
  derived and/or modified CDS sequence (opt3) from ILEV(KO/2)__AY859372.1__GP
augcuguuccccaucauucuccuuaugauacagcuggugagcuccaccccuuugucuacaagaugcuuucacgagggcacuuuagucaaggaaaagaucucaacgaccaguauuagcgaguucugucugaaggacgauguuuccaugaucaaaucugaaauuacauaccaaaagaacgacacugggguguauggacauucgaaaaucuacaggaauuggauaguaaaggaguggaaggccugcaacccagugccgucagcugguggcagcaucaaugucauugaagugaacgaggauaugagucuagcaaccaaaaauuauaucuguacacgggacugcguuauuaccguggauaaggaggacgcccagaucgucuuucagacugauaaccucaaucacuucgaaguguccgggacaacccugucuagcggaugguuuaaaacgaaggcguccguaacucuugaccgcaccugugagcauauaaaaguuucaugcggcaagaagacagugcaguuccacgcuuguuuucgaaaccauaugaguugcguccguuucuuucacaauacuauucugcccgguuacauggccaccagcaucugucaaaacauugaauugaucaucauuauagugcucacaaucgcaauuuucaucaugcuggugauacugaccaaaacguauauuugcuaccucuuaaugccucuguuuaugccaaucgccuauuguuacgggugggcuuacaauaagucuugcaaaaagugcaacuguugcggacuugcauaucaccccuucacuaauuguggcuccuuuugcgucuguggcuugaaauucgaggccucagauagaaugaggauccaucgggagagcgggcugugccagggauacaagagucuacgcguugcuagaaggcucuguaaaucuaaggguuccagcuucgugauuucgauccugcuuucucuguuuauuuuguccuucguaacaccuauagaaggcaccaugacuaacuauccagaggaacggaaguacacacucgaggaaaucgccgacgugauugagggguuuuaucaggaggcgaaaaucaaggaauacaucgucuucuauucaaguauuuuugggagcuucauacugaucuccucuauguuaauucuguacaaacuccagaauaucaccuacuuucuuagcaaguucaacgugauguauugcucagaguguaguauguaccacuccaaaaagaacauuaaguaucugggcgauuuuacgaauaaaugcgguuucuguaccugcggggaauuggaggacgcagaaggacuaagcauccauaagguuacaaaacgcugcacuuacgccuaucaaaugaccuggacaaagauaauccuggcuacucuccugauucuucugaucggccagaacaccuugcucguggucucugcccaggcagauuguugggagaaaacagagauuaccaucgacugcauaggccccauuuuugcuccuaauacuuguaucaagcaggaagagaagacguacgccaaagaagcgcaaacacugguggaccagaacaagauuucacaggccgaugcaaaacaaguagacauguuaggggcuaccaucgaugacgccauaaaggcuauccgaagucagaaaacuuauaccacaaugcacaugcuggaggccauuuuccuaagcaaguacugcgauuacuauucccucuuugaacacaauucuggauacucgcaggguaaguggagacugaucgcaaaaaccgagagcuucgacauuuguuccaggcauacuacacaccauuucugccgguguaugucagaugagacgaagugcaaaaacggcgacugggauuuugccggggaaaugaauaguaccuaucacucuaagagcaacuuccuuuugcaugaccugcgucucuuuuacaaaaucuauuccgcugcguucccaggacugucagaggcaaugcuuuacaaguuucugagcgaaaaagauacuacaaaugccauaaaguugcucgagaagcuguucaccaaauauucuuacaacaauuuacugguuggcauucuacgcuuugguaaguuccucuuuuccaugaguaucuucaacacaacugagcugggaggcgcucagaaagccaugauccuuagaccgaccgacgaauugaggacgaccuacagcggaaagcaagagucucuguccaauucaguggucggcgaacagacaagugacugugugaacaugaaaaagauuagcugcaucucgccccgguuuaauauuccucucuccucuaugauagcaugugggaaccagccaaacuaucagaucuacaaggagcccagcaaauauuacaagucaaauaacaaaccuaauacuuggugcaacaaggauauucacugccugaaugacuucgaaaguaucgaucaauccgccuuagaccgacugaaaaccaugacauguuuucuuauugauccaaucacuaccgaggacgucuauucuauagcuauccacagcugcaaggugaaggauaaaggacaguguacgauucgcgacaagaaauggaacaucauuaagugcgauuccgaguugcucuacuauacagaccauagagaaggugaggauaccggcaaugaaaucgggcacuacugucugucacauaaaugcggaacugacagguaccccauaaacccggagauuaucaaggauuguaucugggaguuccggagccgcaagagugaauauauuaauagaguugaccuagagucucuggaagaguucaaaagggcccucuccgacaagcugacacacacccuuacuauauacaacuuuaaaccuaccgcaaauuugccccacaucaagccaauuuauaaauacaucacagcgcugggcguggaaaacagcgaugguuuagaggcugccuauauucucacgucgaucccugcacuugggggcaccucaauaggauacaauaucaugacuaaggacaacuuccccguaauggaugucauuaucuaugugaaaucugccguuauucagacaaccuacaaucauaucuacgacacaggcccaacuauagggauuaacaguaagcacgaugaaaagugcaccggauccuguccccagaacaucacgcaugaccaaaauuggcugacauuuagccaggagcgugcuucucggugggguugcgaggaguucggcugucuggccaucaacaccgggugcguguuuggaagcugccaggauaugauucgauccgacacuaaagucuauaagaaagcauuggaagaaaccgugguacucacaguguguaucaauuacccuggcaacacuuucugcaccgagguuaauucagucgagacaaagaugacggaugacguggaacugcaguuuaaaaccguggauacuaagacacuaccaaaccugcucgcugucaccaaucacaagcuguauaguggucaaauaaacgaccuugggagcuucucucagauguguggcaauguucagaaaacuaacuccacagugaugggagccggcaccgugaaguuugauuacauuugccauggggcgucaagaaaagacaucauuaucaggcgcuguuauaugaauaacuacgccaguugcagcuugcugaaggaggaaaaagacuuaauauucgcugauaaucacgagacgauuacuguauccaacucuaagcaccucgucggagaacugcaaaucaaacuuaugcugggcgacauccgguauaaacuauuugcagagagaccggagcucgaaguggaugccaaguguguugguugccccucguguuucgagagcuacucaugcaauuuccagauugugaccaacaucgacacagucuguacccuggaagggccuugcacuauuuuucauaacaggauaaucauuuccaguacaaaacagucuuacggaaucaagaugagcugcccaaccaaacccaaucacaucgagaaguucaagauuuguaaccaugaauaugauauauuguuugacacaguggcuaaaaaugauaagaucgagauugacacuggcgaucagacccuguucguucgcgagaaagacacgcgaugcaagacaugguuaugucgggugaaagaugaagguaucuccguaauuuuugagccucuccgugccuucuuuggcucauacuucucuaucauauuuuauaucauucuggcagcgauccuuauuuucgucgggguguacaucuuucugccaauguucaugagauugagggacgugcucaagcgcaacgaacaccuguaucuacaagagauaaagcauaaauga

SEQ ID NO: 10916 - RNA, 4305 nt, Artificial Sequence
  derived and/or modified CDS sequence (opt3) from ILEV(R5964)__KF234074.1__GP
augcuguuccccaucauucuccuuaugauacagcuggugagcuccaccccuuugucuacaagaugcuuucacgagggcacuuuagucaaggaaaagaucucaacgaccaguauuagcgaguucugucugaaggacgauguuuccaugaucaaaucugaaauuacauaccaaaagaacgacacugggguguauggacauucgaaaaucuacaggaauuggauaguaaaggaguggaaggccugcaacccagugccgucagcugguggcagcaucaaugucauugaagugaacgaggauaugagucuagcaaccaaaaauuauaucuguacacgggacugcguuauuaccguggauaaggaggacgcccagaucauauuucagacugauaaccucaaucacuucgaagucuccgggacaacccugucuagcggaugguuuaaaacgaaggcguccgugacucuugaccgcaccugugagcauauuaaaguaucaugcggcaagaagacaguucaguuccacgcuuguuuucgaaaccauaugaguugcgugcguuucuuucacaauacuauccugcccgguuacauggccaccagcauuugucaaaacaucgaauugaucauuauaaucguccucacaauugcaaucuucauaaugcuggugauucugaccaaaacguauaucugcuaccucuuaaugccucuguuuaugccaaucgccuauuguuacgggugggcuuacaauaagucuugcaaaaagugcaacuguugcggacuugcauaucaccccuucacuaauuguggcuccuuuugcguguguggcuugaaauucgaggccucagauagaaugaggauucaucgggagagcgggcugugccagggauacaagagucuacgcgucgcuagaaggcucuguaaaucuaaggguuccagcuucguuaucucgauucugcuuucucuguuuauauuguccuucgugacaccuaucgaaggcaccaugacuaacuauccagaggaacggaaguacacacucgaggaaauugccgacguaaucgagggguuuuaucaggaggcgaaaaucaaggaauacauuguguucuauucaaguauauuugggagcuucauccugauuuccucuauguuaauccuguacaaacuccagaauauuaccuacuuucuuagcaaguucaacgucauguauugcucagaguguaguauguaccacuccaaaaagaacaucaaguaucugggcgauuuuacgaauaaaugcgguuucuguaccugcggggaauuggaggacgcagaaggacuaagcauacauaaggugacaaaacgcugcacuuacgccuaucaaaugaccuggacaaagaucauucuggcuacucuccugauccuucugauuggccagaacaccuugcucguugugucugcccaggcagauuguugggagaaaacagagaucaccauagacugcauuggccccaucuuugcuccuaauacuuguauuaagcaggaagagaagacguacgccaaagaagcgcaaacacuggucgaccagaacaagaucucacaggccgaugcagagcaaguggacauguuaggggcuaccauagaugacgccaucaaagcuauucgaagucagaagacuuauaccacaaugcacaugcuggaagccaucuuccuaagcaaauacugcgauuacuauucccucuuugagcacaauucuggauacucgcaggguaaguggagacugauugcaaagaccgagagcuucgacaucuguuccaggcauacuacacaccauuucugccgguguaugucagaugaaacgaaaugcaagaacggcgacugggauuuugccggggagaugaauaguaccuaucacucuaaaagcaacuuccuuuugcaugaccugcgucucuuuuacaagauauauuccgcugcguucccaggacugucagaagcaaugcuuuacaaauuucugagcgagaaggauacuacaaaugccauuaaauugcucgagaagcuguucaccaaguauucuuacaacaauuuacugguaggcauccuacgcuuugguaaauuccucuuuuccaugaguaucuucaacacaacugaacugggaggcgcucagaaggccaugauucuuagaccgaccgacgaguugaggacgaccuacagcggaaaacaagaaucucuguccaauucaguugugggcgagcagacaagugacugugucaacaugaagaaaaucagcugcauuucgccccgguuuaauauaccucucuccucuaugaucgcaugugggaaccagccaaacuaucagauuuacaaggaacccagcaaguauuacaaaucaaauaacaagccuaauacuuggugcaacaaagauauccacugccugaaugacuucgagaguauugaucaauccgccuuagaccgacugaagaccaugacauguuuucuuaucgauccaauaacuaccgaggacguguauucuaucgcuauucacagcugcaaagucaaggauaagggacaguguacgauccgcgacaaaaaguggaacauuaucaaaugcgauuccgaauugcucuacuauacagaccauagagagggugaagauaccggcaaugagauagggcacuacugucugucacauaagugcggaacugacagguaccccauuaacccggaaaucaucaaagauuguauuugggaguuccggagccgcaagagugaguauauaaauagaguggaccuagaaucucuggaggaguucaagagggcccucuccgacaaacugacacacacccuuacuaucuacaacuuuaagccuaccgcaaauuugccccacauuaaaccaaucuauaaguacauuacagcgcugggcguugaaaacagcgaugguuuagaagcugccuauauccucacgucgauaccugcacuugggggcaccucaaucggauacaauauuaugacuaaagacaacuuccccgugauggauguaaucauuuaugucaagucugccgugauccagacaaccuacaaucauauauacgacacaggcccaacuauugggaucaacaguaaacacgaugagaagugcaccggauccuguccccagaacaucacgcaugaccaaaauuggcugacauuuagccaggagcguaccucucggugggguugcgaagaguucggcugucuggcuauuaacacugggugcguuuuuggaagcugccaggauaugauccgauccgacaccaagguguauaaaaaggccuuggaagagacagucgugcucacuguauguauaaauuacccuggcaacaccuucugcacagagguuaauucaguggaaacgaaaaugaccgaugacgucgagcugcaguuuaagacuguggauacaaaaacccuaccaaaccugcucgcagugacuaaucacaagcuguauaguggucaaauuaacgaccuugggagcuucucucagauguguggcaauguccagaagacaaacuccaccguuaugggagcuggcacggugaaauuugauuacaucugccauggggccucaagaaaggacauuaucauaaggcgcuguuauaugaauaacuacgcgaguugcagcuugcugaaagaagagaaggacuuaauuuucgccgauaaucacgaaacuaucaccguguccaacucuaaacaccucguaggagagcugcaaaucaaacuuaugcugggcgacauucgguauaagcuauuugcugagagaccggaacucgaggucgaugcaaaauguguggguugccccucguguuucgaaagcuacucaugcaauuuccagaucguuacaaacauugacaccguguguacucuggaggggccuugcacaauauuucauaacaggaucauuaucuccaguaccaagcagucuuacggaaucaaaaugagcugcccaacaaagcccaaucacauugaaaaauucaagauauguaaccaugaguaugauaucuuguuugacacugucgccaagaaugauaaaauugagaucgacaccggcgaucagacgcuguucgugcgcgaaaaggacacacgaugcaaaaccugguuaugucggguuaaggaugaggguauuuccgugaucuuugaaccucuccgugcuuucuuuggcucauacuucucuauaaucuuuuauauuauccuggccgcaauucuuaucuucguaggggucuacauauuucugccaauguucaugagauugagggacgugcucaaacgcaacgagcaccuguaucuacaagaaauuaagcauaaguga

SEQ ID NO: 10917 - RNA, 4305 nt, Artificial Sequence
  derived and/or modified CDS sequence (opt3) from MAGV__AY286443.1__GP
auggagcugcucaucauuauacuucuguugggcagcgccgcuuccucucccaucucaaccagaugcuuccacgggggacaguuaauugcagaaaguaagagcgccacauccaucucugaguuuugucugaaagacgaugugucgaugauuaagucagaagucacuuacaucaaaaacgacacggguauauauggccauaauaagguuuucaggagcuggaccaucaaagauuggaagcuaugcaacccuauuccaacagcugggggaaguaucaaugugauugagguaaacuccgaccucucucuggcgacucgggccuacguguguagccgcgauugcaccaucacaauagacaaggaagaugcacaaauuaucuuucagaccgacaaacuuaaucacuucgaggucuccggcacuacacugucaagugguugguuuaagaccaaagccagcgugacguuggaucgaacuugugagcauauuaagguuaccugcgggaaaaagucucuccaguuccacgcuuguuuuaagcaucacauguccugcauccguuucuuucaccauacaauccugccgggaacuauggugucaagcaugugucagaacauugaacugauaaucauuaucggccucaccuuagucauauucauucugauggugauccuuacaaaaaccuauaucugcuacuugcugaugcccguauuuaugccuguugcauauauuuacggcugggccuauaauaagaguuguaaaaagugcaacugcugugggcuagcuuaccacccauucacgaauugcggaucucauugugugugcggucucaaauuugaggccuccgacagaaugaggcugcaccgggaaagcggccuuugucaaggguacaagucgcugcgcaucgcgagaauguugugcaaaucuaagggauccucacucgucauuaguggccuguuaagcaugcugcuccuuuccuucauaacucccaucgaggguacacugaccaacuauccuaaugagaagcaguacacuuuggaagagauugcagaugugguggaagggaucaucacagagcagcaccuaaaagaauaugucguuuucuacaccucucuguuuggaggccucauucugcuucugacguugauacucagcaucaccauuaacaaggugacagaccuguuagccucaacuaauguaaucuauugugaggagugcaguauguaccauuccaaaaagggcauuaaauauaacggggauuucaccaauaaguguggauuuugcacauguagcgaacaggaggacguggaaggugucaucauacacaaggugucuaggaaaugcacuuacaaguaccaacugaaauggguucgggugaucaugauuauccuagcucuccugcuuaccauucagaacacagucuugaucguggccgcagagguagacugcuggaccaagaaaucaauagaaauugauuguaucggcccacugcucaacauugggaguugcacugacaagagcucccgcacguaugagacagagguuaauaagcuggugcgacagucuaaagucacccaugcugaugccgaacagaucucgauacuuggaagcacucuggacaacgcgaucaaggccgugagaucccagaaaaccuacgagacaaugcacuucuuggaaaccgucuuucucaugaagaauugugauuauuacaacucauucgagcauaauaguggcuauucucaaacuaaauggaggcugauugcaaagacaagccacuuugacaucugcucccggcacucaacgcaucacuucugucguugcgugaacgaagguaccaagugucagaauggggauugggacuuugcuggcgagaugaacgauacuuacaauagcaaaaacgacuucuauuuacaugaucuggaccuauuuuacacacuccuggagaaugccuuccccggaaccacagaaucucuuuucuaccaauugcugcagaagaaaaacacuaccggcgcuuccaagcuccuggggaaauuaauuacgaaguauggaaauaacaauauguucguugagaucuggaaauucggucaguaccugcuuaaguugccuuauauaaacgacaccgaacucaguacagaucgcaagagcacuauuaucaaaucucagcaagugcuguccagaucacagaccggcaggcaggagagucuaagcucggccacaccagggacugcaaccaaggagugcuccaacgccaaagacaucggauguauuucuccgcgguuuggcauccccauugguaaucugacggcuugcggggauagcccuaacuacaagguauauaaaacaccagaaaagauauacaagucaaauaaccgaggcgaggucugguguagugacgaugugcacugccucaccgacuucgaacccgcggaggaagagguugugaaucgcaucaaacagaugacuugcuuucugacagaugucaccacuaagaccgacguguucuccguagcaauuucuacauguaaaaugguggauaagggaguuugcacggucaacgacgccaaauggaauauccuuaaguguaacagcggcuuguauuacuuuaccgaucacagagggggacaagacacugguaaugauuucggcgaguacugcauuucccauucauguaacacagaaagguuuccuaucaauccagacgugcugaaggacugcauaugggaguaucacagccggaaaaguaaguacaucucuaccguguccuuagaaagccucgaugaguuccgcagagcuaugucggacaaacugucacauacacuuaugauuuauaacuuuaagcccacugccaaucugccgcacaucaaaccuaccuacaaguucauuacggcaaacgggaucgaaaauucugauggaauagacagugccuauauuuuguccagcauccccgcucucggcgguaugucugucggguacaacauccagacaaaggauaacuuuccacugcuagacauuauaguuuucaucaaaagcgccauuaucaagaccacuuauaaucauauuuacgauaccggcccuacaaucggaauaaacacucagcacgacgagcacuguaccggccccugcccaacacugaucccccauaaagagaauuggcucacguuuucccaggaaaggaccucacguugggggugugaggaauuuggaugccuggcaauuaacacuggcuguguguucgguaguugccaagauaucauucacccugaggcgaagguguaccggaaagcuaucgaagaggagguaguccuuacagugugcauaaccuuuccagggaauacuuauuguacagaaauuaacgccaucgagccgaagaucaccgacgaaauugaguugcaguucaaaacgguugauacuaagacccugcccaauuuacucauggugcagaaccauaagcuguacagcggacagaucaaugaccuuggcucuuuuucccaagguugcggcaacguccagaaaacaaaucagucagugauaggggcaggaaccgccaaguucgauuauguuugucacggcgcuagucgaaaagacgugauuguaagaaggugcuacaacaauaacuaugagagcuguaagcugcuaaaagaagagacuucccucaucuuugccgacaaucaugaaacacuggaggucgcaaacaccaagcacuugauuggggaacugcaauucaagaucauguuaggagauauacgcuacaaaucuuuugcugagucgccugagcucgaaguggacgccaagugcgugggcuguccaagcugcuucgagucauauuccuguaacuuucagauugucacaaauaucgauacuguuugcaguguggacggucccuguacccuguuccacaaccggcuuaucauuucugcgacgaaacagagcuacggguuuaagauguccugcccuagaaaaccagaacccacagaggaguuccagaucugcaauaggaaguacaacguacuguucaccacuauugauaagaaugacaaaauagaaaucaacaccggagaucaaacaucauauauuuacgagaaggacaaucgcuguaaaacuugguugugccgagugcgggaugaaggcaucucugucaucuuugagccgcucaaggccuucuuugguagcuauuucaguauuauauuuuacgugguugugggcaucauuguccuguuccuaaccaucuauauuuuucugccuauguucuuuaaacuucgugacauccucaagagaaacgaauaccuguauuugcaggagcugaagcauaaauga

SEQ ID NO: 10918 - RNA, 4305 nt, Artificial Sequence
  derived and/or modified CDS sequence (opt3) from MAGV(ts8)__AY286444.1__GP
auggagcugcucaucauuauacuucuguugggcagcgccgcuuccucucccaucucaaccagaugcuuccacgggggacaguuaauugcagaaaguaagagcgccacauccaucucugaguuuugucugaaagacgaugugucgaugauuaagucagaagucacuuacaucaaaaacgacacggguauauauggccauaauaagguuuucaggagcuggaccaucaaagauuggaagcuaugcaacccuauuccaacagcugggggaaguaucaaugugauugagguaaacuccgaccucucucuggcgacucgggccuacguguguagccgcgauugcaccaucacaauagacaaggaagaugcacaaauuaucuuucagaccgacaaacuuaaucacuucgaggucuccggcacuacacugucaagugguugguuuaagaccaaagccagcgugacguuggaucgaacuugugagcauauuaagguuaccugcgggaaaaagucucuccaguuccacgcuuguuuuaagcaucacauguccugcauccguuucuuucaccauacaauccugccgggaacuauggugucaagcaugugucagaacauugaacugauaaucauuaucggccucaccuuagucauauucauucugauggugauccuuacaaaaaccuauaucugcuacuugcugaugcccguauuuaugccuguugcauauauuuacggcugggccuauaauaagaguuguaaaaagugcaacugcugugggcuagcuuaccacccauucacgaauugcggaucucauugugugugcggucucaaauuugaggccuccgacagaaugaggcugcaccgggaaagcggccuuugucaaggguacaagucgcugcgcaucgcgagaauguugugcaaaucuaagggauccucacucgucauuaguggccuguuaagcaugcugcuccuuuccuucauaacucccaucgaggguacacugaccaacuauccuaaugagaagcaguacacuuuggaagagauugcagaugugguggaagggaucaucacagagcagcaccuaaaagaauaugucguuuucuacaccucucuguuuggaggccucauucugcuucugacguugauacucagcaucaccauuaacaaggugacagaccuguuagccucaacuaauguaaucuauugugaggagugcaguauguaccauuccaaaaagggcauuaaauauaacggggauuucaccaauaaguguggauuuugcacauguagcgaacaggaggacguggaaggugucaucauacacaaggugucuaggaaaugcacuuacaaguaccaacugaaauggguucgggugaucaugauuauccuagcucuccugcuuaccauucagaacacagucuugaucguggccgcagagguagacugcuggaccaagaaaucaauagaaauugauuguaucggcccacugcucaacauugggaguugcacugacaagagcucccgcacguaugagacagagguuaauaagcuggugcgacagucuaaagucacccaugcugaugccgaacagaucucgauacuuggaagcacucuggacaacgcgaucaaggccgugagaucccaaaagaccuacgagacaaugcacuucuuggaaaccgucuuucucaugaagaauugugauuauuacaacucauucgagcauaauaguggcuauucucagacuaaauggaggcugauugcaaagacaagccacuuugacaucugcucccggcacucaacgcaucacuucugucguugcgugaacgaagguaccaagugucagaauggggauugggacuuugcuggcgagaugaacgauacuuacaauagcaaaaacgacuucuauuuacaugaucuggaccuauuuuacacacuccuggagaaugccuuccccggaaccacagaaucucuuuucuaccaauugcugcagaagaaaaacacuaccggcgcuuccaagcuccuggggaaauuaauuacgaaguauggaaauaacaauauguucguugagaucuggaaauucggucaguaccugcuuaaguugccuuauauaaacgacaccgaacucaguacagaucgcaagagcacuauuaucaaaucucagcaagugcuguccagaucacagaccggcaggcaggagagucuaagcucggccacaccagggacugcaaccaaggagugcuccaacgccaaagacaucggauguauuucuccgcgguuuggcauccccauugguaaucugacggcuugcggggauagcccuaacuacaagguauauaaaacaccagaaaagauauacaagucaaauaaccgaggcgaggucugguguagugacgaugugcacugccucaccgacuucgaacccgcggaggaagagguugugaaucgcaucaaacagaugacuugcuuucugacagaugucaccacuaagaccgacguguucuccguagcaauuucuacauguaaaaugguggauaagggaguuugcacggucaacgacgccaaauggaauauccuuaaguguaacagcggcuuguauuacuuuaccgaucacagagacgggcaagauacuggaaaugacuucggugaguacugcauuucccauucauguaacacagaaagguuuccuaucaauccagacgugcugaaggauugcauaugggaguaucacagccggaaaaguaaguacaucucuaccguguccuuagaaagccucgacgaguuccgcagagcuaugucggauaaacugucacauacacuuaugauuuauaacuuuaagcccacugccaaucugccgcacaucaaaccuaccuacaaguucauuacggcaaacggcaucgaaaauucugacgggauagauagugccuauauuuuguccagcauccccgcucucggaggcaugucugucgguuacaacauccagacaaaggacaacuuuccacugcuagauauuauaguuuucaucaaaagcgccauuaucaagaccacuuauaaucauauuuacgacaccgggccuacaaucggcauaaacacucagcacgaugagcacuguaccggacccugcccaacacugauccuccauaaagagaauuggcugacguuuucccaggaaaggaccucacguuggggcugugaggaauuugggugccuugcaauuaacacuggauguguguucggcaguugccaagacaucauucaccccgaggcgaagguguaccggaaagcuaucgaagaggagguagucuugacagugugcauaaccuuuccugguaauacuuauuguacagaaauuaacgccaucgagccaaagaucaccgaugaaauugagcugcaguucaaaacgguugacacuaagaccuuaccgaaucuccugauggugcagaaccauaaacuuuacagcgggcagaucgaugaccugggaucuuuuucccaaggcugcgguaauguccagaaaacaaaccagucagugauaggcgcagggaccgccaaguucgacuauguuugucacggagcuagucgaaaagaugugauuguaagaaggugcuacaauaacaauuaugagagcuguaagcuacucaaagaagagacuucccugaucuuugccgacaaccaugaaacauuggaggucgcaaauaccaagcaccugauuggcgaauuacaauucaagaucaugcucggggauauacgcuacaaaucuuuugcugagucgcccgagcuggaaguggacgccaagugcgugggauguccuagcugcuucgagucauauuccuguaacuuucagauugucacaaacaucgauacuguuugcaguguggacggcccauguacccuuuuccacaaucggcugaucauuucugcgacgaaacagagcuacgguuuuaagauguccugccccagaaaaccugaaccaacagaggaguuccagaucugcaacaggaaguacaauguauuguucaccacuauugauaagaacgacaaaauagaaaucaauaccggggaucaaacaucauauauuuacgagaaggacaaccgcuguaaaacuuggcucugccgagugcgggaugaaggaaucucugucaucuuugagccccugaaggccuucuuuggcagcuauuucaguauuauauuuuacgugguuguggguaucauuguccuauuccugaccaucuauauuuuucuuccgauguucuuuaaacuccgugacauccugaagagaaaugaauacuuguaucugcaggaguuaaagcauaaauga

SEQ ID NO: 10919 - RNA, 4311 nt, Artificial Sequence
  derived and/or modified CDS sequence (opt3) from MAGV(AG83-1746)__KX100113.1__GP
augaagaugauccugcucauuauaauccuuugcgugaaccuggccgcugcaaaucccgucgccaccagauguuuccacggcgggcaguugauugcggagacaaggagcgcuacuuccaucucugaauuuugcuuaaaagacgauguuucaaugauuaagagugagaucacguacaccaaaaacgacacaggaauauucggucauagcaagaucuauaaauccuggcugauuaaggauuggaagcuauguaauccugugccaacugccggcgggucuaucaacguaauugaaguuaauucggaccucucacugaccacaaaagcauacgucugcagccgggauuguaccaucacuauagacaaggaggaagcccaaauuaucuuucagacagauaaacuuaaccacuucgaggugaguggaaccacgcuguccucuggcugguuuaagacuaaagcuagcguuaccuuggaccgcacaugcgagcauauuaaggugacuugugguaagaaaacccuccaguuccacgcaugcuuucgacaucacauguccuguguccguuucuuucacaauacaauccugccggggaccauggugaacucaaugugccagaauaucgaacugauuauaauccucggauuaacgcugauuaucuucacucuuaugguaauauugacaaagaccuauauuuguuacauccugaugccccuauuuaugccuaucgccuaugcuuacggcugggccuauaacaaaaguugcaagaaaugcaauuguugcggccucgcguaccauccauucacuaacugugggagccacugcguuuguggacugaaguuugaggcaucugauagaaugaggauucaucgggaauccggucuuugccaaggcuacaaaucacugcgcaucgccagauugcucuguaagagcaaggggaguucucugauuauauccacauuacugagcaugcuccuucugucguucaucacccccauugagggaacgaugaccaauuauccugagacaaggcaguacucuuuggaagagaucgcugacguggucgaaggccuacuguccgagcagaacaucaaagaauaugugguguucuacacuucacucuuugguagucugauucuucuguuggccuucauacucagcaucacccugacaaaggucacuaaugcauuagcuaaaaccaacguuauuuauugcgaggaguguuccauguaccacgccaagaaagggaucaaguauaacggagauuuuacaaauaagugcggcuucuguaccugcgacgaacaggaggaugaagagggcauuaucauacacaaagugucuaagaaaugcacuuaccgguaccaacugcagugggcgaagaucauuaugaucauucuaguaaugcuccugaugaugcagaacacgauccuuauaguggccgcagaaacagacuguuggaccaaaaauagcuuggagcuggacugcauugggccacuccugacuaucucagauuguaguaacaaggaguccaagaauuaugaagaggaagcugccaaacuugucagccagucuaagauuacccaagcugacgccgaacaggugacaauccugggaaacaccauagauacugcauugaaagccauccgcucacagaagacauaccaaacgaugcaucuccuggaaaguguguuuuuaaugaaaaauugcgacuauuacagcuccuucgagcacaacucugguuauucgcaggcuaaguggcgacugauugcgaagaccagccauuuugauaucuguuccagacacucaaugcaucacuucuguaggugcguggcagacggcacuaaaugccagaaugggaacugggauuuugccggagagaugaauaacacauacaguaccaagaaugacuucuaucuacacgaucucaaccuguuuuucacacuucaugaaacugcuuuucccggcaccacggagucuuuguucuaccagcugauugccaaaaagaauaccacaggugcaagcaaacuccuggggaaguuaaucacuaaauacggcaacaacaagcuguucgucggaauauggaaguuuggccaauaucuuuugacccucccuuacgugaauacaacugaacuguccaaaacccggaaggagacgauucuaaaaccacaccagauccugacacguucacaagggggacgcccggagagcaugucuuccgccgaaguaggucagaccgcuaaggagugugccaacgcaaagaauguuggcugcaucagucccagauucggggugccuauuggaaaccucacugcguguggcaauagcccaaacuauaagaucuacaagacacccaauaaaauuuauaagucuaacaauaggggugaagucuggugcuccgaggacgugcauugccuggcugauuuugaaccugccgacaccgaggucgugaacaaaguuaagaaaaugacuuguuuccuuucagacgugaauacccgggcagauauauuuaguaucgccauuagcgcuugccgaaugguagacaagggggucuguacagugaacggcgccaaguggaauaucuugaaaugcgagucgggacuguacuauuucacggaucaccgcgaaggccaggacaccgggaacgauuuuggagaguacuguauuucccacucuugcaauacugaaagauacccaaucaaccccgacauauuaaaggaguguaucugggaauaucauagcaggaaaucaaaguacauuaguacaaucaaccucgagucccuggaggaguucaaacgggcaaugucugauaaacuuagccacacccugaugguuuauaauuuuaagccgacagcuaacuugccucauauuaaacccuccuacaaguucaucacugccaaugguauagagaacucagacggccucgaaagcgcguauauucugaguucuaucccagccaucgggggaauguccauuggcuacaauauacagaccaaagauaacuuuccucuacuggaccucaucguguucgucaagagcgcugugauuaaaacgacauauaaucacaucuacgauaccggucccacuauugggaucaacaccaaucaugacgagcacugcacaggcccaugucccacuauaaucccucacaaggaaaacuggcugaccuuuucgcaggagcgcacaucaagauggggaugcgaggaguucggcugucuugcaauuaauacggggugcguauucggaucuugccaggaugugauccauccagaaaccaaaauuuacaggaaggccguugaagaggaggucguguugacuguguguaucaacuuuccgggcaauacauucugcaccgaaauaaacgcuauugagcccaagaucacugacgaaaucgagcugcaauuuaaaacagucgacaccaagacguuaccuaaucuccuggccguucagaaccacaaacuuuauaguggucagauuaacgaucugggguccuucagccagggauguggcaaugugcaaaagacuaaccagucuauccuaggugcaggcaccgugaaauuugacuacguaugccauggggcgagccguaaggauauaauuguccggcgauguuauacaaauaacuacgacuccugcaagcuccugaaagaagagagaucauugaucuucgccgauaaucacgagacccuggaaguggcuaacacuaggcauuuaauuggagagcuccaguuuaagaucaugcugggcgacauacgcuauaaagccuucgcagaaaagccagagcuugaaauugaugcuaaauguguugggugccccaguuguuuugagagcuacucuugcuccuuccaaaucgugacaucaaucgacaccgucuguaguguggagggaccuugcacacuguuucacaaucggauuaucauuacugccgcaaagcagagcuauggcguuaagauguccugcaaaaccaagccaggucccguggaagaguucagaauauguaacaggaauuaccgcguaucuuucgccacgaucgauaaaaacgacaagauugaaaucaauacaggggaucagaccucguacaucgucgagaaagacagccgaugcaagacuugguugugucgggugcgugaugaaggaauuucagugauauuugagccgcucaaggcuuucuuuggcuccuauuucagugucgcguuuuacaucauuaucgguauugccgcacuguuccuaaucauauauaucuuucugccuauguucuuuaaacuuagagacguucucaagaaaaacgaguaccuguauuugcaggaacugaagcacaaauga

SEQ ID NO: 10920 - RNA, 4305 nt, Artificial Sequence
  derived and/or modified CDS sequence (opt3) from MAGV(BeAr 7272)__KX100104.1__GP
auggagcugcucaucauuauacuucuguugggcagcgccgcuuccucucccaucucaaccagaugcuuccacgggggacaguuaauugcagaaaguaagagcgccacauccaucucugaguuuugucugaaagacgaugugucgaugauuaagucagaagucacuuacaucaaaaacgacacggguauauauggccauaauaagguuuucaggagcuggaccaucaaagauuggaagcuaugcaacccuauuccaacagcugggggaaguaucaaugugauugagguaaacuccgaccucucucuggcgacucgggccuacguguguagccgcgauugcaccaucacaauagacaaggaagaugcacaaauuaucuuucagaccgacaaacuuaaucacuucgaggucuccggcacuacacugucaagugguugguuuaagaccaaagccagcgugacguuggaucgaacuugugagcauauuaagguuaccugcgggaaaaagucucuccaguuccacgcuuguuuuaagcaucacauguccugcauccguuucuuucaccauacaauccugccgggaacuauggugucaagcaugugucagaacauugaacugauaaucauuaucggccucaccuuagucauauucauucugauggugauccuuacaaaaaccuauaucugcuacuugcugaugcccguauuuaugccuguugcauauauuuacggcugggccuauaauaagaguuguaaaaagugcaacugcugugggcuagcuuaccacccauucacgaauugcggaucucauugugugugcggucucaaauuugaggccuccgacagaaugaggcugcaccgggaaagcggccuuugucaaggguacaagucgcugcgcaucgcgagaauguugugcaaaucuaagggauccucacucgucauuaguggccuguuaagcaugcugcuccuuuccuucauaacucccaucgaggguacacugaccaacuauccuaaugagaagcaguacacuuuggaagagauugcagaugugguggaagggaucaucacagagcagcaccuaaaagaauaugucguuuucuacaccucucuguuuggaggccucauucugcuucugacguugauacucagcaucaccauuaacaaggugacagaccuguuagccucaacuaauguaaucuauugugaggagugcaguauguaccauuccaaaaagggcauuaaauauaacggggauuucaccaauaaguguggauuuugcacauguagcgaacaggaggacguggaaggugucaucauacacaaggugucuaggaaaugcacuuacaaguaccaacugaaauggguucgggugaucaugauuauccuagcucuccugcuuaccauucagaacacagucuugaucguggccgcagagguagacugcuggaccaagaaaucaauagaaauugauuguaucggcccacugcucaacauugggaguugcacugacaagagcucccgcacguaugagacagagguuaauaagcuggugcgacagucuaaagucacccaugcugaugccgaacagaucucgauacuuggaagcacucuggacaacgcgaucaaggccgugagaucccagaaaaccuacgagacaaugcacuucuuggaaaccgucuuucucaugaagaauugugauuauuacaacucauucgagcauaauaguggcuauucucaaacuaaauggaggcugauugcaaagacaagccacuuugacaucugcucccggcacucaacgcaucacuucugucguugcgugaacgaagguaccaagugucagaauggggauugggacuuugcuggcgagaugaacgauacuuacaauagcaaaaacgacuucuauuuacaugaucuggaccuauuuuacacacuccuggagaaugccuuccccggaaccacagaaucucuuuucuaccaauugcugcagaagaaaaacacuaccggcgcuuccaagcuccuggggaaauuaauuacgaaguauggaaauaacaauauguucguugagaucuggaaauucggucaguaccugcuuaaguugccuuauauaaacgacaccgaacucaguacagaucgcaagagcacuauuaucaaaucucagcaagugcuguccagaucacagaccggcaggcaggagagucuaagcucggccacaccagggacugcaaccaaggagugcuccaacgccaaagacaucggauguauuucuccgcgguuuggcauccccauugguaaucugacggcuugcggggauagcccuaacuacaagguauauaaaacaccagaaaagauauacaagucaaauaaccgaggcgaggucugguguagugacgaugugcacugccucaccgacuucgaacccgcggaggaagagguugugaaucgcaucaaacagaugacuugcuuucugacagaugucaccacuaagaccgacguguucuccguagcaauuucuacauguaaaaugguggauaagggaguuugcacggucaacgacgccaaauggaauauccuuaaguguaacagcggcuuguauuacuuuaccgaucacagagacgggcaagauacuggaaaugacuucggugaguacugcauuucccauucauguaacacagaaagguuuccuaucaauccagacgugcugaaggauugcauaugggaguaucacagccggaaaaguaaguacaucucuaccguguccuuagaaagccucgacgaguuccgcagagcuaugucggauaaacugucacauacacuuaugauuuauaacuuuaagcccacugccaaucugccgcacaucaaaccuaccuacaaguucauuacggcaaacggcaucgaaaauucugacgggauagauagugccuauauuuuguccagcauccccgcucucggaggcaugucugucgguuacaacauccagacaaaggacaacuuuccacugcuagauauuauaguuuucaucaaaagcgccauuaucaagaccacuuauaaucauauuuacgacaccgggccuacaaucggcauaaacacucagcacgaugagcacuguaccggacccugcccaacacugaucccccauaaagagaauuggcucacguuuucccaggaaaggaccucacguuggggcugugaggaauuugggugccuggcaauuaacacuggauguguguucggcaguugccaagacaucauucacccugaggcgaagguguaccggaaagcuaucgaagaggagguaguccuuacagugugcauaaccuuuccagguaauacuuauuguacagaaauuaacgccaucgagccgaagaucaccgaugaaauugaguugcaguucaaaacgguugacacuaagacccugcccaauuuacucauggugcagaaccauaagcuguacagcgggcagaucaaugaucuuggaucuuuuucccaaggcugcgguaacguccagaaaacaaaucagucagugauaggcgcagggaccgccaaguucgacuauguuugucacggagcuagucgaaaagacgugauuguaagaaggugcuacaacaauaacuaugagagcuguaagcugcuaaaagaagagacuucccucaucuuugccgauaaucaugaaacacuggaggucgcaaacaccaagcacuugauuggcgaacugcaauucaagaucauguuaggggacauacgcuacaaaucuuuugcugagucgccugagcucgaaguggaugccaagugcgugggauguccaagcugcuucgagucauauuccuguaacuuucagauugucacaaauaucgacacuguuugcaguguggauggccccuguacccuguuccacaaccggcuuaucauuucugcgacgaaacagagcuacgguuuuaagauguccugcccuagaaaaccagaacccacagaggaguuccagaucugcaauaggaaguacaacguacuguucaccacuauugacaagaaugauaaaauagaaaucaacaccggggaccaaacaucauauauuuacgagaaggauaaucgcuguaaaacuugguugugccgagugcgggacgaaggaaucucugucaucuuugagccgcucaaggccuucuuuggcagcuauuucaguauuauauuuuacgugguuguggguaucauuguccuguuccuaaccaucuauauuuuucugccuauguucuuuaaacuucgugauauccucaagagaaacgaauaccuguauuugcaggagcugaagcauaaauga

SEQ ID NO: 10921 - RNA, 4311 nt, Artificial Sequence
  derived and/or modified CDS sequence (opt3) from MAGV(CbaAr 426)__KX100110.1__GP
augaagaugauccugcucauuauaauccuuugcgugaaccuggccgcugcaaaucccgucgccaccagauguuuccacggcgggcaguugauugcggagacaaggagcgcuacuuccaucucugaauuuugcuuaaaagacgauguuucaaugauuaagagugagaucacguacaccaaaaacgacacaggaauauucggucauagcaagaucuauaaauccuggcugauuaaggauuggaagcuauguaauccugugccaacugccggcgggucuaucaacguaauugaaguuaauucggaccucucacugaccacaaaagcauacgucugcagccgggauuguaccaucacuauagacaaggaggaagcccaaauuaucuuucagacagauaaacuuaaccacuucgaggugaguggaaccacgcuguccucuggcugguuuaagacuaaagcuagcguuaccuuggaccgcacaugcgagcauauuaaggugacuugugguaagaaaacccuccaguuccacgcaugcuuucgacaucacauguccuguguccguuucuuucacaauacaauccugccggggaccauggugaacucaaugugccagaauaucgaacugauuauaauccucggauuaacgcugauuaucuucacucuuaugguaauauugacaaagaccuauauuuguuacauccugaugccccuauuuaugccuaucgccuaugcuuacggcugggccuauaacaaaaguugcaagaaaugcaauuguugcggccucgcguaccauccauucacuaacugugggagccacugcguuuguggacugaaguuugaggcaucugauagaaugaggauucaucgggaauccggucuuugccaaggcuacaaaucacugcgcaucgccagauugcucuguaagagcaaggggaguucucugauuauauccacauuacugagcaugcuccuucugucguucaucacccccauugagggaacgaugaccaauuauccugagacaaggcaguacucuuuggaagagaucgcugacguggucgaaggccuacuguccgagcagaacaucaaagaauaugugguguucuacacuucacucuuugguagucugauucuucuguuggccuucauacucagcaucacccugacaaaggucacuaaugcauuagcucggaccaacguuauuuauugcgaggaguguuccauguaccacgccaaaaaggggaucaaauauaacggagauuuuacaaauaagugcggcuucuguaccugcgacgaacaggaggaugaagagggcauuaucauacacaaggugucuaaaaagugcacuuaccgcuaccaacugcagugggcgaaaaucauuaugaucauucuaguaaugcuccugaugaugcagaacacgauccuuauaguggccgcagaaacagacuguuggaccaagaauagcuuggagcuggacugcauugggccacuccugacuaucucagauuguaguaacaaagaguccaagaauuaugaagaggaagcugccaaacuugucagccagucuaaaauuacccaagcugacgccgaacaggugacaauccugggaaacaccauagauacugcauugaaggccauccgaucacagaaaacauaccaaacgaugcaucuccuggaaaguguguuuuuaaugaagaauugcgacuauuacagcuccuucgagcacaacucugguuauucgcaggcuaaauggagacugauugcgaagaccagccauuuugauaucuguuccaggcacucaaugcaucacuucugccgguguguggcagacggcacuaagugccagaauggggauugggacuuugccggagagaugaacaauacauacaguaccaaaaacgauuucuaucuacacgaccucaaucuguuuuucacacuucaugaaacugcuuuucccggcaccacggagucuuuguucuaccagcugauugccaagaaaaacaccacaggugcaagcaagcuccuggggaaauuaaucacuaaguacggcaauuccaaacuguucgucggaauauggaaguuuggccaauaucuuuugacccucccuuacgugaacacaacugaacugucaaagacccgucgcgagacgauucuaaaaacacaccagauccugaccagaagccaagggggaaggucugaguccaugaguagcgccgaaguaggucagaucgcuaaggagugugccaacgcaaagaauguuggcugcauuucuccacgguucgggaucccgauuggaaaccucacugcguguggcaauucccccaacuauaagauauacaaaacaccuaauaagaucuauaagucaaacaaucgaggugaaguguggugcagugaggauguccauugccuggcugacuuugaaccagccgacaccgagguggucaacaaagugaagaaaaugacuuguuuccuuagcgauguuaauacccgcgcagacaucuuuucgauugccauuuccgcuugcagaaugguggauaaggggguauguacagucaacggcgccaaauggaauaucuugaagugcgagucuggacuguacuauuucacggaccacagggaaggccaggauaccgggaacgacuuuggagaguacuguauaagccacucaugcaauacugaacgguaccccaucaacccugauauuuuaaaggaguguaucugggaauaucauagucgcaaauccaaguacauuucuacaaucaaucucgagagccuggaggaguucaaaagagcaauguccgacaaacuuucacacacccugaugguguauaacuuuaaaccaacagcuaacuugccccauauaaagccgagcuacaaguucauuacugccaaugguaucgagaacagugauggccucgaaucugcguauauccuguccagcauuccugccauagggggaaugucgaucggcuacaauauucagaccaaagacaacuuuccccuacuggaucucaucguuuucgugaagucagcugucauuaaaacgacauauaaucacaucuacgacaccgguccaacuauagggaucaacaccaaucaugaugagcacugcacaggcccuugucccacuauuaucccacacaaggaaaacuggcugaccuuuucucaggagaggacaagucguuggggaugcgaggaguucggcugucuugcaauuaauacggggugcguguucggauccugccaggacguaauccaucccgaaaccaaaauauaccggaaggccguggaagaggagguugucuugacuguguguauuaacuuuccuggcaauacauucugcaccgaaaucaacgcuaucgagccaaaaauuacugacgaaaucgagcugcaauuuaagacaguggauaccaagacguuaccgaaucuccuggccguccagaaccacaaacuuuauagcggucagauaaaugaccuggggucuuucagccagggauguggcaacguucaaaagacuaaccaguccauucuaggugcaggcaccgugaaauuugauuacgugugccauggggcgucacgaaaggacaucauuguaagaagguguuauacaaauaacuacgauaguugcaaacuccugaaggaggaacgcagcuugaucuucgccgacaaucacgagacccuggaagucgcuaacacucggcauuuaauaggagagcuccaguuuaagauuaugcugggcgauaucagauauaaagccuucgcagaaaagcccgagcuugaaaucgacgcuaaauguguggggugcccuucuuguuuugaguccuacucaugcaauuuccaaauuguuacaaguaucgauaccguguguagcgucgagggaccaugcacacuguuucacaacaggauuauaaucacugccgcaaagcaguccuauggcgugaaaaugucuugcaagaccaagcccgguccuguugaagaguucacgauuuguaaucgcaacuaccgagugucguucgccacaaucgacaaaaaugauaagaucgaaauuaacaccggggaccagacuagcuacauaguagagaaagauucacggugcaagaccugguugugucgugucagagacgaaggaaucuccgugauuuuugagccacucaaggcuuucuuuggcaguuauuucucuaucgcguuuuacauuaucauagguaucgccgcacuguuccuaauuaucuauauuuuucugcccauguucuuuaaacuuagggacgugcucaagaagaaugaguaccuguauuugcaggaacugaagcacaaauga

SEQ ID NO: 10922 - RNA, 4305 nt, Artificial Sequence
  derived and/or modified CDS sequence (opt3) from MAGV(CoAr 3363)__KX100107.1__GP
augcugagccuccuuauccuggccuucuugggcuuauccaccucuaaccccauugcuacaagaugcuuucacgggggacagcugauagcagagucaaagagugccacuagcaucuccgaauuuugucuaaaagacgaugugucuaugcucaagucggaggucguuuacacgaaaaaugacaccggucuguuuggccauaacaagguguucaggucauggacaauuaaagauuggaaacuuugcaauccuaucccaacugcgggaggaaccauuaacguaaucgaagugaauaaggaccugagcuugaugacaaagaccuauauauguagucgggauugcacuaucacaauugacaaggaggaagcucaaaucauuuuucagaccgauaaacucaaccacuucgaggucuccggcacgacucugucuagcgguugguuuaaguccaaagccucagugacccuggaccgcacaugugagcauguuaaggugacuugcgggaagaaaagucuccaguuccacgcauguuuuaagcaucacaugagcugcguccgauucuuucacaauaccaucuuaccgggaaacaugauaacaucuaugugucagaauauugaacugaucauuauccuuggcuugacccuggccaucuucauucuaauggugaugcucacgaaaacuuacauaugcuaucugcuuaugcccaucuuuaugccuauugcuuaccuguauggcugggcauacaacaaguccuguaaaaagugcaauugcuguggguuggccuaucauccauucacaaacugcggaucacacuguguaugcggucucaaauucgaggcuagcgaucguaugagaauccauagggaaaguggccugugucaaggguacaagucuuuacggauagcccgccugcucugcaaguccaaaggaagcucgcuuguuauuucuggccuguuguccaugcuaauccugucauuugugacccccaucgaggguacuauuacaaguuacccugagagcagaaaguauacccucgaagagaucacggacgucguggaagggcugguguccgagcagaauauuaaagaauacauagucuucuauaccucucuuuuuggaagccugaucuugcuccuggcguucauuaugucaaucacauuaaguaagaucacuuccauucuggcaaggcggaacguuauauacugugaggagugcagcauguaucacucuaaacgcggcaucaaguacaauggcgauuuuaccaacaaguguggguucugcacauguaacgaacaggaggacgccgaagggcuagugauucacaaaguaucaaagcgaugcacuuauaaaugccagcucaagugggcuaaagugcugaugaucacccuugucuugcugcucauugcccaaaauacaauccugauaguggcagcuaagaccgauuguuggacuaagaaaagucuugacaucgacugcauugguccaaugcuggauaucggcagcuguacgaacaagaauacaagauccuacgacaccgaggcccagaaauugguuacucagucuaaggugucgcagcucgaugcggaccaagccagccuguuaggguccucaauugauagugcaaucaaagcuauaaggacccagaagacauaccccaccaugcaucugcuagaaacuauuuuucucaugaagaacugcgacuauuacacaucuuucaaucacaacagcggauauucccaggcccgguggcgucugaucgcuaaaacgggccauuuugauauuuguucacgccacagcacccaucacuucugcagauguaucucugacgguacuaagugccaaaauggggauugggacuuugccggcgagaugaacgagccuuacaauuccaaaaacgauuucuaucuucacgacuugaaucuguuuuacacaauauucgaaaacgcauucccaggaaccacagagagucucuuuuaucagcugauccagaagagggacacuaccggcgccagcaaagucuuagggaagcugauuacgaaauacggaaauaacaauauguucguggguguauggaaguuuggccaguaccuuuugacccucccguauaucaacaacacagaacugucucaaaaucggaagcagacuauucuagcuacccaggagccccugucccgaucacauccugggcgccaggaaaguaugagcucggcgauccaaggauccguuacaaaagagugucacaacgcaaaggaugugggcugcauaucuccaagauucgguauucccaucgggaaucucacugccuguggcgacagcccuaacuacaaaaucuauaagaccccagagaaacuguacaagucaaauaacaagggagaagucuggugcaguaaugaugugcauugccuuaacgacuuugagcccgcugaugaagaggucgugaauaaaguuaagaaauugacguguuuccugacagacguguuaguaaagaccgauauuuucuccgucgccgcaucuacuugcaaaauggccgacaagggcaucuguacagugaacgaugcuaaguggaauauuauaaaaugcgacagcgggcucuauuacuucaccgaucacagggagggacaggacacugguaacgauuuuggcgaauauuguaucucccacucaugcaauaccgagcgguucccgauuaacccugacauccugaaggacuguacaugggaauuucauagccgcaaaaguaaguacauuucuacgaucucccuugagagccuggaagaguucagaagggccauggcagagaaauugucgcacacccucacuauauacaauuuuaagcccacagcgaaccugccacauauccguccuaccuauaaguucauuacagcuaacgggguugaaaauucagauggaaucgagucugccuacauucuaaguuccauccccgcacugagcggcauaucuguggguuauaacguccagacuaaagacaauuucccacuccuggauauuaucguguuuaucaagagcgccguaauucggaccacguacaaccacauauaugacacagggcccaccaucggcauuaauacucagcaugaugaacacugcaccggaccuuguccagcugugguuccgcacaaagagaacuggaucacauucucccaagaacgaacuucaagauggggcugcgaggaguuugggugucuugccauuaauaccggaugcgucuucggcaguugccaggacaucauacaucccgaaacaaagguguacaggaaagcaguggaggaagaggucguuuugacgguguguaucaacuuuccugguaauaacuauugcaccgaaauuaaugcuaucgagccaaagauuacugaugagaucgaacugcaguucaaaacaguggacaccaagacuuuacccaaccuccuggccguacagaaucacaaacuuuacagcgggcaaauaaacgaucugggaucuuuuucccagggcugugguaauguccagaagacaaaccauucaauucuaggcauggggaccgcgaaguucgacuacgugugccacggagccagucgcaaagauguuaucgugcggagauguuauaacaauaacuuugacagcugcaagcuccugaaagaggaaacguccuugaucuucgcugauaaucaugagacucuggaggucgcacacaccaagcacuuaauuggcgaacuccaauuuaagaucaugcugggggacauaagguacaaaucuuucgccgagucgccugaacuugagauugacgcuaagugugugggaugcccaagcuguuucgaaucauauuccugcaacuuucagaucguuacaaauauugauaccguguguaguguagagggccccugcacucuguuccauaaccgcaucauaauuucugccaauaaacagagcuacgguuugaagauguccugccagacaaaaccgaaccaaaaugaggaauuuaucaucuguaaccgaaaguauucaguccucuucaccacaauugacaagaaugauaaaaucgaggugaacacuggggaccagaccucuuacauuuaugaaaaggauagccggugcaaaacguggcugugucgugugagagacgagggaauaaguguccuauuugaaccucugaaggcauucuuuggcuccuacuucagcaucaucuuuuacguugugauugguaucauuguacuuuuccucauaguguauaucuuucugccaauguucuuuaaauugaaggauguccugaagaaaaaugaguacuuauaucuccaggagcugaagcacaaauga

SEQ ID NO: 10923 - RNA, 4305 nt, Artificial Sequence
  derived and/or modified CDS sequence (opt3) from MAGV(OBS 6657)__KX100116.1__GP
auggagcugcucaucauuauacuucuguugggcagcgccgcuuccucucccgugucaaccagaugcuuccacgggggacaguuaaucgcagaaaguaagagcgccacauccauuucugaguuuugucugaaagacgaugucucgaugaucaagucagaaguuacuuacacgaaaaacgacaccgguauuuauggccauaauaagguguucaggagcuggacaaucaaagauuggaagcuaugcaacccuauaccaacugcugggggaaguaucaauguaauugaggugaacuccgaccucucucuggcgaccaaggccuacgucuguagccgggauugcacaaucaccauugacaaagaagaugcacaaaucauauuucagacugacaaacuuaaucacuucgagguguccggcacaacccugucaagugguugguuuaagacgaaggccagcguuacuuuggaucgcaccugugagcauauuaaagugacaugcgggaagaagucucuccaguuccacgcuuguuuuaaacaucacauguccugcauccgauucuuucaccauacuauucugccgggaaccauggucucaagcaugugucagaacaucgaacugaucauuauaaucggccucacauuagugcuguucauucuuaugguaaucuugaccaagacguauauaugcuaccugcuaaugcccauuuuuaugccuaucgcauauaucuacggcugggccuauaauaaaaguuguaagaaaugcaacugcugugggcucgcuuaccacccauucacuaauugcggaucucauuguguuugcggucugaaguuugaggccuccgaccguaugaggauucacagagaaagcggccuuugucaaggguacaaaucgcugcggaucgcgcgcauguugugcaagucuaagggauccucacucgugauuaguggccuguuaagcaugcugcuccuuuccuucauaacacccaucgaggguacccugacuaacuauccuaaugagagacaguacacauuggaagagauugcagaugucguggaagggauccuaaccgagcagcaccugaaagaauauguggucuucuacacgucucucuuuggaggccugauccuucuguugacccucauucugagcauaacaaucaacaagguuacugacuuacuggccucaaccaaugugauuuauugugaggagugcaguauguaccauuccaaaaagggcaucaaauauaacggggauuucacaaauaaguguggauuuugcacuuguagcgaacaggaggacauugaagguguagugauccacaaggucucuaggaaaugcaccuacaaguaccaacuaaaaugggugcggguuauaaugaucauucucgcucugcuuuugacacugcagaacaccgugcucaucgucgccgcagagguggacugcuggacuaagaaaucaauugaaaucgauuguauaggcccacugcuuaacauugggacgugcacagacaagaguagccgcaccuaugagacugagguaaauaagcugguucgacaguccaaagugacccaggcugaugccgaacaagucucuaucuugggaucgacacucgacagcgcgauuaaggccaucagaucccagaaaaccuacgagacuaugcauuuccuggaaacaguguuuuuaaugaagaacugugauuauuacucaaguuucgagcacaauucuggcuauagccagacgaaauggaggcugauagcaaagaccucccauuuugacaucugcucacggcacagcgcucaccauuucugucguugcgucaacgaagguacuaagugucaaaauggggauugggacuuugcccgcgagaugaacgauacauacaauucuaaaaacgacuucuaucuacacgaucucgaccuguuuuacacccuuuucgagaaugcuuuucccggcacaacugaauccuuguucuaccagcugcuccagaagaaaaacaccacgggagccaguaagcuguuaggcaaacugauuaccaaguaugggaauaacaaucuuuucgugggaaucuggaaauuuggucaguacuugcucaagcugccuuauauuaacgacacagagcuaagcacugauagaaagucuaccaucaugaaaucccaacagaugcugucaaggagucagacaggccggcaggaaagccucucguccgcaacuccagggaccgccacgaaggagugcucuaaugcuaaagacauaggauguauuagcccgcgauucggcauccccaucgguaaccugacagcgugcggggauucaccuaacuacaagauuuauaaaaccccagagaagaucuacaagaguaauaacaaaggcgaaguuugguguuccgacgaugugcauugccuugcagacuuugagcccgccgaagaggaaguagucaaucgcauuaagcaaaugacuugcuucuugacagaugugaccacuaaaaccgacguguuuucuguugcuauaagcacauguaagauggccgauaaaggagucugcacggugaacgacgcaaaguggaauauccugaaguguaacuccggcuuauauuacuucaccgaucacagagacgggcaggauacuggaaaugacuuuggugaguacugcauuucacacagcuguaacacagagagguucccuaucaauccagacguacucaaagauugcauuugggaauaucauagucggaagucuaaauacaucuccaccauaagccuggagucgcuugacgaauuucgcagagccaugucagauaagcugucucacacauugaugaucuauaacuucaaacccacugcuaaucucccgcauauuaagccuaccuacaaguuuaucacggccaacggcauugagaauagugacgggaucgauuccgcauauauacugagcucuauucccgcgcuaggaggcaugagcguggguuacaacguucagacaaaagacaauuucccacugcucgauaucaucgucuuuauuaaguccgcuauaaucaaaaccacuuauaaccacauuuacgacaccgggccuacaaucggcauuaacacucagcaugaugaacacuguaccggacccugcccaacacugaucccccacaaggagaauuggcuuacguucucacaagagaggaccagucguuggggcugugaagaguucgggugcuuggccauaaacacuggauguguguuuggcagcugccaggacaucauucauccugaagcaaaaguguaccggaaggccaucgaggaagaggucguucugacagugugcauuaccuucccagguaauacuuauuguacagagaucaacgcuauagaaccgaaaauuaccgaugagaucgaauuacaguuuaagacgguggacacuaagacccuccccaaucugcuuaugguacagaaccacaaacuguacucugggcaaaucaaugaucuaggauccuucucacagggcugcgguaacguccagaagacaaaucaaagugugauuggcaccgggacugccaaauuugacuauguuugucauggagcaagccgaaaggacgugaucgucagaaggugcuacaacaauaacuaugaguccuguaaacuccugaaggaggaaucuucguugauauucgcugauaaucacgagacacuggaaguggccaacaccaagcauuuaauuggcgagcuccaguuuaaaaucaugcugggggacauucgcuacaagagcuucgcggaaucaccugagcuugagguugaugccaaaugcgugggauguccauccugcuuugaaaguuauucuuguaauuuccagaucguaacaaacauagacacugucugcagcguggauggccccuguacccuguuucacaaccgguugauuaucuccgcugcaaagcagucauacggucucaaaaugucuugcagcagaaggccugagcaaacggaagaguuccagaucugcaaucgcaaguacagugugcuguucacaaccauugacaagaacgauaaaaucgaaauuaauacuggggaccagaccuccuauauauacgagaaggauaaccgauguaaaacauggcuaugccggguccgugacgagggaaucagcguuauuuuugaaccacugaaggccuucuuuggcucuuauuucucaaucaucuuuuacgugauuguagguauaaucgugcuuuuccucauuaucuauauuuuucugcccauguucuuuaaauugagagauauccugaagaggaaugaguacuuauaucuccaggaacugaagcacaaauga

SEQ ID NO: 10924 - RNA, 4302 nt, Artificial Sequence
  derived and/or modified CDS sequence (opt3) from NORV(0234)__EU004188.1__GP
augaucugguucauucugcuccuugccauagcucccagcuuuggcaccccuaucgcaacaagaugcuuccacgggggacagcugauugccgaggcgaagucccaaacuucuaucucagaauuuuguuugaaagacgaugugaguaugauuaagagcgaggucacguacaccaaaaacgacacagguaucuucggccauuccaagguuuauaggucuuggacuauaaaagauuggaaguuaugcaauccagugccgaccguagggggaucgaucaacgugauugaagucacagcugaccugucacuaagcaccaaggccuacguguguagucgggauugcacuaucacaauugacaaagagggcgcacagaucguuuuucagaccgauaagcucaaucacuucgaaguguccgguacgacucugucuagcgggugguuuaaaaccaaggccuccgucacacuugaccgcacuugugagcauauaaaagugaccugcggaaagaagacacugcaguuccacgcuuguuuuaaacaucacaugucaugcauucgauucuuucacaacaccaucuugcccggcaguaugguagcaagcaugugucaaaauauugagcucaucaucauucugggccugacgcucauaaucuucauuuuaauggccauccugacuaagacauauauaugcuaccuuuugaugccuauuuuuaugccaaucgcuuaugccuacgggugggcguauaacaaaucuuguaagaaaugccauugcuguggacuggcauaccaccccuucaccaauugcgguucccauuguguuugcggccuaaaguucgaagccucagaucguaugagaauccacagggagagcgggcucugucagggauacaaaagucugcggguggcucgccuucugugcaagucuaagggcuccagcuuggucauuucgauccuccugucuauguuaauucuguccuuugugacuccuauagaagguacacucaccaacuauccagagucaagaagguacacgcuugaggaaaucgccgacguggucgaggggauuaucgcagaacaggaucugaaagaguauaucguuuucuacaccaguuuguuuggaagccuaauucugcuccuggcuuucauacuuuccgugacacugacuaagguauuggaccuccuggccaaaaccaaugugaucuauugugaagagugcucuauguaccacccccggaagggcauuaaauauaacggcgauuuuacaaauaaguguggguucugcacuugugacgagcaggaagacgucgagggagugaucauucauaagguuagcaaaaagugcaccuaccgcuaccaagugaaaugggcgaagaucauaaugaucauugucgugaucuuacugauggcccagaacacaauucuaaucguagcagcugaaaccgauugcuggacuaaaaagucacucgagcuggacuguauagguccucuuuugaauauuggcaguugcuccgggaaggaagcccgaacguaugagacagagguuaaaaagcuggugagccagucuaaagucacccacaucgaugcugaacauauuucaauccucggagccacuauagacagugcaaucaagagcauuagagcccagaaaaccuacgcuacaaugcaucugcuugagaccguguuucugaugaagaacugugauuauuacacugucuucgaacacaauuccggcuauucucaagcgaaguggagguugaucgcaaaaacaaaccacuuugacauuugcucgcggcacagcgcccaucacuucugucguugcaucaacgaugagacgaagugucagaaugguaacugggacuuugcuggggaaaugaauaacaccuacuccacuaaaaaggauuucuaucgccaugaccucgaucuguuuuacacaauauucgagaaugccuucccaggcucaaccgagaguuuauuuuaccaucugcuacagacuaaaaacacaaccggagcaucuaggauucucgaaaagcugagcacgaaauucggcaauaacaauauguuuguggggaucuggaaguucggacaauaucuuuugacccugccguacguuaacgagacagaacucucccccucaaggcagagcacuauccugaccaauucuaacuccuuaagucggagcacaggucgacaggagucucuguccucagccauuccuggcccaaauacuaaggagugcaguaacgcucgcgacgugggguguaucagccccagauuugggauuccuauaggcaaucuuaccgccugcggugaaucgccauccuauaaaaucuacaagacgcccgagaaauuguauaagucuaacaacaaaggggaaauuugguguagcgacgauguacacugccucaagaauuucgagccggcaacagaagagaucgucaacaggauuaagcagaugaccugcuuucugacugacgugucaacaaaaaccgauaucuucaguauagcgacuuccaccugucggaugguugacaagggcgugugcacagucaaugaugcuaaauggaacauccuaaagugugacucuggacuguuuuacuucacggaucaacgcgagggccaggacaccgggaaugauuuuggagaauauugcauuagccacuccuguaacacugagagauucccuaucaaucccgacauucucaaagauugcacaugggaauaccacucaagaaagagcaaguacaucaguaccauaucucuggagucccuugacgaauuucgucgggccaugagcgauaaauugucgcauacacugaugauuuauaacuucaagccaacugcaaauuuaccucacaucaaacccaccuacaaguucaucacggccaacgguauugaaaauucagacggccucgacucugcuuauauagugaguuccaucccagcccugggaggaaugagcguaggcuacaacgugcagacaaaagauaauuuuccccuucuggacauuaucguuuucauuaagucugcagucauccgaaccacuuauaaccauauauacgauaccgguccuacaaucgggauuaauacucagcacgacgagcacuguaccggcgcuugcccaacacaaaucccgcauaaggauaacugguugacguuuagccaggaaagaaccuccagguggggaugugaggaguucggcugccucgccauuaacacuggguguguguuuggaucaugccaggacaucauacaccccgagacaaaaguguaucgcaaggcgauggaagaggaggucauucugaccguuugcgugacuuucccuggcaauacauacuguaccgaaaucaacgccaucgagccaaaaauuacggaugaaaucgagcuacaguuuaagacuguggacaccaaaacacugcccaauauacucgcuguacaaaaccauaagcuguacaguggucagauuaaugaucuugggagcuucucucagggaugcggcaacguccagaaaaccaaucaauccaucuuggguacuggcacagcaaaguuugacuaugugugucacggggccucacggaaggauauuaucguuagaaggugcuacaacaauaaccaugacaguuguaaacuguuaaaggaggaaaccagccucauauucgcugauaaucacgagacacugguggucgccaacacuaaacaccuuauuggagaacugcaguuuaagaucaugcuaggcgacauccgcuauaaauccuucgcagagucuccugaacucgagauugacgcgaagugcgugggguguccaucgugcuucgagagcuacucauguaauuuucagaucauuaccaacauagauacgguuugcuccgugaguggacccuguacacuguuccauaaucgauugaucauuaccgccacuaagcaaucuuauggcaucaaaaugagcugcccgaccaagccugaagguacagagacuuuugaaaucugcaacaaacaguacaagauuuucuuuaccacgauagacaaaaacgauaagaucgagauuaauacaggggaccagaccuccuauaucuacgaaaaggauaaccgguguaaaacuuggcugugccguguaagagacgagggaauuucagucuuauucgagccacucagggccuuuuucggcucuuacuuuagcaucauauucuaugcugugguggguaucauuauccuguuucuugcagucuacauuuuccugcccaugaucuuuaaguugcgcgauaugcucaaaaagaaugaauaucuguaccuacaggagaguaaacacaaguga

SEQ ID NO: 10925 - RNA, 4305 nt, Artificial Sequence
  derived and/or modified CDS sequence (opt3) from PLAV(75V3066)__KX100122.1__GP
augcuguuccuccuuauccuggccuuuuugggcuucagcaccuccaaccccauugcuacaagaugcuuucacgggggacaguuaauagcagagucuaagucagccacgaguaucagcgaguucugucugaaagacgauguguccaugcuaaagucugaagucguuuacauuaaaaaugacacuggucucuuuggccauaacaagguguucaggucguggaccaucaaagauuggaagcugugcaauccuauuccaacagcugggggaacuaucaacguaauagaagugaauaaggaccuuucacugaugaccaaaacauauaucuguagccgggauugcaccauuacuaucgacaaggaggaagcgcaaauuaucuuucagacagauaaauugaaccacuucgaggucaguggcaccacgcucuccucugguugguuuaagagcaaagccuccgugacucuggaccgcaccugugagcauguuaaggugacaugcgggaagaaaucacugcaguuccacgcauguuuuaagcaucacaugaguugcguccgauucuuucacaauacuauacucccgggaaacaugauuaccagcaugugucagaauaucgaauuaauuaucauccugggccuuacauuggccauuuucauacugauggugaugcuaaccaaaacguacaucugcuaucuccugaugcccauuuucaugccuaucgcuuaccuuuauggcugggcauacaacaagucuuguaaaaagugcaauugcugugggcuggccuaucauccauuuacuaacugcggaucccacuguguaugcgguuugaaauucgaggcuucagaucguaugagaauacauagggaaagcggccucugucaaggguacaagagucugcggauugcccgcuuacugugcaagucuaaaggauccagccucguuaucucgggccuucugucuauguugauccuauccuuugugacacccauugaggguaccaucacuucauacccugagaguagaaaguauacacuggaagagauuaccgacgucguggaagggcucgugagcgagcagaauauaaaagaauacaucgucuucuauacgucccuguuuggaucucuuauucuguugcucgcguucaucaugagcaucacccugucaaagauuacaaguauauuagcaaaaaggaacguuaucuacugugaggagugcuccauguaucacagcaagcggggcauuaaguacaauggcgauuuuacuaacaaauguggguucugcaccuguaacgaacaggaggacacagaaggacuggugauccacaagguaucuaaacgcugcacuuauaaguaccagcuaaaaugggccaaggugcucaugauuacccugguccuuuugcugaucgcucaaaauacaauacucaucguggccgcagagaccgauugcuggacuaagaaaucacuggacauugacuguaucgguccaaugcuugauauuggcaguugcacgaacaagaauacacgaagcuacgacgcugaagcccagaaacugguuucccagucuaagaucucgcaguuggaugcggaccaagugagccuccuggggaacuccauagauucagccauuaaagcaaucagagcucagaagaccuaucccacuaugcauuuacuggagaccauuuuucuaaugaagaauugugacuacuauacaaacuucaaucacaacaguggauacucucaggccaaauggaggcucaucgcuaagaccggccauuuugauauaugcagccggcacuccacucaucacuucugucguugcaucaaugacgguacaaaaugucaaaacggggauugggacuuugccggcgagaugaaugaaacguauaacucaaagaaugauuucuacagccacgaccugaaccuuuucuauaccauuuuugagaaugcauucccuggaacuacagaaucuuuguuuuaccagcugauccagaaaaagaacaccacaggcgccuccaaaguccucgggaagcugauuacuaaguacggaaacaauaacauguucguggguguauggaaauuuggccaguauuuacugacccuuccauacaucaauaacacggaguugagucaaaaucgcagacucaccauacuggcuacacaggaaauucuaagcaggucucauuccgggcggcaggagucaaugaguaacgcgauccagggaagcaucacuaaggagugccacaaugcaaaaggcguugguuguauuucgccgcgauucgggauccccauuggcaaccugaccgccugcggagacuccccuaauuauaagauauacaaaacaccagaaaagcucuauaagucuaacaauaaaggcgaggugugguguagcaacgauguccauugccugaaugacuuugaacccgcugaugaggaggugaucaacaagauuaaaaagcugacuugcuucuugaccgacgucucaguggaaguugauaucuuuaguguggccgcauccacguguaaaauggccgacaaggggguaugcacagucaauggagcuaaguggaacauuaucaaaugugauucuggucuguacuauuucaccgaccaccgcgagggccaagauacugggaacgacuuuggagaauacugcauaagccacuccuguaauacagagagauucccuaucaacccagauaccuuaaaggacugcacuugggaauuucauucaaggaaaagcaaguacauuaguaccaucucucucgagucccuggaggaguuccggcgcgccauggcagaaaaacuuagccacacacugacgauuuauaauuucaagcccaccgcgaacuugccgcauaucagaccuacuuacaaguuuauaacagcuaauggcguggaaaacucggaugguauugagucagccuauauccucucuaguauccccgcacuugggggcauuuccguuggauacaaugugcagaccaaagacaacuucccacuacuggacauaaucgucuuuauuaagagcgccgugaucaggacaacuuauaaucacauuuacgauaccggcccuacgaucgggauaaacacacagcaugacgaacacuguaccggacccugcccagcuguagugccccacaaagagaauuggaugacuuucucucaggagcguaccagccgguggggcugugaagaguuugguugccucgccaucaacacaggguguguuuucggauccugccaagauauuauccauccugaaacuaaggucuaucgaaaagcaguggaggaagaggugguccugaccguuugcauuaauuuuccaggcaacucauacuguacagagaucaaugcuauagaaccgaagauuacggacgagaucgaacuucaguucaaaaccguggauacuaagacauugcccaaccuguuagccgugcagaaccacaagcucuacaguggucagaucaaugaccugggcagcuuuucucaagggugcggaaacguacagaaaaccaaucauuccauucuuggcauggggacugucaaguucgauuaugugugucacggagcgucaagaaaagacguuacagugaggcgcugcuacaacaauaacuuugauaguuguaagcugcuaaaagaggagaccagccucaucuucgccgacaaucaugaaacgcuggaggucgcucacacuaagcacuugauaggcgaacugcaguucaagauuauguuaggugauauccgguauaaauccuuugcagagucuccugaacucgagauugacgccaagugcgugggguguccaucgugcuucgagagcuacucauguaacuuucaaaucguuaccaauauagauacagugugcuccguagaaggacccuguacccuguuccauaacagaauuaucaucagugcuaauaaacagucuuauggccuuaagaugagcugccagacuaaaccuaaccagaaugaggaauuuauuaucugcaacaggaaguacuccguccuguucacaaccauugacaagaaugacaaaauagaggugaacacaggugaucaaacuucauauaucuacgaaaaggacucucgcuguaaaaccugguugugccgagugcgggaugagggcauuagcguccucuuugagccacugaaggccuucuuugggaguuacuucuccaucaucuuuuauguugugguaggaauuauagugcuauuccugaucgucuacauuuuucuucccauguucuucaaacucaaggacgugcugaagcguaaugaauauuuguaccugcaggaguuaaaacacaaguga

SEQ ID NO: 10926 - RNA, 4305 nt, Artificial Sequence
  derived and/or modified CDS sequence (opt3) from PLAV(75V5758)__KX100128.1__GP
auggagcugcucaucauuauacuucuguugggcagcgccgcuuccucucccgugucaaccagaugcuuccacgggggacaguuaaucgcagaaaguaggagcgccacauccauuucugaguuuugucugaaggacgaugucucgaugaucaaaucagaaguuacuuacacgaagaacgacaccgguauuuauggccauaauaaaguguuccggagcuggacaaucaaggauuggaaacuaugcaacccuauaccaacugcugggggaaguaucaauguaauugaggugaacuccgaccucucucuggcgaccaaggccuacgucuguagccgcgauugcacaaucaccauugacaaggaagaugcacaaaucauauuucagacugacaaacuuaaucacuucgagguguccggcacaacccugucaagugguugguuuaagacgaaagccagcguuacuuuggaucgaaccugugagcauauuaaggugacaugcgggaaaaagucucuccaguuccacgcuuguuuuaagcaucacauguccugcauccguuucuuucaccauacuauucugccgggaaccauggucucaagcaugugucagaacaucgaacugaucauuauaaucggccucacauuagcaauuuucauccugauggugauacuuaccaaaacguauauuugcuacuugcugaugcccguauuuaugccuaucgccuauaucuacggcugggcuuauaauaagaguuguaaaaagugcaacugcugugggcuagccuaccacccauucacuaauugcggaucucauuguguuugcggucucaaauuugaggcguccgacagaaugaggauucaccgggaaagcggccugugucaaggguacaagucgcuucgcaucgcaagaaugcugugcaaaucuaagggauccucauuggugauuaguggccuccugagcauguuacugcucuccuucauaacacccaucgaggguacccuuacuaacuauccuaaugagaagcaguacacacuggaagagauugccgaugucguggaagggaucaugaccgagcagcacuugaaagaauauguggucuucuacacgucucuauuuggaggccugauccuccugcuuacccugauuuugagcauaacaaucaacaagguuacugaccuccuggcuucaaccaaugugauuuauugugaggagugcaguauguaccauuccaaaaagggcaucaaauauaacggggauuucacaaauaaguguggauuuugcacuuguagcgaacaggaggacguagaagguguggucauucacaaggugucuaggaaaugcaccuacaaguaccaauuaaaauggguucgggugaucaugauaauccuggcccuacuccugacaauucagaacaccguccuuaucguggcagcugagguagacugcuggacuaagaaaucaauugaaaucgauuguauaggcccauugcugaacauugggaguugcacggacaagagcggaaagacauaugagaccgagguuaauaaacucgugcgccaguccaaggucacucaggccgaugcggaacaaaucucugugcugggcaacacccuugacucggccauuaaagcaauccgaagccagaagacauacgagaccaugcauuuccuggaaacugucuuuuugaugaaaaauugugauuauuacuccucauucgagcacaacagugguuauucucagacaaaguggagacucauagcuaagacgagccauuuugacaucugcuccaggcacucagcccaccauuucugucggugcgugaaugaagggaccaaaugucaaaacggcgauugggacuuugcuggagagaugaauaacacuuacaauagcaagaacgauuucuaucugcacgacuuagaucuguuuuacacacuauucgagaaugccuuucccggcaccacagaaucucucuucuaccagcugcuucagaaaaagaacacuaccggggcauccaaauugcugggaaagcucauuacgaaauaugguaauaacaauauguucguuggcaucuggaaguuugggcaguaccuguuaaagcugccuuauauuaacgacaccgagcuuagugccgaccguaaaagcacaaucaugaagucucaacagguguugucccgcucacagacuggaagacaggaaagucucagcucggcuaccccaggcacagcgacuaaagagugcuccaacgcaaaggauauagguuguauuucuccgagguucgggauccccaucggcaaucugaccgccugcggagacagcccuaacuacaaaauuuauaagacgccagagaagaucuacaaaucaaauaacaagggcgaaguaugguguagugaugacguccauugccuagcugauuuugagcccgccgaagaggaagugguuaaucggauuaaacaaaugacaugcuuccugaccgacgugacuacaaagaccgaugucuuuuccauagcagugucuacuuguaaaaugguagacaagggggugugcaccguuaacgaugccaaguggaauauccucaaauguaacagcggacuguauuacuucacagaccaccgagauggucaggacacgggcaaugauuuuggggaguacugcauuucccacucauguaacaccgagcgcuucccuaucaauccagacguccuuaaggacugcauuugggaauaucauagcagaaaaaguaaguacaucucuacuauauccuuggagagccuggaugaauuuaggcgggcuaugucggacaaauuaucacacacacucaugaucuauaacuucaagcccaccgccaaucugccgcauauuaagccugcauacaaauuuaucacagcgaacggaauugaaaauucugauggcaucgacagugcuuauauacuuuccagcauucccgcccugggugggaugucugugggcuacaacgugcagacuaaggauaacuucccauugcucgacaucaucgucuuuauuaaaagcgcaauaaucaagaccacguauaaucacauuuacgauacaggaccuaccaucggcauuaacacucagcaugacgagcacuguaccgggcccugcccaacacugaucccccacaaagagaauuggcuaacuuucucccaagagcgcaccucaagauggggaugugaagaguucggcugccuggccauaaacacagguuguguuuuugggaguugccaggauaucauucauccugaagcuaagguguacaggaaagccaucgaggaagaggugguacucacggucugcauuaccuucccaggaaauacuuauuguacagagaucaacgcaauagaaccgaagauuaccgacgagaucgaacugcaguuuaagacuguggauacaaaaacccuucccaauuugcugaugguucacaaccauaaguuauacagcggccagaucaaugaccucgguucuuucucccaaggcugcgggaacgugcagaaaacgaaucagucagucauuggagcuggcacugugaaguuugauuauguuugucacggggccagucguaaagacgugaucguacggcgaugcuacaacaauaacuaugagagcuguaagcugcuuaaggaggaaaccucccugauauucgcggacaaucaugagacacuagaagucgccaacaccaaacaccucauuggagagcugcaauuuaagaucauguugggcgauauuagauacaaaucuuucgcugaaucgccugagcuggagguggacgcaaagugcguggguuguccaagcugcuuugaaucauauuccuguaacuuccagaucgucacuaauauagauacaguuugcagugugaacgggcccuguaccuuauuucacaauaggcucauuaucucugccacaaaacagagcuacggacugaagauguccugcucacgcaagccugagccaacugaagaguuccagaucugcaaccggaaauacucuguacuuuucaccacgauugacaagaaugauaaaaucgaaauuaacacaggcgaccaaaccagcuauauauacgagaaggauaauagauguaaaacuuggcugugcagggugcgcgacgaggguaucagugucauuuuugaacccuugaaggcuuucuuuggcuccuauuucagcaucaucuuuuacgugauuguugggauaaucguccucuuccugauuguguauaucuuucuaccgauguucuuuaagcugcgagauauucuuaaacggaacgaguaccucuaucugcaggaauugaagcauaaauga

SEQ ID NO: 10927 - RNA, 4317 nt, Artificial Sequence
  derived and/or modified CDS sequence (opt3) from POTV(89-3380)__EU004189.1__GP
auggagcccccuaugaagcuguuccucauccuugccaccgcuguggcagccgucuacagccugccagcguccagaugcuuuucugacggcauuauaaucaaagaaaagcaggauucaaaagcuguuagugaguucuguuugaaggacgaugugagcaugauuaaaucccacguaguguauucuaagaacgaaucggggaucuuugccaauucacaaauuuuaaggaaguggaucauaaaagacuggaagcugugcagcccgcuacccacagcaggaggucagaucaacgucauugagaucaaucaugaucucacucugaguacgaaaaccuacguguguacaacugacugcaccauuggcaucgauaaggaaaacgcccagauaacauuccagaccaauaaacuuaacuauuuugagguuuccgggacuacaauuucuagcggaugguucaaguccaagaccucagugagucuggaccaaacgugugagcacuugaaagucagcugcggcaagaaaucuaugcaguuucaugcuuguuucaagcagcacauguccugcauccgguaccuccauaaaacugcacugccugguuauauggccgcuucaauuuguagcaauaucgaacugaucauuaugaccacacucacuuuagccauauuuauccugcuuugcauuaucaccaagacauacauauguuauuugcugaugccacuauucaugcccauugcguacaucuacggguggcucuauaacaaaaguugcaagaagugcaauuguugcggacugucuuaccacccuuuuaccaacuguggcuccuauugcguguguggcgcaaaauucgagacgagcgaucgcaugcgaauccaccgugaaucggggcuuugccagggauacaagucucugagaguagccaggaaauuguguaaguccaaagguucaagucucguuauuagcgugacucuguccgucuuuaucuucucuuucauuacaccaauaggcggggugaucauuaaugacaaguuaagcgaggagaaguauucaaucaaccaaaugauggaugcuaucguggaccuggaaaauuuuagucauaacgucuccggaacccagcagguuauuagcgugauauuccuccuuaucucuugccuguuuuugcuacugacuuaccggcucaauaaaauuauccagcaccuggcccgcucaggccuucuguucugugaggaaugcaguauguaucauagcaagaaagauauuaaguacaacggugacuuuacaaacaaauguggguucugcacuugcggacaacccgaggacccugaaggcuugaaucuccacauccugucccagaacuguacguacaagcagcaauuuaaguggguaaaaauaaucauuucuaucuuacugucgcuaauuaucauagagagcuccaugauucucgcagcugccgagaccgauugcuucucagaaaagcagaucagugaguuuugucugggcccacuuuugucuauuagcuccugcgaagacaaaaauucaagaacauucaagggggaggcgcagaaacugguggcccucaagaagaucacuagcgaugaagcaaugcugauagagucuaugggagcuaaagucgaggacgcccuuaagaugauccaggcucaaaaauccccggauaguauguauaccauggaauacguguuucugaacacauauugugacuacuauagcuuguucgagcacaauucugguuacucccagauuaaguggagguauauccucaaaacucaucaguuugaugccugcgcacggcacucaaacaaucauuucugucgcugcaugagugacggcaugcacugucccagccuggauugggacauugccgaugaauuaaacaauaccuacaucacaaagccuaacuucuuuaaacaugacuacaaucugcuacucgacguuauaaccgcugcguucccagggacuggagcaguguuugucauugaugccugcaagaaggcuaacgccacggcaaucaaaacauucucgaauaacaucauugcccgauuucccuauaauaaccugcuuaagggcgugaugaaauucuugcaguacaucuccaagcacccuucuuuuaaaaaguaucaaccagacaccagacacuacgaucugauucccguagcuccgacugccaggggucggagccucgggcguucaaacaguuauuccgacgcacagguuggcccucccaccaaggauugucagaaacugaaggaggugggaugcuuaucuccaaaauucggccugccucuugaaagcauaaucuccugcgggucaagccccaauuacaaguuguauaaaaagccacagaaguacuacaaaaguaacaauaaggagaacacaugguguucuaaagacguccauugccuccacgauuuugagcccauuaccgaagacgugcuggagaaggucaaagugaugacuuguugggaaaucgagccuggaacaauugaggauaucuucacgauagcguccgaaaccugcaagaucaaugaccgcgguguuugugaggugaacgcugccaaguggaaaauuguaaagugcgaaacuggccuauauuacuauacagaucauagagagggggacgauaccggaagcgaccugggccacuacugucucacacacaaaugcgccggugggagguauccaaucaauccggaaauucugcaaaacuguaucugggaguuucauucgcagaagucacaguacauaaaucaggucgaccuugagcaaauugaagaguauaaaaaggcauugacugaaaaacugacccacacguuaaaccauuacaauuuccuccccaccaagaaccugccucacaucucuccaaauuacaaguaugugacacuuaacggccaggagaccagugauggaaucgaaaauuccuacauuguuagcgagauacccgcuaucgccggcaccucuauugggcugaaagugcagacaaagaacaacggaaauaucuuugacuugauuaucuaugucaaacgggcagauauaaucgcuagcuacaaccauauuuaugacacugguccuaccaucggccacaauguggagcacgaagaacucugcacggggcaauguccacagcauauucccgccaaggcgaacuggcugacauucucccaggaacgaaccucacgcuggggaugcgaggaguucggcugccuagccaucaauacugguuguguauacgggaguugccaggauauaauuaaaccgguggcuaagguuuauagaaagagcacagaggagaaagucgaacuggagcucuguaucgugcugccugacaggaacuuuugcaccacucuuaaugcauuggaaccaaagaucaccgaggagauugaacugcaauucaaaacaaucgaucaggugucuuuacccaacauaguccuccugcgggaccacaagcuguuuaaaggccagauuaaugaucugggaacguucggccagaacugugggaauguucaaaagaccaaccaguccauccuaggagccggcacugugcgcuuugacuaccucugccauucagcuaguagaaaggauauuaucauaaggcguuguuacaauaacaauuaugacagcugcaaccaccuucaguuggccgagucccugauuuucuuagauaaccaugaaacacucgaggugcggaaaccuaaucacauccuggguacccuuucuaugaagcugauguugggggacuuucaguacaaaacauucgcaaaggacaucgaacucgauuuuacuggacgauguguaggcugcauugguuguuucgagggcuuugucugcgagaugcacaucaccacgacaguggaagcgaccugcaaccuggaggccucgugucaauucuuccauaaucagcuacacauuaaacccgacguucugaaguauuacacuaagaugaccugccagacagaugaauauauaccaagcaaaaucaagauuuguaacaaagaguacaagaucacuaucgggaaagugagaaagaaugacaagauugaaauagauaacucagaccaaaccuccuauaucaaagagaaggaugagaggugcaaaacauggcuuugucgcguccgggacgaaggaauuagugugaucuuugagccucuccugaauauuuucggcaacuacgggagaaucgcuguugccgugauaucugcaaucuuggcucugauuguauuagucuacauccucaugcccauuugcaugaagaucagggauauacugaaaacgaaugaaaaggaguuucuuauugaaagcaaauauaaguga

SEQ ID NO: 10928 - RNA, 4311 nt, Artificial Sequence
  derived and/or modified CDS sequence (opt3) from TENV(TSV-FE3-66FB)__FJ943508.1__GP
auggagaucuucuuuauugcccugcucgcuauagcaaacagcgugaauagcacuccccuugccacaagaugcuuccacggcgggcagcugaucgcggaaucuaagucagcuaccaguuugagcgaguuuuguuuaaaagacgaugucuccaugauuaagucugaaaucuacuauguuaaaaacgagacgggaauuuucucgcauaauaaggugcugaggucauggaccaucaaagacuggaaguuuugcaacccuguaccaacagccgguggcagcauaaaugugaucgaagucaacagugauaugucccuagcaacuaagaccuacguguguucucgggacugcacaauuaccaucgaucgcgaggaggcccaaauuaucuuccagacugaaaaacucaaucacuuugagguuagcgggacaacccuguccucaggaugguucaagaguaaagcuagcgugacgcuugaccgaacuugugaacaucugaaggugaccugcggcaaaaagucuuugcaguuucacgcauguuucaagcaucacauguccugcauaagauuuuuccacaacacaaugcucccgggucguauugucaauucaaugugucagaacaucgagcugauuaucauccuggggcucacuauuguaauauuuaucuuaaugguuauucugaccaaaacauauaucugcuacauacuuaugcccuuguucaugccuauugccuauaucuacggaugggcuuauaauaagagcuguaaaaagugcaacugcuguggccuggccuaccauccauucaccaauugcggcagucacugugugugcgggcuaaaauuugaggcgucugauaggaugcggauccaucgcgaauccggacucugucaagguuacaagagccugagaauugcaaggcuucugugcaaaucgaaggggucuuccuuggucaucucaauucuccugaguauguuacugcucagcuucgugacgcccauagagggcgcccuuacuaacuauccucaguccaagcuguacucuuuggaagagaucgcugacguggucgaaggacuaauuacagagcacaauguuaaagaguauaucguguuuuacaccagccuguucggcggucucauccugcuucuggccuuuauuuugucaauaaugcucacuaagguaacaaguaugcuggcacggaccaacgugaucuauugugaagagugcuccauguaccacagcaaaacggggauuaaguauaacggagauuucaccaauaaauguggcuuuugcacaugugacgaacaggaggaugcugaaggcaucauuauccauaaggucucuaagaaaugcacuuacaaguaccaguuaaaaugggcccgcauaaucaugauuauccugauugugcuacucaccacacaaaacacuauccugauaguugcggccgagguggacugcugggagcgagcaacccuuucacaggaauguauugggccauugcagaagaucgaggauugccagaauaaagaagagaagacauauaugagugaagcuaacaagcuggucagccaauccaaaauuacccaggccgacgcugaccaggugucuguacucggagauacuaucgacucggccauaaaggcaaucagaagccagaaaacguaccaaacaaugcaucugcuugagaccguuuuccugaugaagaauugugauuauuacuccacuuuugagcacaacucagguuauagucaggccaaauggagguugauggcuaagaccaaucacuucgacauuugcucucggcauagcaaccaccacuuuugucguugcgugacagaaggcaccaagugucagaauggggauugggacuucgcgggagagaugaacuccacuuacaauacaaaaucagauuuuuaucaacaugaccucaaccuguucuucagcuuauacgaaucugcauuucccggcacggccgagucccuguucuaccagcuaaucagugagaagaauaccacuggugcuagccagcuccuggggcagauuaucaaaaaguuugccaacaauaacaugcuuauaggcgucuggaaauucggacaauauuugcugacacucccuuacgugaacaccacaaagcugucuaaaucccgcgaagagacuauuuuaaccaaucaccagagacuggucaggucauauacgggccggcagcagaguauggcaaacgccgaagugggggagagcaccaagaauugccuuaacgcuaagaauguuggauguaucucgccacgauuuggugugccgaucggcaacuugacaguaugcggggaauccacuaauuacaaagucuauaagacccccgccaaaauuuacaagucuaacaaucgcccuaaaacaugguguagcgaggaugugcauugccucucaaacuucgagccagcaagugcggaaguugugaauaagaucaagagaaugacuugcuuucugaccgacgucacgacaaacguggauguauucuccauugcuauaucuaccuguaaaauggccgacaagggagugugcacuguuaaugacgcaagguggagcauccuaaaaugugauuccggccugcucuauuuuacagaccaccgggagggucaagauaccgggaacgacuucggcgaauacugcauuucacacaauuguaacacugagcgcuaccccaucaacccugauauuaucaaggacugcauaugggaauaucauagcagaaaaaguaaguacaucucugccauuaaucuggagucccuugaggaauuuaggcgugcuaugagcgagaaguugucgcacacccuggucaucuauaacuucaaaccaacagccaauuuaccccauauuaagccgucauacaaaucuaucacggugaacggaauagaaaauagugauggcauugaguccgcauauauccucagcaacaucccugcuauugggggaaugucuguggguuacaauguccugaccaaggacggcuuuccccuucuggauauaaucauuuucaucaaaagcgccguuauuaagacuacauauaaccacaucuacgacaccgggccaacaauaggaaucaauacuuugcaugaugaaaaguguaccggcccuugccccuccauuaucccacacaaagagaacuggcucacguucucacaggagcggacaagucgaugggguugugaagaguuugggugccuggcgauuaauaccggcuguguguucggaagcugccaggacaucauaagacccgaaacuaagauuuacaggaaagccguggaggaggaaguaauccuaaacgcuugcaucaauuuuccuggcaacaccuauuguacagagauuaaugcaaucgaaccaaagauaacugaugagauugaacugcaguucaaaaccgucgacacaaagacgcucccgaaccugcuugccgugcaaaaccacaaauuguacucugggcagaucaaugacauuggaaccuuuucccagggcugcgguaacguucaaaagacuaaucagacaaugcuggggaccggaacugugcgcuucgauuaugucugucauggcgcuucacggaaggacaucauagugagaaggugcuacaacaauaacuaugagaguuguaaauuacucaaggaggaaaaaucccugauuuuugccgauaaucacgagacacuugaaguugcaaacacccgccaucugcuaggugagcuccaguucaagaucaugcugggcgacauccgauacaaagcguuugccgaaaagcccgaguuggagauugaugcuaagugcgugggguguccuuccugcuucgaaucuuauucguguaauuuucagaucguaagcaacgucgacacggugugcuacauugagggaccauguacucuguuccacaaucggauaaucauuaaaaccaugaagcaagccuacggcaucaaaaugucaugcaagacaaaacccgcaccuuccgaagaguucaagaucugcgggcguaccuauaacguggcuuuuaauacugucgaaaagaacgauaaaauugagauaaauacaggagaccagaccaguuacaucucugagaaggaugacagauguaaaacaugguuaugcaggguucgcgaugaaggcauuagcgugaucuucgagccacucaagaaccuguuugguaauuauuucaacauugccuuuuacaucauaaucgggcuuauugcacuguucuugacuaucuauauuuuucuccccauguucuuuaaacugcgggacguacuaaagagaaacgaauaccuguaucuucaggagcucaagcauaaauga

SEQ ID NO: 10929 - RNA, 4311 nt, Artificial Sequence
  derived and/or modified CDS sequence (opt3) from TENV(TSV-FL06)__FJ943506.1__GP
auggagaucuucuuuauugcccugcucgcuauagcaagcuccgugaacucuacaccccuugccaccagaugcuuccacggcgggcagcugaucgcggaaucaaagagugcuacuagcuuguccgaguuuuguuuaaaagacgaugucucuaugauuaagucggaaaucuacuauguuaaaaaugagacgggaauuuucucauacaacaaggugcugaggagcuggaccaucaaagacuggaaguuuugcaauccuguaccaacagccgguggcaguauaaacgugaucgaagucaauuccgauaugucucuagcaacuaagaccuauguguguagccgggacugcacaauuaccaucgaucgcgaggaggcccaaauuaucuuccagacugaaaaacucaaccauuuugagguuuccgggacaacccugucaaguggaugguucaagagcaaggcuucugugacgcuugaccgaacuugugaacaccugaaagugaccugcggcaaaaaguccuugcaguuucaugcauguuucaagcaccauaugucaugcauaagauuuuuccacaauacaaugcucccgggucguauugucaacagcaugugucagaauaucgagcugauuaucauccuggggcucacuauuguaauauuuaucuuaaugguuauucugaccaaaacauacaucugcuauauacuuaugcccuuguucaugccuguggccuacauuuauggaugggcuuacaacaagaguuguaaaaagugcaauugcuguggccuggccuaccacccauucaccaacugcggcucucauugugucugcgggcuaaaauuugaggcguccgauaggaugcggauccaccgcgaaagcggacucugucaagguuauaagucgcugagaaucgcaaggcuucugugcaaaucuaagggcuccucauuggugauuaguauccuccugagcauguuacugcucuccuucgugacgcccauugagggggcccuuacuaauuacccucagucuaagcuguauagcuuggaagagauagcugacgucguugaaggacuaaucacagagcauaacgugaaagaguacauuguauuuuauaccucacuguucggcggucucauccugcuucuggccuuuaucuugaguauuaugcucacuaaggugacauccaugcuggcacggaccaaugucauauacugugaagagugcagcauguaucacucuaaaacggggaucaaguacaacggagauuucaccaacaaauguggcuuuugcacaugugacgaacaggaggaugcugaaggcauuaucauucacaaggugucaaagaaaugcacuuacaaguaucaguuaaaaugggcccgcaucauaaugaucauucugaucguucuacucaccacacaaaauacuauucugaucguggcggccgaggucgacugcugggagcgagcaacccuuagucaugaauguauagggccauugcagaagauugaggauugccagaacaaagaagagaagacauacaugagcgaagcuaauaagcuggugucccagucuaaaaucacccaagccgacgcugaccagguaucgguucucggagauacuauugacagcgccaucaaggcaauaagaucccagaaaacguaucaaacaaugcaucugcuugagaccguguuccugaugaagaacugugauuacuauucaacuuuugagcacaauagugguuacucucaggccaaauggagguugauggcuaagaccaaccacuucgacaucugcagccggcauuccaaucaccacuuuugucguugcgucacagaaggcaccaagugucagaacggggauugggacuucgcgggagagaugaacucaacuuauaauacaaaaagcgauuuuuaccagcaugaccucaaucuguucuucucuuuauacgaauccgcauuucccggcacggccgagagucuguucuaucaacuaauuagcgagaagaacaccacuggugcuucucagcuccuggggcagaucauuaaaaaguuugccaauaacaauaugcuuaucggcguguggaaauucggacaguacuugcugacacucccuuaugucaacaccacaaagcuguccaaaucacgcgaagagacuaccuuaacgaaccaccaaagacuggugaggaguuacaccggccggcagcagagcauggcaaaugccgaaguuggggagucgacaaagaacugccuuaaugcuaagaacgugggauguauauccccacgauuugguguaccgauuggcaauuugacugucugcggggaaucuaccaacuauaaaguguacaagacacccgccaaaaucuauaagagcaauaaccgcccuaaaacuugguguucagaggauguucauugccucaguaauuucgagccagcauccgcggaaguggucaacaagaucaagagaaugaccugcuuucugacggacgugacaaccaauguagauguguucucuauugcuaucagcacuuguaaaauggccgacaagggaguuugcacagucaacgacgcaaggugguccauucuaaaaugugauucaggccugcucuacuuuaccgaccaccgggagggucaggauacugggaaugacuucggcgaauacugcauaagccacaacuguaauaccgagcgcuaucccaucaacccugauauuaucaaggacugcauuugggaauacuauaguagaaaaucuaaguacaucuccgccauaaaccuggagagccuugaggaauuuaggcgugcuaugucggagaaguugucacauacacuggugaucuauaauuucaaaccaacggccaacuuaccccacauuaagccgucuuacaaaaguaucaccgugaauggaauugaaaacuccgauggcaucgagagcgcauauauacucucuaauauuccugcuaucgggggaaugagcgucgguuacaacguucugacuaaggacggcuuuccccuucuggauaucauuauauucaucaaauccgccgugauuaagacaaccuacaaucauaucuaugacacagggccaacuauuggaaucaacaccuugcacgaugaaaaguguacgggcccuugccccucaauaaucccacauaaagagaauuggcucacauucagucaagagcggaccagccgaugggguugugaagaguuugggugccuggcgauuaacacuggcuguguguucggaucuugccaggacaucauuagacccgaaaccaagaucuacaggaaagccguagaggaggaagucauacuaaaugcuugcauuaacuuuccuggcaauacauauuguacugagaucaacgcauucgaaccaaagaucaccgaugagauugaacugcaguuuaaaacaguggacacgaagacccucccgaaucugcuugccguucagaaccacaaauuguacuccgggcaaaucaacgacauaggaacuuucucacagggcugcgguaaugugcagaagacaaaccaaaccaugcuggggacuggaacaguccgcuuugauuaugugugucacggcgcuagucggaaggacauuaucguuagaaggugcuacaauaacaauuaugagagcuguaaauuacucaaggaggaaaaaucccugauuuucgccgauaaccaugagacccuugaaguggcaaauacgcgccaucugcuaggugagcuccaguuucgaaucaugcugggcgacauacgguacaaggcguucgccgaaaaacccgaguuggagauugaugcuaagugcguaggguguccuucuugcuuugaaucguacagcuguaacuuccagaucgucucaaauguggacacugugugcuauaucgagggaccauguacccuguuccacaaccgugucauuaucaagacaaugaaacaggccuacggcauuaagauguccugcaaaaccaagcccgcaccuagugaagaguuuaaaauaugcgggagaacuuauaauguugcuuucaacacaguggaaaagaaugauaagaucgagauuaacaccggagaccaaacaucuuacaucagcgagaaagaugacagguguaagacuugguuaugccgcguacgggaugaaggcaucuccgugauuuuugagccacucaaaaaucuguucgguaacuauuuuaauauagccuucuacaucauuaucgggcuuauugcacuguuuuugaccaucuauauauuccuccccauguuuuucaagcugagagacguccuaaaaaggaacgaauaccuguaccuucaggagcucaagcacaaguga

SEQ ID NO: 10930 - RNA, 4305 nt, Artificial Sequence
  derived and/or modified CDS sequence (opt3) from TLAV(61D240)__KX100119.1__GP
augcuguuccuccuuauccuggccuuuuugggcuucagcaccuccaaccccauugcuacaagaugcuuucacgggggacaguuaauagcagagucuaagucagccacuuccaucagcgaauuuugucugaaagacgauguguccaugcuaaagucugaggucguuuacacgaaaaaugacaccggucucuuuggccauaacaagguguucaggucguggacaauuaaagauuggaagcugugcaauccuaucccaacugcugggggaaccauuaacguaaucgaagugaauaaggaccuuucacugaugacaaaaaccuauauauguagccgggauugcacuaucacaauugacaaggaggaagcgcaaaucauuuuucagaccgauaaauugaaccacuucgaggucaguggcacgacucucaauuccgguugguuuaagucuaaagccagcgugacccuggaccgcacaugugagcauguuaaggugacuugcgggaagaaaucccugcaguuccacgcauguuuuaagcaucacaugucaugcguccgauucuuucacaacaccauccucccgggaaauaugauaacaaguaugugucagaacauugaauuaaucauuauccugggccuuaccuuggccaucuucauucugauggugaugcuaacgaaaacuuacauaugcuaucuccugaugcccaucuucaugccuauugcuuaccuuuauggcugggcauacaauaagagcuguaaaaagugcaacugcugugggcuggccuaucauccauuuacaaauugcggaucucacuguguaugcgguuugaaauucgaggcuuccgaucguaugagaauccauagggaaucaggccucugucaaggguacaagagccugcggauagcccgcuuacugugcaagaguaaaggaucuucccucguuauuagcggccuucugucgauguugauccuaucuuuugugacccccaucgaggguacuauuacauccuacccugagucaagaaaguauacccuggaagagaucacggacgucguggaagggcucgugagugagcagaacauuaaagaauacauagucuucuauaccagccuguuuggaucccuuauccuguugcucgcguucauuaugucuaucacacugagcaagaucacuucaauuuuagcaaggcggaauguuauauacugugaggagugcaguauguaucacuccaaacgcggcaucaaguacaacggcgauuuuaccaacaaguguggguucugcacauguaaugaacaggaggacgccgaaggacuggugauucacaaaguaagcaagcgaugcacuuauaaauaccagcuaaagugggcuaaagugcucauggucacccuggugcuuuugcugaucgcccaaaacacaauucucaucguugcagcugguaccgauugcuggacuaagaagucucuggacauagacuguaucggcccaaugcuugauauugggucaugcacgaauaaaaacacaagaaauuacgacaccgaggcccagaagcuggugagucagagcaaagucucccaguuggaugcggaccaagccucucuccugggaaacucgaucgauagcgcaauuaaggcuaucagggcccagaaaacuuaucccaccaugcauuuacuggaaacaauauuucuaaugaagaauugugacuacuauaccuccuucaaccacaauucaggcuacagucaggcuaaguggcggcucauugccaaaacuggucauuuugauaucugcucucgucacagcacacaucacuucugucgcugcauuaacgacgggacgaagugucaaaauggcgauugggacuuugcaggagagaugaacgagaccuauaauuccaaaaacgauuucuacucacacgaccugaaucuuuucuauacuaucuuugaaaacgccuucccuggcacaaccgagagcuuguuuuaccagcugauacagaagaaaaacacaacuggggcuucuaagauccucggaaaacugauuaccaaguacgguaauaagaacauguucgugggcguauggaaauuugggcaguauuuacugacgcuuccauacaucaauaacaccgaauugucccaaaauagaaggcagacaauucucgcgacucaggagagucugagccggucucauuccggacgacaggaaucaaugaguagcgcaauccaaggcucgguuaccaaggagugccacaacgccaaagacguggguuguauauccccgcgcuucgggauucccaucggcaaucuaacagcuugcggagauucuccuaacuauaagaucuacaaaacuccagagaagcuguauaagagcaauaacaaaggcgaagucugguguucaaaugacgugcauugccucaacgauuuugagcccgccgacgaagaggucgugaauaagguuaaaaagcugaccugcuuccuuacggaugugaguguaaaaacagacauuuuuagugucgcagccucuaccuguaagauggcugauaagggggugugcacuguuaacgacgccaaauggaauaucauuaagugugauagcggauuguacuauuucacagaccacagagagggucaggauaccggcaacgacuuuggggaauacugcauaucccacucauguaacacugagagguucccuaucaauccagauauucugaaagacugcaccugggaauuucauagccggaagaguaaauacaucucuacaauuuccuuagagagccucgaagaguuccgcagagcaaugacggagaagcugucgcacacccuuacuaucuauaacuucaagcccacagcgaaucugccgcauauaaggccuaccuacaaauuuaucacagcuaacggaguggaaaauucagacggcauugagucugccuauaucuugaguuccauucccgcacucggugggaucagcgucggcuacaacgugcagacuaaggauaauuucccacugcuagacauaauuguauuuaucaaaucugccgugauccguaccacguauaaccacauuuacgauacaggaccuaccauaggcaucaauacucagcaugacgaacacuguaccgggcccugcccagcuguugucccccacaaggagaacuggauuacauucagccaagaacggacuucccgauggggaugugaggaguuuggcugccuggccaucaauaccgguuguguguucgggucaugccaggauauuauccauccugaaacaaaaguguauagaaaggcagucgaggaagagguuauacucacggugugcaucaacuuuccaggaaauaacuacuguaccgaaauuaaugcuaucgagccgaaaauuacugacgagaucgaacugcaguucaagacaguggauaccaagacucuucccaacuugcuggccguacagaaccacaaauuauacaguggccaaauaaaugaccucgguagcuuuucucagggcugcgggaacguccagaagacaaaucauuccauucugggaaugggcaccgcgaaauucgauuaugugugucacggggccucaaggaaggacguuaucgugcgccggugcuacaacaauaacuuugauaguuguaaacuucugaaggaggaaacgagccuaaucuucgcugacaaucaugagacucucgaggucgcacacaccaagcaccugauuggagaauugcaauucaaaaucaugcugggcgauauaagauauaaguccuuugccgagucuccugaauuagagauugacgcuaaaugcguggguuguccaucgugcuucgaaagcuacucauguaacuuucagaucguuacaaauauugacaccgugugcuccguagaggggcccuguacucucuuccauaacaggaucauaauuagugccaauaagcagucuuauggacugaaaaugagcugccagacaaagccuaaccaaaaugaggaauuuaucaucugcaaccgcaaguacuccguccuuuucaccacaauugauaaaaaugacaagaucgaggugaacacuggcgaucagaccucauauauuuacgaaaaagacucucgauguaagacguggcugugccgggugcgugaugaggguauaagcgucuuguuugaaccacucaaagcauucuuuggcaguuacuucuccaucauuuucuauguugugguagggaucaucgugcuguuccuaauuauauacaucuuucugcccauguucuucaaacuuaaggacguccucaagagaaaugaguaucuguacuugcaggagcugaagcacaaauga

SEQ ID NO: 10931 - RNA, 4305 nt, Artificial Sequence
  derived and/or modified CDS sequence (opt3) from NRIV(9800535)__AY593725.1__GP
augcugcuccuucugguguuguuaauccccugcuacgucagcgccuccccuguugugaccagauguuuccacggcgggcagcugauugcugagaagaaaucucaaacagcaguaucagaauuuugccuaaaggacgaugugaguacuauaaaaagcgagaucacguaugaaaagaacaauaccggacucuucgcccauuccaaaguccugaggaacuggauuaucaaggacuggaagaauuguaacccagugccgacagcggguggcucuauuaauguuaucgaggugaacacugaucuuucgcugaccacaaaaaccuacgucugcucacgggacuguacuauaacaguggauaaggaagacgcucagaucauuuuucagaccgagaaauugaaucacuucgagguaagcgggacgacucucaguuccggaugguuuaagaccaaagccucuguuacacuggaucgcacuugcgaacauaucaaggugaccuguggcaagaaaacacugcaguuccacgcaugcuuuaagcaucacaugagcuguauucgauucuuucacgguaccauccuccccgggacgauggccacuuccauaugccaaaacauugaguuaaucauuaucaucucacugacacuuauuauauucaucuugaugauuauccugaccaaaacuuauauauguuaccuacucaugccucuguuuaugccaauugcuuauuucuacggauggaguuauaauaagagcugcaaaaagugcucuuguugcggccuugcauaccaucccuuuacaaacuguggcucccacugcgucugugggcugaaauucgaagccucagaccguaugagaauccauagggagagcggauugugccaggguuacaagagucuccggguggcucgccuguuauguaagucuaaaggcuccagccuggugaucucgauucuccuuucuaugcugaucuuguccuucgucaccccuauugaggggacgcuaaccaauuauccagaaucaagaaaguacgaucuggaggaaauagccgacguucucgagggauuuaucguggaaaaaggcauuaaggaguauguaguguucuacacaaguaucuuuggugcgcugcuucuguugaucgcacucgucauuacuauaacccugaacaaagugacagaguauuuaacuaauaucaacguucuguacugcuaugaauguagcauguaccacuccaagaagaauauuaaauacaucggggauuucaccaacaagugcggauuuuguacaugcggcgagcuagaagaccaggagggccucaaaauucacaaggugucuaggaaaugcaucuauaaguaccagcugaccuggagcaagauaaucaugacuauucuugucuguuugcugaucgcccaaaacacgauucucaucguggcugccucagaugacugcuggacuaaaaagagucuggaaauggaguguauagggccccuucagcagguagauaccugcgacgacaaagcaucccggagcuauucuggagaggcucgcaagcugguucgagccucaaaaauuagugauuuggacgcggcccaggugggucuccugggcagcacuaucgaauccgcaauugcuucuaucagaaagcaaaggaccuacccuacaaugcauuuacuggagucggucuuccuagggaagcacugugauuauuacaaaaccuuugaacauaauagcggauauucccaggccaaguggcggcucacugcuaaaacacaccauuucgacauaugcucacgucacaguacgcaccauuuuugucgcugcaucucugauggcaccaagugucagaacggugaccuggauuucgccggggagaugaauagcacuuaccaauccaaaaaggacuuuuucgaacacgauuuuaaacuuuucugcacauugguggagaacgcauucccaggcaccacagagucacuguuuuacgaaaugcucagcaagaagaauacuaccggaauuaaacagcuguuagacaagcugacgagaaaauucggcaacaauaacauguuugucgggaucuggaaguucggacaguaucuuaugucuuugccguacauuaaugagaccucccucacacccgcccagaucaguaaaauacuggaagugacugaccaacaucacaggagcauuucuggucggcaggagucccuagcuucagcgaccccuggcaguaagagcaaggagugugggcacgccaaaaagguuucgugcaucuccccacgauuuucugugcccauggaaggacugauggcaugcggcgauagcccuaacuauaaaaucuacaagacaccaacuaaacucuauaagucaaauaacaagggugagguaugguguaguggggacguccauugcucccaggaacugucucccgcuagccaggaguccguggaucgcauuaaacaaaucaccuguuuccuuacggaaccggagguuucagacgauguguuuagcauugccauaaguacaugcaagguccaggacaaaggcguguguaccguaaaugaggauagauggaacgugaucaagugcgacucuggauugauuuacuauacugaucagagggacggccaggauacagggaaugacuucggagaauacugucugucccacagcugccggaucgagcgcuuuccuauuaaccccgcaaucauaagagauuguuuaugggaauaccauucgaggaaaucaaaguauaucaccucucucgaccuggagaaccuugaagaguucaagcgugccauuagugagaaacugucccacacuuugaucguuuacaauuuuaagccaaccgcuaaccucccucauauuaaacccgucuauaaguacaucacagugcaagguguggaaaauagcgacggcgucgauucugccuauauagcagcgagcaugccagcucuguccgggacgucaauuggauacaacaucaugagucgggacaauuucccccuauuugauaucauuauauucaucaaaagcgccauuaucaaggcaaccuauaaccacauuuacgacacuggcccuacaaucgguauaaauguuaugcacgaugagcauugcaccgggcaguguccaacagacaucccgcacaaagaaaacuggauuacuuucgcccaggagcgaaccucuagauggggcugcgaagaguuuggaugccuggcugugaauacgggcuguguguucggguccugccaggauaucauuaggcccgagacaaagguauaccgcaaggccgucgaagagucagugcuccugaccguuuguaucacuuauccuggaaaaaccuuuugcacagaaauaaacgcaauugagccaaagaucacugacgagcuugaauugcaauucaaaaccguggauacaaagacgcugcccaauaucuuagcuguccagaaccauaaacucuacaguggccagauuaaugaccuggguagcuuuucccaaggguguggaaacauccagcggaccaauucuucgauaauuggcacugguacagccaaguucgauuaugugugccacggcgcgagcagaaaggacaucauuguuaggcgcuguuacaacaacaauuaugagucaugcaaacuucugaaggaagaacagucccuaauguuugccgauaaccaugaaaccaucgacguggcuaauguacgacaccuccugggggacuugcaguucaaacugauguuaggagaucuccgguacaagaguuuugcagagaacccugaccuggagauagaagccaaaugugucggcugcccaucuuguuucacuagcuauuccugcucauuuaagauugcuucuaauaucgauacagugugcagcaucgaggggcccuguaccacguuccacaaccgucuuaugauuacaaguaccaagcaagacuacggaaucaaaauguccugcaagacaaaaccgaaggaaaccgaggaguuccagauuuguaaaaagacuuacacagugcuguuuaccacagucgagaagaaugauaaaauagagaucagcacuggcgaccagaccucuuucauucaggaaagagaugacaggugcaagacgugguugugucgcguucgggaugaggguaucucagugaucuuugaaccuauuagagccuucuuuggguccuauuucaguauagcauuuuacguagugaucagcauuaucguccucuuccuggcgauuuauaucuuucuaccaaugguguucaaacugagggacguucuuaagcgaaacgaguaccucuaucugcaagaaauaaaacauaaguga

SEQ ID NO: 10932 - RNA, 4305 nt, Artificial Sequence
  derived and/or modified CDS sequence (opt3) from NRIV(GSA/TS7/5170/WT)__KM514677.1__GP
augcugcuccuucugguguuguuaauccccugcuacgucagcgccuccccuguugugaccagauguuuccacggcgggcagcugauugcugagaagaaaucucaaacagcaguaucagaauuuugccuaaaggacgaugugaguacuauaaaaagcgagaucacguaugaaaggaacaauaccggacucuucgcccauuccaagguccugcggaacuggauuaucaaagacuggaagaauuguaacccagugccgacagcggguggcucuauuaauguuaucgaggugaacacugaucuuucgcugaccacaaagaccuacgucugcucacgcgacuguacuauaacaguggauaaagaagacgcucagaucauuuuucagaccgagaaguugaaucacuucgagguaagcgggacgacucucaguuccggaugguuuaaaaccaaggccucuguuacacuggaucgaacuugcgaacauaucaaagugaccuguggcaagaagacacugcaguuccacgcaugcuuuaaacaucacaugagcuguauucguuucuuucacgguaccauccuccccgggacgauggccacuuccauaugccaaaacauugaguuaaucauuaucaucucacugacacuuauuauauucaucuugauggucauucugaccaagacuuauaucuguuaccuacucaugccucuguuuaugccaauagcuuauuucuacggauggaguuauaauaaaagcugcaagaaaugcucuuguugcggccuugcauaccaucccuuuacaaacuguggcucccacugcgugugugggcugaaguucgaagccucagacagaaugaggauucaucgggagagcggauugugccaggguuacaaaagucuccgcguggcuagacuguuauguaagucuaagggcuccagccuggucaucucgauccuccuuucuaugcugauuuuguccuucguuaccccuaucgaggggacgcuaaccaauuauccagaaucaaggaaauacgaucuggaggaaauugccgacgugcucgagggauuuauaguagaaaagggcaucaaagaguauguggucuucuacacaaguauuuuuggugcgcugcuucuguugauggcacucgugaucacuaucacccugaacaagguuacagaguauuuaacuaauauuaacgugcuguacugccacgaauguagcauguaucacuccaaaaagaauauaaaguacaucggggauuucaccaacaaaugcggauuuuguacaugcggcgagcuagaagaccaggagggccucaagauucauaaagucucucggaagugcaucuaccgcuaucagcugaccuggagcaaaauuaucaugacuauacuuguguguuugcugaucgcccaaaacacgauucucaucguagcugccucagaugacugcuggacaaagaagagucuggaaauggaguguauugggccccuucagcagguugacacaugcgaugacaaagcaucccgaagcuacucuggagaggcuaagaaacuggugagagccucaaagaucagugauuuggacgcggcccaggucggucuccugggcagcacuauagaauccgcaauugcuucuaucaggaaacaacggaccuauccuacaaugcacuuacuggagucgguguuccuagggaagcauugugauuacuauaagaccuuugaacacaauagcggauacucccaggccaaauggcgucucacugcuaagacacaucacuucgacauuugcucacgccacaguacgcaucacuuuuguagaugcaucucugauggcaccaaaugucagaacggugacugggauuucgccagcgagaugaacuccacuuaucaaucaaagaaagacuuuuucgaacaugauuuuaagcuguucugcacacuugucgagaaugcauucccagggaccacagagagcuuguuuuacgaaaugcugucuaaaaagaauacuaccggcauaaagaaccuccuggacaaauuaacgaggaaguucggaaauaacaauauguuugugggcaucuggaaauucgggcaguaccugauuucccuuccguauguuaacgagaccaguuugacacccgcccaggugagcaagauccucgaaguaacugaccagcaccaccggucuauuuccggacgacaagagucacuggcuagugcgaccagcgguucgaaauccaaggaguguggccaugcaaagaaagucucuugcaucagcccucgcuuuucagugccaauggaagggcuaauggccugcggagauagucccaauuacaagauauauaaaaccccugcuaagcuguacaaauccaacaauaagggcgagguuugguguucuggugacgugcacugcagccaggaacucuccccagccucacaggagagcgucgauagaauuaagcagaucacuuguuuccugaccgaacccgaggugagugacgauguauuuucuaucgcaauuuccacgugcaaagugcaagacaaggggguuuguacagucaacgaggauagguggaaugugaucaaaugcgacagcggccuuauuuauuacaccgaucagcgggacggacaggauacuggcaacgacuucggggaauauuguuugucgcauucaugccgcauagagagauuuccgaucaacccuacaauuaucucugauugucugugggaauaccacaguaggaaguccaaauacauuaccagcuuagaccucgagaaucuggaagaguucaagcgugccaucucugagaaacuuagccauacucugauaguguauaacuuuaaacccaccgcuaauuugccacacaucaagccugucuacaaauauauuacaguucagggaguggaaaacuccgacgguguggauucagccuacaucagugcaagcaugcccgcgcucucuggcacguccauuggguauaauaucaugucacgggacaacuucccacuguuugauauaauuaucuucaucaagagugcuauuauaaaagccaccuacaaucacaucuaugacacuggacccacaauuggcaucaacguaaugcaugaugagcacugcaccggucaauguccuacagacauuccacauaaggaaaauuggaucacuuucgcacaggagcgaaccagcagaugggggugcgaagaguuuggcugccuagccgucaacacgggauguguguucggcuccugccaggauauaaucaggccggagacaaaaguuuaccgcaaggcuguggaagagucuguccugcucaccguguguauuacuuaccccgggaagaccuuuugcacagaaaucaaugccauugagccuaaaaucacugacgagcuggaacuucaguucaagaccguugauacaaaaacguugccaaacauacuggcagugcaaaaucacaaguuauauucgggacagauuaacgaccucggcagcuuuucacaggguugugggaauauccaaaagaccaacuccaguaucauuggaacuggcacagcuaaguucgauuacguaugccauggugccucucggaaggacaucauagucagaagguguuauaacaauaacuacgagagcugcaaacugcuuaaggaagaacagucccugauguuugcggauaaucacgaaaccauugacguggccaacgugcgccaccuacucggcgaccugcaguucaaauugaugcugggggauuuacgauauaagucauuugcugagaaucccgaccucgagaucgaagcaaaaugugucggaugcccuucuuguuucacuagcuacaguugcuccuuuaagauugccagcaacaucgauacaguuugcucuauagagggcccauguaccacguuccauaaucggcugaugauuacuucaaccaagcaggacuaugggaucaaaauguccugcaagacaaaacccaaggaaaccgaggaguuccaaaucuguaaaaagacuuacacagugcuuuuuaccacaguagagaagaacgauaaaauugagaucaguacuggagaccagaccagcuucauucaggaacgugaugacagaugcaagacguggcuguguagggugcgcgaugagggcauaucggucaucuuugaaccgauucgggcuuucuuugguucuuacuucuccaucgccuuuuaugugguugugaucauuauagucuuguuccucgcaaucuacauuuuucugccuaugguguucaaacuaagagacguucugaagaggaaugaguaucuuuaccuccaggaaaucaaacacaaguga

SEQ ID NO: 10933 - RNA, 4305 nt, Artificial Sequence
  derived and/or modified CDS sequence (opt3) from NRIV(TND/S1/19801/WT)__KM514679.1__GP
augcugcuccuucugguguuguuaauccccugcuacgucagcgccuccccuguugugaccagauguuuccacggcgggcagcugauugcugagaagaaaucucaaacagcaguaucagaauuuugccuaaaggacgaugugaguacuauaaaaagcgagaucacguaugaaaggaacaauaccggacucuucgcccauuccaagguccugcggaacuggauuaucaaagacuggaagaauuguaacccagugccgacagcggguggcucuauuaauguuaucgaggugaacacugaucuuucgcugaccacaaagaccuacgucugcucacgcgacuguacuauaacaguggauaaagaagacgcucagaucauuuuucagaccgagaaguugaaucacuucgagguaagcgggacgacucucaguuccggaugguuuaaaaccaaggccucuguuacacuggaucgaacuugcgaacauaucaaagugaccuguggcaagaagacacugcaguuccacgcaugcuuuaaacaucacaugagcuguauucguuucuuucacgguaccauccuccccgggacgauggccacuuccauaugccaaaacauugaguuaaucauuaucaucucacugacacuuauuauauucaucuugauggucauucugaccaagacuuauaucuguuaccuacucaugccucuguuuaugccaauagcuuauuucuacggauggaguuauaauaaaagcugcaagaaaugcucuuguugcggccuugcauaccaucccuuuacaaacuguggcucccacugcgugugugggcugaaguucgaagccucagacagaaugaggauucaucgggagagcggauugugccaggguuacaaaagucuccgcguggcuagacuguuauguaagucuaagggcuccagccuggucaucucgauccuccuuucuaugcugauuuuguccuucguuaccccuaucgaggggacgcuaaccaauuauccagaaucaaggaaauacgaucuggaggaaauugccgacgugcucgagggauuuauaguagaaaagggcaucaaagaguauguggucuucuacacaaguauuuuuggugcgcugcuucuguugauggcacucgugaucacuaucacccugaacaagguuacagaguauuuaacuaauauuaacgugcuguacugccacgaauguagcauguaucacuccaaaaagaauauaaaguacaucggggauuucaccaacaaaugcggauuuuguacaugcggcgagcuagaagaccaggagggccucaagauucauaaagucucucggaagugcaucuaccgcuaucagcugaccuggagcaaaauuaucaugacuauacuuguguguuugcugaucgcccaaaacacgauucucaucguagcugccucagaugacugcuggacaaagaagagucuggaaauggaguguauugggccccuucagcagguugacacaugcgaugacaaagcaucccgaagcuacucuggagaggcuaagaaacuggugagagccucaaagaucagugauuuggacgcggcccaggucggucuccugggcagcacuauagaauccgcaauugcuucuaucaggaaacaacggaccuauccuacaaugcacuuacuggagucgguguuccuagggaagcauugugauuacuauaagaccuuugaacacaauagcggauacucccaggccaaauggcgucucacugcuaagacacaucacuucgacauuugcucacgccacaguacgcaucacuuuuguagaugcaucucugauggcaccaaaugucagaacggugacugggauuucgccagcgagaugaauagcacuuaucaaucaaagaaagacuuuuucgaacaugauuuuaagcuguucugcacacuugucgagaacgcauucccagggaccacagagagcuuguuuuacgaaaugcugucuaaaaagaauacuaccggcauaaagaaccuccuggacaaauuaacgaggaaguucggaaauaacaauauguuugugggcaucuggaaauucgggcaguaccugauuucccuuccguauguuaacgagaccaguuugacacccgcccaggugagcaagauccucgaaguaacugaccagcaccaccggucuauuuccggacgacaagagucacuggcuagugcgaccagcgguucgaaauccaaggaguguggccaugcaaagaaagucucuugcaucagcccucgcuuuucagugccaauggaagggcuaauggccugcggagauagucccaauuacaagauauauaaaaccccugcuaagcuguacaaauccaacaauaagggcgagguuugguguucuggugacgugcacugcagccaggaacucuccccagccucacaggagagcgucgauagaauuaagcagaucacuuguuuccugaccgaacccgaggugagugacgauguauuuucuaucgcaauuuccacgugcaaagugcaagacaaggggguuuguacagucaacgaggauagguggaaugugaucaaaugcgacagcggccuuauuuauuacaccgaucagcgggacggacaggauacugccaacgacuucggcgaauauuguuugucgcauucaugccgcauagagagauuuccgaucaacccuacaauuaucucugauugucugugggaauaccacaguaggaaguccaaauacauuaccagcuuagaccucgagaaucuggaagaguucaagcgugcuaucucugagaaacuuagccauacucugauaguguauaacuuuaaacccaccgccaauuugccacacaucaagccugucuacaaauauauuacaguucaggggguggaaaacuccgacggaguggauucagcauacaucagugcgagcaugcccgcucucucugguacguccauuggcuauaauaucaugucacgggacaacuucccacuguuugauauaauuaucuucaucaagagugccauuauaaaagcaaccuacaaucacaucuaugacacugggcccacaauuggaaucaacguaaugcaugaugagcacugcaccggccaauguccuacagacauuccacauaaggaaaauuggaucacuuucgcccaggagcgaaccagcagaugggguugcgaagaguuugggugccuagcugucaacacgggcuguguguucggauccugccaggauauaaucaggccggagacaaaaguuuaccgcaaggccguggaagagucuguccugcucaccguguguauuacuuaccccggcaagaccuuuugcacagaaaucaaugcaauugagccuaaaaucacugacgagcuggaacuucaguucaagaccguugauacaaaaacguugccaaacauacuggcugugcaaaaucacaaguuauauucggggcagauuaacgaccucggauccuuuucacagggcugugguaauauccaaaagaccaacuccaguaucauugggacuggaacagccaaguucgauuacguaugccauggcgcgucucggaaggacaucauagucagaagguguuauaacaauaacuacgagagcugcaaacugcuuaaggaagaacagucccugauguuugccgauaaucacgaaaccauugacguggcuaacgugcgccaccuacucggugaccugcaguucaaauugaugcugggcgauuuacgauauaagucauuugcagagaaucccgaccucgagaucgaagccaaaugugucgggugcccuucuuguuucacuagcuacaguugcuccuuuaagauugcuagcaacaucgauacaguuugcucuauagagggaccauguaccacguuccauaaucggcugaugauuacuucaaccaagcaggacuauggcaucaaaauguccugcaagacaaaacccaaggaaaccgaggaguuccaaaucuguaaaaagacuuacacagugcuuuuuaccacaguagagaagaacgauaaaauugagaucaguacuggggaccagaccagcuucauucaggaacgugaugacagaugcaagacguggcuguguagggugcgcgaugagggaauaucggucaucuuugaaccgauucgggccuucuuuggcucuuacuucuccaucgcauuuuaugugguugugaucauuauagucuuguuccucgcgaucuacauuuuucugccuaugguguucaaacuaagagacguucugaagaggaaugaguaucuuuaccuccaggaaaucaaacacaaguga

SEQ ID NO: 10934 - RNA, 4305 nt, Artificial Sequence
  derived and/or modified CDS sequence (opt3) from NRIV(9800521)__JX857326.1__GP
augcugcuccuucugguguuguuaauccccugcuacgucagcgccuccccuguugugaccagauguuuccacggcgggcagcugauugcugagaagaaaucucaaacagcaguaucagaauuuugccuaaaggacgaugugaguacuauaaaaagcgagaucacguaugaaaagaacaauaccggacucuucgcccauuccaaaguccugaggaacuggauuaucaaggacuggaagaauuguaacccagugccgacagcggguggcucuauuaauguuaucgaggugaacacugaucuuucgcugaccacaaaaaccuacgucugcucacgggacuguacuauaacaguggauaaggaagacgcucagaucauuuuucagaccgagaaauugaaucacuucgagguaagcgggacgacucucaguuccggaugguuuaagaccaaagccucuguuacacuggaucgcacuugcgaacauaucaaggugaccuguggcaagaaaacacugcaguuccacgcaugcuuuaagcaucacaugagcuguauucgauucuuucacgguaccauccuccccgggacgauggccacuuccauaugccaaaacauugaguuaaucauuaucaucucacugacacuuauuauauucaucuugaugauuauccugaccaaaacuuauauauguuaccuacucaugccucuguuuaugccaauugcuuauuucuacggauggaguuauaauaagagcugcaaaaagugcucuuguugcggccuugcauaccaucccuuuacaaacuguggcucccacugcgucugugggcugaaauucgaagccucagaccguaugagaauccauagggagagcggauugugccaggguuacaagagucuccggguggcucgccuguuauguaagucuaaaggcuccagccuggugaucucgauucuccuuucuaugcugaucuuguccuucgucaccccuauugaggggacgcuaaccaauuauccagaaucaagaaaguacgaucuggaggaaauagccgacguucucgagggauuuaucguggaaaaaggcauuaaggaguauguaguguucuacacaaguaucuuuggugcgcugcuucuguugauggcacucgucaucacuauuacccugaacaaagugacagaguauuuaacuaauauaaacguucuguacugccacgaauguagcauguaucacuccaagaagaauaucaaauacauuggggauuucaccaacaagugcggauuuuguacaugcggcgagcuagaagaccaggagggccucaaaauccauaaggugucuaggaaaugcauuuacaaguaucagcugaccuggagcaagaucauaaugacuauccuugucuguuugcugauugcccaaaacacgauccucauuguggcugccucagaugacugcuggacgaaaaagagucuggaaauggaguguaucgggccccuucagcagguagauaccugcgacgacaaagcaucccggagcuacucuggagaggcucgcaagcugguucgagccucaaaaauaagugauuuggacgcggcccaggugggucuccugggcagcacuauugaauccgcaaucgcuucuauuagaaagcaaaggaccuauccuacaaugcacuuacuggagucggucuuccuagggaagcauugugauuacuauaaaaccuuugaacacaauagcggauacucccaggccaaguggcggcucacugcuaaaacacaucacuucgacaucugcucacgucacaguacgcaucacuuuugucgcugcauaucugauggcaccaagugucagaacggugacugggauuucgccggggagaugaauagcacuuaucaauccaaaaaggacuuuuucgaacaugauuuuaaacuguucugcacacuuguggagaacgcauucccaggcaccacagagucauuguuuuacgaaaugcugagcaagaagaauacuaccggaaucaaacagcuccuggacaaguuaacgagaaaauucggcaacaauaacauguuugucgggauuuggaaguucggacaguaccugaugucucuuccguaugugaaugaggccuccuugacccccgcucagaucaguaaaauucucgaaguuacagaccaacaccacaggagcaucucuggucggcaggagucccuggcgucagcaacuccuggcaguaagagcaaggagugugggcaugccaaaaaggugucgugcauauccccacgauuuucuguacccauggaaggacuaauggcuugcggcgauagcccuaacuacaaaauuuauaagaccccaacaaaacuguacaagucaaauaacaagggugaggucugguguaguggggacgugcacugcucccaggaacucucucccgccagccaggaguccguugaucgcaucaaacaaaucacuuguuuccugaccgaaccggaggugucagacgaugucuuuagcauugcaaucaguacgugcaaggugcaggacaaaggcguauguacagugaaugaggauagauggaacguuauuaagugcgacucuggacuuauauauuacaccgaucagagggacggccaggauacugggaaugacuucggagaauauuguuugucccauagcugccggaucgagcgcuuuccuauuaaccccgccaucauuagagauugucugugggaauaccacucgaggaaaucaaaguacaucacaucuuuagaccucgagaaccuggaagaguucaagcgugcuauaagugagaaacuuucccauacccugaucgucuauaauuuuaagccaacugccaacuugccucacauuaaacccguguacaaguauaucaccgugcaaggugucgaaaauagcgacggcguugauucugcauacauugcggcuagcaugccagcccucuccgggacaucaaucggauauaacauaaugagucgggacaauuucccccuguuugauauuaucaucuucauuaaaagcgcaauaaucaaggccacguacaaccacauuuaugacaccggcccuacuaucgguauuaaugugaugcaugaugagcacugcacagggcaguguccaaccgacaucccgcauaaagaaaacuggauaacauucgcucaggagcgaacuucuagauggggcugcgaagaguuuggaugccuagccgugaauaccggcuguguauucggguccugccaggauaucauuaggcccgagacgaaggucuaccgcaaggcaguggaagagucaguucugcucacaguguguaucaccuacccuggaaaaacuuuuugcaccgaaauuaacgcuaucgagccaaagauaacagacgagcuggaacuucaauucaaaacugucgauaccaagacauugcccaauauucuggccgugcagaaccacaaauuauauaguggccagaucaaugaccucgguagcuuuucccaaggguguggaaacauccagcggacaaauucuucgauuaucggcaccgguacugcgaaguucgauuacguuugccauggcgccagcagaaaggacauaauugugaggcgcuguuauaacaacaauuacgagucaugcaaacugcuuaaggaagaacagucccugauguuugcugauaaccacgaaacaaucgacguagcaaauguccgacaccuacucggggaccugcaguucaaauugaugcugggagauuuacgguauaagaguuuugccgagaacccugaccucgagauugaagcuaaaugugugggcugcccaucuuguuucaccagcuacuccugcucauuuaagaucgccacuaauauagauacagugugcucuauugaggggcccuguaccacguuccauaaccgucugaugaucacuagcaccaagcaagacuauggaaucaaaaugaguugcaagacaaaaccgaaggaaaccgaggaguuccagauuuguaaaaagacuuacacaguccuuuuuaccacaguugagaagaaugauaaaaucgagauuuccacuggcgaccagaccagcuucauacaggaaagagaugacaggugcaagacguggcugugucgcgugcgggaugaggguaucucuguaauuuuugaaccuaucagagcauucuuugggucauacuucuccaucgcguuuuauguggucauuaguauaaucguguuguuccucgccauuuacaucuuucugccaaugguuuucaaacuaagggacgugcugaagcgaaacgaguaucuuuaccuccaagaaauuaaacacaaguga

SEQ ID NO: 10935 - RNA, 4305 nt, Artificial Sequence
  derived and/or modified CDS sequence (opt3) from NRIV(Adrar)__KJ716849.1__GP
augcugcuccuucugguguuguuaauccccugcuacgucagcgccuccccuguugugaccagauguuuccacggcgggcagcugauugcugagaagaaaucucaaacagcaguaucagaauuuugccuaaaggacgaugugaguacuauaaaaagcgagaucacguaugaaaagaacaauaccggacucuucgcccauuccaaaguccugaggaacuggauuaucaaggacuggaagaauuguaacccagugccgacagcggguggcucuauuaauguuaucgaggugaacacugaucuuucgcugaccacaaaaaccuacgucugcucacgggacuguacuauaacaguggauaaggaagacgcucagaucauuuuucagaccgagaaauugaaucacuucgagguaagcgggacgacucucaguuccggaugguuuaagaccaaagccucuguuacacuggaucgcacuugcgaacauaucaaggugaccuguggcaagaaaacacugcaguuccacgcaugcuuuaagcaucacaugagcuguauucgauucuuucacgguaccauccuccccgggacgauggccacuuccauaugccaaaacauugaguuaaucauuaucaucucacugacacuuauuauauucaucuugauggucauucugaccaaaacuuauaucuguuaccuacucaugccucuguuuaugccaauagcuuauuucuacggauggaguuauaauaagagcugcaaaaagugcucuuguugcggccuugcauaccaucccuuuacaaacuguggcucccacugcgugugugggcugaaauucgaagccucagaccguaugaggauucauagagagagcggauugugccaggguuacaagagucuccggguggcucgccuguuauguaagucuaaaggcuccagccuggucaucucgauccuccuuucuaugcugauuuuguccuucguuaccccuaucgaggggacgcuaaccaauuauccagaaucaagaaaguacgaucuggaggaaauugccgacgugcucgagggauuuauaguagaaaaaggcaucaaggaguauguggucuucuacacaaguauuuuuggugcgcugcuucuguugauggcacucgugaucacuaucacccugaacaaaguuacagaguauuuaacuaauauuaacgugcuguacugccacgaauguagcauguaucacuccaagaagaauauaaaauacaucggggauuucaccaacaagugcggauuuuguacaugcggcgagcuagaagaccaggagggccucaaaauucauaaggucucuaggaaaugcaucuacaaguaucagcugaccuggagcaagauuaucaugacuauacuuguguguuugcugaucgcccaaaacacgauucucaucguagcugccucagaugacugcuggaccaaaaagagucuggaaauggaguguauugggccccuucagcagguugacacaugcgaugacaaagcaucccggagcuacucuggagaggcuaagaaacuggugcgcgccucaaagaucagugauuuggacgcggcccaggucggucuccugggcagcacuauagaauccgcaauugcuucuauccgaaagcaaagaaccuauccuacaaugcacuuacuggagucgguguuccuagggaaacauugugauuacuauaagaccuuugaacacaauagcggauacucccaggccaaauggaggcucacugcuaagacacaucacuucgacauuugcucacggcacaguacgcaucacuuuugucguugcaucucugauggcaccaaaugucagaacggugacugggauuucgccggggagaugaauagcacuuaucaauccaagaaagacuuuuucgaacaugauuuuaagcuguucugcacacuugucgagaacgcauucccaggcaccacagagucauuguuuuacgaaaugcugagcaagaaaaauacuaccggaauaaagaaacuccuggacaaguuaacgcgcaaauucggcaacaauaacauguuuguggggaucuggaaguucggacaguaccugauuucucuuccguauguuaaugagaccuccuugacacccgcccaggugaguaagauccucgaaguaacugaccagcaccacagaagcauuucugguaggcaagagucccuggcuucagcgaccccuggcaguaaaagcaaggagugugggcaugcaaagaaggucucgugcaucuccccacgguuuucugugcccauggaaggacuaauggccugcggcgauagcccuaacuacaaaauauauaagacaccagcuaagcuguacaaaucaaauaacaagggugagguuugguguaguggggacgugcacugcucccaggaacucucucccgccagccaggaguccgucgaucgaauuaaacagaucacuuguuuccugaccgaaccggaggugucagacgauguauuuagcaucgcaauuaguacgugcaaggugcaagacaaaggcguuuguacagucaaugaggaucgcuggaacgugaucaagugcgacucuggacuuauuuauuacaccgaucagagagaaggccaggacacugggaaugauuucggagaguauuguuugucccauagcugcaggauagaacgguuuccuaucaaccccgccauuaucucggacugucugugggaguaccacucacgcaagucuaaauacauuacaaguuuagaucucgaaaaccuggaggaguucaagagagcuaucuccgaaaaacuuagccauacccugauaguguauaauuuuaagccaacugccaacuugccucacaucaaacccauuuacaaguauaucaccguccaggguguugaaaauucugacggcguggacagcgcauacauugcggcuuccaugccagcccucucagggacaaguaucggauauaacauaaugagcagggauaauuucccccuguuugacauuaucaucuucauuaaaucugcaauaaucaaggccacguacaaccacauuuaugauaccggcccuacuaucgguauuaaugugaugcaugacgagcacugcacagggcaauguccaaccgauaucccgcauaaggagaacuggauaacauucgcucaggaacguacuucccgguggggcugcgaggaguuuggaugccuagccguaaauaccggcugugucuucgggucaugccaggacaucauucgaagugaaacgaaaguguacagaaaggcaguugaggaaagcgugcugcucacagucuguaucaccuaccccggaaaaacuuuuugcaccgagauuaacgcuaucgagccuaagauaacagaugaacuggagcuucaguucaaaacuguggacaccaagacauugccaaauauucuggccguucaaaaccacaaguuauauuccggccagaucaaugaucucgguucuuuuucgcagggguguggaaacauccagaaaacgaaucugagcauuaucggcaccgguacugcgaaguucgacuacgugugccauggcgccucaaggaaagauauaauuguacgccgguguuauaacaacaauuacgaauccugcaaacuucugaaagaggaacaaagucuaauguuugcugacaaccacgagacaaucgaugucgcaaaugugagacaccuccugggggacuugcaguucaagcugauguuaggagaccucagguauaagucuuuugccgagaaccccgaucuggaaauugaggcuaaaugugugggcugcccuagcuguuucaccuccuacucaugcucuuuuaagaucgccagcaauauagacacugucugcaguauugaagggccauguacaaccuuccauaaccgccuuaugaucacguccacuaaacaggauuauggaaucaagaugagcugcaaaaccaagcccaaggagacagaagaguuccaaauuuguaaaaagaccuacacuguucuguuuacaaccguggagaaaaaugacaagaucgaaauuucuacaggcgaucagacuucauucauacaggagaaagacgaucgaugcaagaccugguugugucggguacgugacgaagguaucuccgugauuuuugagccgaucagagcauucuuugggaguuacuucagcaucgcguuuuaugucgugauuucgauaaucguucucuuccuggccauuuacaucuuucuaccuaugguguucaagcugagggauguccuuaaacgcaacgaauaucucuaccugcaggagauuaagcacaaauga

SEQ ID NO: 10936 - RNA, 4305 nt, Artificial Sequence
  derived and/or modified CDS sequence (opt3) from NRIV(DakArD28542)__JX857317.1__GP
augcugcuccuucugguguuguuaauccccugcuacgucagcgccuccccuguugugaccagauguuuccacggcgggcagcugauugcugagaagaaaucucaaacagcaguaucagaauuuugccuaaaggacgaugugaguacuauaaaaagcgagaucacguaugaaaagaacaauaccggacucuucgcccauuccaaaguccugaggaacuggauuaucaaggacuggaagaauuguaacccagugccgacagcggguggcucuauuaauguuaucgaggugaacacugaucuuucgcugaccacaaaaaccuacgucugcucacgggacuguacuauaacaguggauaaggaagacgcucagaucauuuuucagaccgagaaauugaaucacuucgagguaagcgggacgacucucaguuccggaugguuuaagaccaaagccucuguuacacuggaucgcacuugcgaacauaucaaggugaccuguggcaagaaaacacugcaguuccacgcaugcuuuaagcaucacaugagcuguauucgauucuuucacgguaccauccuccccgggacgauggccacuuccauaugccaaaacauugaguuaaucauuaucaucucacugacacuuauuauauucaucuugauggucauucugaccaaaacuuauaucuguuaccuacucaugccucuguuuaugccaauagcuuauuucuacggauggaguuauaauaagagcugcaaaaagugcucuuguugcggccuugcauaccaucccuuuacaaacuguggcucccacugcgugugugggcugaaauucgaagccucagaccguaugaggauucauagagagagcggauugugccaggguuacaagagucuccggguggcucgccuguuauguaagucuaaaggcuccagccugaucaucucgauucuccuuucuaugcugaucuuguccuucgucaccccuauugaggggacgcuaaccaauuauccagaaucaagaaaguacgaucuggaggaaauagccgacguucucgagggauuuaucguggaaaaaggcauuaaggaguauguaguguucuacacaaguaucuuuggugcgcuguuccuucugauggcauuggucaucacuauuacccucaacaaagugacagaguaucugacuaauauaaacguuuuauacugccacgaauguagcauguaucacuccaagaagaauaucaaauacauuggggauuuuaccaacaagugcggauucuguacaugcggcgagcuggaagaccaggagggccuaaaaauccauaaggugucuaggaaaugcauuuacaaguaucagcucaccuggagcaagaucauaaugacuauccuggucugucuuuugauugcccaaaacacgauccugauuguggcugccucagaugacugcuggacgaaaaagagucucgaaauggaguguaucgggccccugcagcagguagauaccugcgacgacaaagcaucccggagcuacucuggagaggcuaagaaacuuguucgcgccucaaagauaagugaucuggacgcggcccagguggguuugcucggcccuacuauugaaagcgcaaucgcuuccauucgaaagcaaagaaccuauucuacaaugcaccuguuagagucggucuuucuggggaaacauugugauuacuauaagaccuucgaacacaauagcggauacucccaggccaaauggaggcuaacugcuaagacacaucacuuugacaucugcucacggcacaguacgcaucacuucugucguugcauaucugauggcaccaaaugucagaacggugacugggauuuugccggggagaugaauagcacuuaucaauccaagaaagacuucuuugaacaugaucucaagcuguucugcacacuuguggagaacgcauucccaggcaccacagagucauuguuuuacgaaaugcugagcaagaaaaauacuaccggagucaagaaacuccuggacaaguuaacgcgcaaauucggcaacaauaacauguuuguggggaucuggaaguucggacaguaccugaugucucuuccguauguuaaugagaccuccuugacacccgcccagguggcuaagauucucgaaguaacugaccagcaccacagaaguaucagcgguaggcaagagucucuggcguccgcaaccccuggcucaaaaaguaaggaguguagccaugccaaaaaggucucgugcauuuccccacgguuuucugugcccauggaagggcuaauggcuugcggagauagcccuaacuacaaaaucuauaagacaccagccaagcuguacaaaucaaauaacaagggcgagguuugguguaguggugacgugcacugcucccaggaacucucucccgcaagccaggaguccgucgaucgaauaaaacagauuacuuguuuccugaccgaaccggaggugucagacgauguauuuagcaucgccaucaguacgugcaaggugcaagacaaagggguuuguacagucaaugaggaucgcuggaacgugauuaagugcgacucuggccuuaucuauuacaccgaucagagagacggacaggauacuggcaaugacuucggggaauauuguuugucccauagcugcaggauugagcgguuuccuauaaaccccgcuaucauuucggauugucugugggaauaccacucacgcaagucuaaauacaucacaaguuuagaccucgagaaccuggaagaguucaagagagccauuuccgagaaacuuagccauacccugaucguguauaauuuuaagccaacugcaaacuugccucacauaaaacccgucuacaaguauaucaccguucagggaguggaaaauucugacgguguggauagcgcguacauugcugccuccaugccagcacucucaggcacaaguaucggguauaacauuaugagcagggacaauuucccccuguuugauaucauaauuuucaucaaaucugccaucauuaaggcuacguacaaccacauauaugacaccggaccuacuaucggcauuaauguaaugcaugaugagcacugcacaggucaauguccaaccgacaucccgcauaaggaaaacuggauuacauucgcccaggagcguacuucccggugggggugcgaagaguuuggcugccuagcagucaauaccggauguguguucggcucaugccaggauaucauacgacccgagacgaaaguuuacagaaaggcuguggaagagaguguccugcucacaguguguaucaccuacccugggaaaacuuuuugcaccgaaauuaacgccaucgagccaaagauuacagacgagcuggaacuucaguucaaaacuguugauaccaagacauugcccaauauccuggcggugcaaaaccacaaguuauauagcggacagauaaaugaccucggcuccuuuucucaggguugugggaacauucagaaaacaaauucgagcaucaucggaaccggcacugccaaguucgauuacguaugccauggugcuucaaggaaagacauuaucguccgccgguguuauaacaacaauuacgaguccugcaagcugcuuaaagaagaacaaagucugauguuugcagauaaccacgaaacaauagacguggccaaugugagacaccuacucggcgaccugcaguucaaguugaugcugggggauuuaagguauaagucuuuugcugagaacccugaccucgagauugaagccaaaugugucggaugcccaagcuguuucaccuccuacucaugcucuuuuaagaucgcaagcaauauugauacuguuugcaguaucgagggccccuguacaaccuuccauaaccgccugaugauaacguccacuaaacaggacuaugggauuaagaugagcugcaaaaccaagccgaaggaaacagaggaguuccaaaucuguaaaaagaccuacacugugcuuuuuacaaccguagagaaaaaugauaagaucgagauuucuacaggagaccagacuucauucauccaggaacgagaugaccggugcaaaaccuggcugugucgugugagagaugagggcauuuccgucauauuugaaccuaucagggcguucuuugguaguuacuucagcauugccuuuuaugugguugugucgaucaucgucuuguuccucgcuauuuacauauuucugccaaugguguucaagcuacgcgacguucugaagcggaacgaguaucuuuaccuccaggaaaucaaacacaaguga

SEQ ID NO: 10937 - RNA, 4305 nt, Artificial Sequence
  derived and/or modified CDS sequence (opt3) from NRIV(SUD-HKV141)__JX857323.1__GP
augcugcuccuucugguguuguuaauccccugcuacgucagcgccuccccuguugugaccagauguuuccacggcgggcagcugauugcugagaagaaaucucaaacagcaguaucagaauuuugccuaaaggacgaugugaguacuauaaaaagcgagaucacguaugaaaagaacaauaccggacucuucgcccauuccaaaguccugaggaacuggauuaucaaggacuggaagaauuguaacccagugccgacagcggguggcucuauuaauguuaucgaggugaacacugaucuuucgcugaccacaaaaaccuacgucugcucacgggacuguacuauaacaguggauaaggaagacgcucagaucauuuuucagaccgagaaauugaaucacuucgagguaagcgggacgacucucaguuccggaugguuuaagaccaaagccucuguuacacuggaucgcacuugcgaacauaucaaggugaccuguggcaagaaaacacugcaguuccacgcaugcuuuaagcaucacaugagcuguauucgauucuuucacgguaccauccuccccgggacgauggccacuuccauaugccaaaacauugaguuaaucauuaucaucucacugacacuuauuauauucaucuugauggucauucugaccaaaacuuauaucuguuaccuacucaugccucuguuuaugccaauagcuuauuucuacggauggaguuauaauaagagcugcaaaaagugcucuuguugcggccuugcauaccaucccuuuacaaacuguggcucccacugcgugugugggcugaaauucgaagccucagaccguaugaggauucauagagagagcggauugugccaggguuacaagagucuccggguggcucgccuguuauguaagucuaaaggcuccagccugaucaucucgauucuccuuucuaugcugaucuuguccuucgucaccccuauugaggggacgcuaaccaauuauccagaaucaagaaaguacgaucuggaggaaauagccgacguucucgagggauuuaucguggaaaaaggcauuaaggaguauguaguguucuacacaaguaucuuuggugcgcuguuccuucugauggcauuggucaucacuauuacccucaacaaagugacagaguaucugacuaauauaaacguuuuauacugccacgaauguagcauguaucacuccaagaagaauaucaaauacauuggggauuuuaccaacaagugcggauucuguacaugcggcgagcuggaagaccaggagggccuaaaaauccauaaggugucuaggaaaugcauuuacaaguaucagcucaccuggagcaagaucauaaugacuauccuggucugucuuuugauugcccaaaacacgauccugauuguggcugccucagaugacugcuggaccaaaaagagucucgaaauggaguguaucgggccccugcagcagguagacacaugcgaugacaaagcaucccggagcuacucuggagaggcuaagaaacuuguucgcgccucaaagauaagugaucuggacgcggcccagguggguuugcucggcccuacuauugaaagcgcaaucgcuuccauucgaaagcaaagaaccuauucuacaaugcaccuguuagagucggucuuucuggggaaacauugugauuacuauaagaccuucgaacacaauagcggauacucccaggccaaauggaggcuaacugcuaagacacaucacuuugacaucugcucacggcacaguacgcaucacuucugucguugcauaucugauggcaccaaaugucagaacggugacugggauuuugccggggagaugaauagcacuuaucaauccaagaaagacuucuuugaacaugaucucaagcuguucugcacacuuguggagaacgcauucccaggcaccacagagucauuguuuuacgaaaugcugagcaagaaaaauacuaccggagucaagaaacuccuggacaaguuaacgcgcaaauucggcaacaauaacauguuuguggggaucuggaaguucggacaguaccugaugucucuuccguauguuaaugagaccuccuugacacccgcccagguggcuaagauucucgaaguaacugaccagcaccacagaaguaucagcgguaggcaagagucucuggcguccgcaaccccuggcucaaaaaguaaggagugugggcaugccaaaaaggucagcugcauuucgccacgguuuuccgugcccauggaaggacuaauggcuugcggcgauucuccuaacuacaaaaucuauaagacaccagccaagcuguacaaaagcaauaacaagggugagguuugguguucaggggacgugcacugcagucaggaacucacucccgcaucccaggagucugucgaucgaauaaaacagauuaccuguuuccugacggaaccggaggugagcgacgauguauuuuccaucgccaucucaacaugcaaggugcaagacaaaggcguuuguaccgucaaugaggaucgcuggaacgugauuaagugcgacagcggacuuaucuauuacacugaucagagagacggccaggauacagggaaugacuucggagaauauuguuugagucauucuugcaggauugagcgguuuccuauaaaccccgcuaucauuuccgauugucugugggaauaccacagccgcaagucgaaauacaucaccucauuagaccucgagaaccuggaagaguucaagagagccauuucugagaaacuuagucauacucugaucguguauaauuuuaagccaaccgcaaacuugccucacauaaaacccgucuacaaguauaucacaguucaggguguggaaaauuccgacggcguggauagcgcguacauugcugccucuaugccagcacucagcgggacguccaucggauauaacauuaugucaagggacaauuucccccuguuugauaucauaauuuucaucaaaagugccaucauuaaggcuaccuacaaccacauauaugacacuggcccuacaaucgguauuaauguaaugcaugaugagcacugcaccgggcaauguccaacagacaucccgcauaaggaaaacuggauuacuuucgcccaggagcguaccagccgguggggcugcgaagaguuuggaugccuagcagucaauacgggcuguguguucgggucuugccaggauaucauacgacccgagacaaaaguuuacagaaaggcuguggaagaguccguccugcucaccguguguaucacuuacccuggaaaaaccuuuugcacagaaauuaacgccaucgagccaaagauuacugacgagcuggaacuucaguucaaaaccguugauacaaagacguugcccaauauccuggcggugcaaaaccacaaguuauauucaggccagauaaaugaccucgguaguuuuagccagggguguggaaacauucagaaaaccaauuccucuaucaucggcacugguacagccaaguucgauuacguaugccauggcgcuucgaggaaagacauuaucguccgccgguguuauaacaacaauuacgagagcugcaagcugcuuaaagaagaacaaucacugauguuugcagauaaccacgaaaccauagacguggccaaugugagacaccuacucggggaccugcaguucaaguugaugcugggagauuuaagguauaaguccuuugcugagaacccugaccucgagauugaagccaaaugugucggcugcccaaguuguuucacuucuuacagcugcuccuuuaagaucguuucaaauauugauacagugugcucuaucgaggggcccuguaccacguuccauaaccgccugaugauaacuagcaccaaacaggacuauggaauuaagaugaguugcaaaacaaagccgaaggaaaccgaggaguuccaaaucuguaaaaagacuuacacaguacuuuuuaccacaguggagaaaaaugauaagaucgagauuuccacuggcgaccagaccagcuucauccaggaacgagaugaccggugcaaaacguggcugugucgugucagagaugaggguauuucugugauauuugaaccuaucagggcauucuuugggucauacuucuccauugcguuuuauguuguggucaguaucaucguguuguuccucgccauuuacauauuucugccaaugguuuucaagcuacgcgacgugcugaagcggaacgaguaucuuuaccuccaggaaaucaaacacaaguga

SEQ ID NO: 10938 - RNA, 4305 nt, Artificial Sequence
  derived and/or modified CDS sequence (opt3) from NRIV(SUD-HKV66)__JX857320.1__GP
augcugcuccuucugguguuguuaauccccugcuacgucagcgccuccccuguugugaccagauguuuccacggcgggcagcugauugcugagaagaaaucucaaacagcaguaucagaauuuugccuaaaggacgaugugaguacuauaaaaagcgagaucacguaugaaaagaacaauaccggacucuucgcccauuccaaaguccugaggaacuggauuaucaaggacuggaagaauuguaacccagugccgacagcggguggcucuauuaauguuaucgaggugaacacugaucuuucgcugaccacaaaaaccuacgucugcucacgggacuguacuauaacaguggauaaggaagacgcucagaucauuuuucagaccgagaaauugaaucacuucgagguaagcgggacgacucucaguuccggaugguuuaagaccaaagccucuguuacacuggaucgcacuugcgaacauaucaaggugaccuguggcaagaaaacacugcaguuccacgcaugcuuuaagcaucacaugagcuguauucgauucuuucacgguaccauccuccccgggacgauggccacuuccauaugccaaaacauugaguuaaucauuaucaucucacugacacuuauuauauucaucuugauggucauucugaccaaaacuuauaucuguuaccuacucaugccucuguuuaugccaauagcuuauuucuacggauggaguuauaauaagagcugcaaaaagugcucuuguugcggccuugcauaccaucccuuuacaaacuguggcucccacugcgugugugggcugaaauucgaagccucagaccguaugaggauucauagagagagcggauugugccaggguuacaagagucuccggguggcucgccuguuauguaagucuaaaggcuccagccugaucaucucgauucuccuugccaugcugaucuugucuuucgucaccccuauugaggggacgcuaaccaauuauccagaauccagaaaguacgaucuggaggaaauagcggacguucucgagggauuuaucguggaaaaaggcauuaaggaguauguaguguucuacacaucaaucuuuggugcacuguuccuucugauggccuuggucaucacuauuacccucaacaaagugacagaguaucugacuaauauaaacguuuuauacugccacgaauguaguauguaucacagcaagaagaauaucaaauacauuggggauuuuaccaacaagugcggauucuguacaugcggcgagcuggaagaccaggagggccuaaaaauccauaagguguccaggaaaugcauuuacaaguaucagcucaccuggucuaagaucauaaugacuauccuggucugucuuuugauugcucaaaacacgauccugauuguggccgcaagcgaugacugcuggaccaaaaagucacucgaaauggaguguaucgggccccugcagcagguagacacaugcgaugacaaagcuagucgguccuacagcggagaggccaagaaacuuguucgcgcgucuaagauaucagaucuggacgccgcacaggugcgauugcucgguccuacuauugaaagugcuaucgccagcauuagaaagcaaaggaccuauuccacaaugcaccuguuagagucugucuuucugggcaaacauugugauuacuauaagaccuucgaacacaauucgggguacagccaggcuaaauggcggcuaacugccaagacacaucacuuugacaucugcucccgucacucaacgcaucacuucugucgcugcauaagugaugcaaccaaaugucagaacggagacugggauuuugccggcgagaugaauaguacuuaucaaagcaagaaagacuucuuugaacaugaucucaagcuguucugcacacuuguggagaacgcuuucccagguaccacagaguccuuguuuuacgaaaugcugucaaagaaaaauacuaccggggucaagaaacuccuggacaaguuaacgagaaaauucggcaacaauaacauguuugugggaaucuggaaguucggccaguaccugaugagccuuccguauguuaaugagaccucuuugacacccgcacagguggcgaagauucucgaaguaacugaccagcaccacagguccaucagugggcggcaagagagccuggccucugcuaccccuggauccaaaucaaaggaguguggucaugccaaaaaggucaguugcauuagcccacgauuuucggugcccauggaaggccuaauggcaugcggggauuccccuaacuacaaaaucuauaagacaccagccaagcuguacaaaucuaauaacaagggagagguuugguguagcggcgacgugcacugcucacaggaacucacucccgcuagucaggaguccgucgaucgcauaaaacagauuaccuguuuccugacggaaccggaggugucugacgauguauuuagcaucgccaucuccacaugcaaggugcaagacaaagguguuuguaccgucaaugaggauagauggaacgugauuaagugcgacucagggcuuaucuauuacacugaucagagggacggccaggauacaggaaaugacuucggcgaauauuguuugagccauaguugccggauugagcgcuuuccuauaaaccccgcaaucauuucugauugucugugggaauaccacuccagaaagagcaaauacaucaccucguuagaccucgagaaccuggaagaguucaagagggcgauuucagagaaacuuucucauacucugaucguguauaauuuuaagccaaccgcuaacuugccucacauaaaacccgucuacaaguauaucacaguucaggggguggaaaauagugacggaguggauuccgccuacauugcagccagcaugccagcucucucugguacgagcaucggcuauaacauuaugucccgugacaauuucccccuguuugauaucauaauuuucaucaaaucagccaucauuaaggcaaccuacaaccacauauaugacacugggccuacaaucggaauuaauguaaugcaugaugagcacugcaccggccaauguccaacagacaucccgcauaaggaaaacuggauuacuuucgcucaggagcggaccagucgaugggguugcgaagaguuugggugccuagccgucaauacgggcuguguguucggaagcugccaggauaucauaagacccgagacaaaaguuuacaggaaggcgguggaagagucuguccugcucaccguguguaucacuuacccuggcaaaaccuuuugcacagaaauuaacgccaucgagccaaagauuacugacgagcuggaacuucaguucaaaaccguugauacaaagacguugcccaauauccuggcugugcaaaaccacaaguuauauuccgggcagauaaaugaccucggaucauuuagucagggcugugguaacauucagaaaaccaauagcuccaucaucgggacuggaacagcaaaguucgauuacguaugccauggcgccucucgcaaagacauuaucguccggagauguuauaacaacaauuacgagucgugcaagcugcuuaaagaagaacaaagccugauguuugcugauaaccacgaaaccauagacguggccaaugugaggcaccuacucggugaccugcaguucaaguugaugcugggcgauuuacgcuauaagucauuugcagagaacccugaccucgagauugaagcgaaaugugucgggugcccauccuguuucacuucuuacucuugcagcuuuaagaucgccuccaauauugauacaguuugcucaaucgagggacccuguaccacguuccauaaccgacugaugauaacuucuaccaaacaggacuauggcauuaagaugagcugcaaaacaaagccgaaggaaaccgaggaguuccaaaucuguaaaaagacuuacacagugcuuuuuaccacaguagagaaaaaugauaagaucgagauuaguacuggggaccagaccuccuucauccaggaacgggaugaccguugcaaaacguggcuguguagagugagggaugagggaauuagcgucauauuugaaccuauccgcgcuuucuuuggcucuuacuucucaauugccuuuuaugugguuguguccaucaucgucuuguuccucgcaauuuacauauuucugccaaugguguucaagcuacgggacguucugaagagaaacgaguaucuuuaccuccaggaaaucaaacacaaguga

SEQ ID NO: 10939 - RNA, 4344 nt, Artificial Sequence
  derived and/or modified CDS sequence (opt3) from BWAV(M459)__NC_034490.1__GP
auggccauguucgagcugaucgugcuccuugcuuuuagcuacgucaccggcguuccccaggaacugacaagaugcuucacugggggauccgugguaaggcaacacuggucuaagaacgcaauuucagaguuguguuuaaaagacgaugugaguauaaucaagagcgaaauugaguauaaaaagaaugaaacggguaccuuugcccuguccaaaaucuaccggaaguggauuacaacugacugggagaagugccagccucagaaaucuaccggcgggcauaucucgguccuagaggugcgccacgaucucacacuggcgucagcuaccuauauauguggaaacccaugcacuaucaauguugaccgagaaauggcccaggugcaucuucaaacagagggcgucaaccacuucgaaauuagcgguaccacgaucaagagugggugguuuaaaacuaccacauacauuacucuggaucagaccugugagcauuugaagguguccugcggaaaacagucuguacaguuccacgcauguuuuaagcaacacauggccugcguucguuuccuccauagaacaauccugccgggcaauauggcuaacagcauaugucagaauauugagaucauuauccugcucgcauuaacccuguccaucuuuauucuuuugugcauacugacgaagacuuauaucuguuacauucuacuccccaucuucauaccuauuucauauaucuacggcuacuuuuauaacaggaguugcaaaaagugcagccagugugggcugguguaccacccauucacagaaugcggacggaauugugucugcggugcccgcuaugacaccucugagagaaugaaacuucauaggcuguccggcuugugucccggguacaagucacucaaagcugcccgggugcugugcaagagcaaaggaagugcgucuaucuuauccauucugaucagccuccuuauucugacuuuugugacaccuauaaacggcuugaugcuaaaggauaccgacaucacgaaucugaagauugauacccucccagacgauaugcuggaacuuauccacaacgucgacuaucugaaauugauccucgagauuaauauaacaaucuucgguuucauucugaucauuaucuuauuuaugcugcuaauguucuaccgcuaucagcacauauuuaucucgauuuacguuaucgauuguaaggaaugcaacauguaccauucuaaauccgggcuccgauauaauggagacuucacuaacaaguguaugaccugcacauguggcgagguggacgauauggagggccugaacaaacacaagaagagauacaauugccuuauuaaauauaagacuaccaucuugcaacacuuuuuccugucaauacucguaugccugauucuuaaagaaagugugcuguuugcagccgcucagagcgaggaaaucauuaaguguuuggagcaggaaucccucacaucuaaaugcaccgggccccuguuaaagacuccucaauguacggagcagcagaagaaccugcuauucaucgagauagccaaacagauggaaaaggacaauaucauuacaagccucgauaacgcacugaucgcuaaacuuccaaaugagauugccggaucaauggcgaucuuggacaccaagaaauacuaucaugaacaaauaacucuggaguacgccauucucaguaaguauugcgauuacuacaagaaauaugaagguaacaccggcuacucccagacaaccuggaggacuuaucugcggagccaggacuuagagaucugucugauccuuccguaccaguuuuucugccguuguuuuaagucugggacaggaugcauugauacgaaaauggagaucaagucaaccauggacacuuauuacaguagccaucaaacaaaauucgauuccgacuugaauuauaugcuccacgucauucaccuggcauuucgcggcucugcuaccucguacauagccaagugucuaaucgagaaaaacuacacagaaacuauuagcuaucugaccaagauccaggaaaaguaccccaauaaccagcuccugaaaguggcuauuuucuucacgaaucaucuuuugaaccagucccugguugagaauuuugaggugucaaccgaauggaguagauauaagcacucuacagcccaaccugagcaugaauggaaaaaggguagcgaguuaaaaaugcucgauccaaacaagcugaagacugggcccgcaauccagaccugccuucacauaaaagaccugcacuguaucuccccuaggucacgggccccaacaagcggcauuaucacuugcggauugaaugaccaggcuugcgucuaccgaaagcccgauaaaaagauuuaugcgucucauaugacccagcacggcuucugugugauggacgggcauugccucaaaccguuugaaccuaucuccggagagaugcugcaaauaauuaagaagaguaaauguuggacggaggauaucgaagaccuaaucacagagggucaggauaagggccgcauuagcugccagcccauagacguagggaacuguaacguuucuggaaaucuguggaccaucacucucugcuccgauaaaaaguucuacuauacagacaacaaacacgugcaugauaauucaaaggacauuggcuacuacuguauggaagagaacugcaagaucccaagauuuccuauucaccccgauuucgucaaagacugugaaugggaucugaaucacaucaagauagaccaucuuaaacaaaucaacauugaggacaucaauaguuauaagaaaauuuugaccgagaagcugacuaccgcauuaaacagcuuuaaauacaaggguaaugaaaaccucccacacucgauccccaaguauaaauacauaacaauucaggggacgcagaccaucgauggcaucgagaaugccuucauugaaguggagaucccugcucuguccggaucugccacuggcuuuaagauaagcucaagggacgggauugaacuuuucgaugcaauccuguaugucaaacaggccaguuuuuccucuguguacaagaaacuauauguuacaggaccaaccauugguaucaacacaaagcaugacgagcggugcacuggcgcuuguccgaugacccucccccacagcuacggguggcugacguucuccaaggagcgcacaucacaauggggaugcgaagaguacggcugcuuggccauaagcgaugguuguguguuugggaguugccaggacauuaucaaagaugaccugaccaucuauagaaaggaaacugaggaguuaucucucgcagaaauuuguaucaccuucaugcauaauacauucugcacuuccauugauagcaccacaccuacgauaaccgacauccuggaggcgcaguuuaaaacuguagaaucguucaaacuuccaaacacagucggccugaaaaugcacaaguuguacauuggaaccaucaaugauaucggcguguauaagaaggcuugugggaacguucagaaguacaacaauacuauucucggaucaggcucucccaaauuugacuaugugugccaccuggccaagaggaaagaugucauacuacguaaguguuucgacaacgacuacaauaguugcaagcugcuuaaaguggcaaacgaucuccggaucgaggaagacggugagaagcugaaaguaauuaauuauaagaaagugauggggacauugaaguuuaaggccaucuucggagauauuaaauacaaguccuuuacccaagacguugauaucgacgcugaggccacgugugucggcugccugaacuguuucgaaaauauaaacugcgagaucaaagugcagagcccuuuagaaacuaccugcgagguggaaucuagcugugaucucuuuacaacccgaauccuguuccaucaggacauucacaaguacgcacuuaaacugauuugcuccaaggaggcuucaaguaaauuuuggaucagauucuguaauaaggagauaaagagcucuauuuccuugaucaacgccgcgccaauucucgaacuggcccccaucgaucagacuucauaugucaaagaggaagacgagaggugcgguacauggaugugucgcguugcucaagaaggcauaggggugaucuucgagccguuuaagaaucuauucggaaguuaccugggcaucuuuuauauuauuaucauagugauuauccuucucguacuguucgucuacaucuuuuugccuaugauuuuaaaacugaaggagauccuccagaaaaacgaaguggcauaucagcgggauaugaagauaagauga

SEQ ID NO: 10940 - RNA, 4344 nt, Artificial Sequence
  derived and/or modified CDS sequence (opt3) from BWAV(UgAr1888)__KJ867186.1__GP
auggccaucuucaagcugauugugcuccuugcuuuuagcuacgcaaccggcgucccccaggagcuguccagaugcuucacagggggaucuguugugaggcaacacuggaguaaaaacgccauaucagaauuguguuuaaaggacgauguaagcaucauuaaauccgagaucgaauauaagaaaaaugagacugguacguuugcgcugaacaagauuuaccggaaguggaucaccacagacugggaaaaaugccagccucagaagucuacuggcgggcauauaucggugcuagagguccgccacgaucucacccuggcuucagccacauauaucuguggaaauccaugcaccauuaacguggaccgagagauggcacagguucaucuucaaacugaaggcgugaaucacuucgagaucagcgguacaaccauuaaaagugggugguuuaagacgacuaccuacaucacacuggaucagacuugugaacauuugaaagucuccugcggaaagcagucugugcaguuccacgccuguuuuaagcaacacauggcuugcguacguuuccuccauagaaccauacugccgggcaacauggcaaauagcauuugucagaacaucgagauuaucauccugcucgccuuaacacuguccauuuuuauacuuuugugcauccugaccaaaacguauauuuguuacauccuacuccccauauucauuccuaucucauauaucuacggcuacuuuuauaauaggaguugcaagaaaugcagccagugugggcugguuuaccacccauucacugagugcggacggaacugugugugcggugcucgcuaugacacaucugaaagaaugaaacuucauaggcuguccggcuugugucccggguacaaaucacucaagaccgcccggguccugugcaaaagcaagggaagugcgucuauuuuauccauccugauuagccuccuuauacugacuuuugugacaccuaucaauggcuugaugcuaaaggauaccgacauuacgaaccugaaaaucgauacccucccagacgauaugcuggagcuuauccacaauguggacuaucugaaguugauucucgaaauaaacaucaugauuuucgguuucauccugauuaucauauuauuuaugcugcuaauguucuaccgcuaucagcacaucuuuauuucgaucuacgucauugauuguaaagagugcgacauguaccauucuaaguccgggcuccgauauaauggagacuucacaaacaaauguaugacuugcaccuguggcgaaguugaugacauggagggccugaacaagcacaagaaaagauacaauugccuuaucaaguauaaaacaacuauauugcaacauuuuucacugaguaugcucgugugccugauucuuaaggagagcguacuguucgcagccgcucagcccgaagagaucauuaaauguuuggaacaggagucccucaccucugaaugcacagggccucuguuaaagaccccacaauguacugagcagcagaagaaccugcuauuuauggagaucgccaaacagauggaaaaggauaaugugauaacgagccucgacaacgcacugaucgcuaaacuuccgaaugagauugccggaucaauggcgaucuuggauacaaagaaauacuaucacgaacaaauuacccuggaguacgccauccucaguaaguauugcgacuacuacaagaaauaugaagguaacacuggcuacucccagaccacauggaggaccuaucugcggagccaggauuuagagauaugucugauucuucccuaccaguucuuuugccguuguuucaagucugggacuggaugcaucgacacaaaaaucgaguuuaagucaacgauggauaccuauuacaguagccaucaaacuaaauucgacuccgauuugaauuauaugcuccacgucauucaccuggcauuucgcggcucugcuacaucguacaucgccaagugucuaauugagaaaaacuacaccgaaacaauaagcuaucugacuaagauccaggaaaaguacccuaauaaccagcuccugaaaguggcuauuuucuucaccaaucaucuuuugaaccagucccugguugagaauuuugaggugucaacggaauggaguagauauaagcacucugccacccaaccagagcaugaauggaaaaaggguagcgaguuaaaaauccucgacuccaacaagcugaagacagggcccgcaauucagacuugccuucacaucaaagaccugcacuguauaucaccuaggagccgggccccaaccucuggcaucauuacaugcggauugaaugaucaggcuugcgucuaccgaaagcccaacaaagaaaucuaugcgucccauaugacucagcacggcuucuguauuauggacgggcauugccucaagccguuugagccuaucaguggagagaugcugcaaauaauuaaaaagagcaaguguuggaccgaagauaucgaggaccuaaucacggaaggucaggauaaaggccgcauuucuugccagcccauagacguggggaacuguaauguauccggaaaccuguggacaaucacccucugcucagauaagaaauucuacuauacugacaauaagcacguucaugauaguagcaaagacgugggcuacuacuguauggaggaaaacugcaagauuccaagauuuccuauccaccccgauuucgucaaggacugugagugggaucugaaucacauggagauugaccaucuuaaacaaaucaacauagaagacaucaauucguauaagaaaauuuugacagagaagcugaucaccgcauuaaacuccuuuaaauacaaggguaaugaaaaccucccacacucuauucccaaauaugaguacaucacuauacaggggacccagacaauugauggcaucgaaaaugccuucaucgagguggagauuccugcucugagcggaucagccacgggcuuuaagaucaguuccagggacgggauagaacuuuucgaugcaauucuguaugucaagcaggccucuuuuagcuccguguacaaaaagcuauauguuaccggaccaacuaucgguauuaacacaaaacaugacgagcggugcaccggcgcuuguccggugacacucccccacucauacggguggcugacuuucagcaaggaacgcaccagucaauggggaugcgaggaguacggcugcuuggccaucucugaugguuguguauuuggguccugccaggacauaauuaaagaugaccugacggucuauagaaaggaaacagaggaauuaagccucgcagagaucuguaucaccuucaugcauaauacuuucugcaccucgauugauucaacaacuccuaccaucacagacauucuggaagcgcaguuuaagacgguggagucuuucaaacuuccaaacaccguuggccugaagaugcacaaauuguacauaggaacuaucaaugauauuggcguguauaagaaggcuugugggaacguccagaaguacaacaauacaauccucggaaguggcucccccaaguuugacuaugugugccaccuggccaaaaggaaggauguaauccuacguaaauguuucgacaacgacuacaauagcugcaagcugcuuaaaguggcaaacgaucuccggauugaggaagacggugagaagcugaagguuauaaauuauaaaaaggucauggggaccuugaaauuuaaggccaucuucggagaugugaaauacaagucuuuuacucaagacguggauauugacgcugaagccacaugugucggcugccugaacuguuucgagaauaucaacugcgaaauuaagguucagagcccuuuagagaccacgugcgagguggaauccucaugugaucucuuuacuacccgaauccuguuccaucaggacauacacaaauacgcacuuaagcugaucugcaguaaagaggcuacaagcaaguuuuggauuagauucuguaaaaaggaaaucaaaucuuccauuucauugaucaaugccgcgccaauacucgagcuggcccccauugaucagaccaguuaugugaaggaagaggacgagaggugcgguacuuggaugugucgcguagcucaagaaggcaucggggucauuuucgagccguuuaagaaccuauucggaagcuaccugggcaucuuuuauauaaucauuaucgugauuauccuucucguucuguucguguacauauuuuugccuaugauuuuaaaacugaaggaaauccuccagaaaaaugaggucgcauaucagcgggauaugaaggugagauga

SEQ ID NO: 10941 - RNA, 4332 nt, Artificial Sequence
  derived and/or modified CDS sequence (opt3) from BWAV/PGAV(SAAr1)__KJ867177.1__GP
augaucugcauuuguauauucguggccaucuuucccgcuauuuacgcaaucccugacagcuauuccagaugcuucaccggcgggacagucguuaaggagauguggucuaaagaugccgugacugaacuguguauuaaggacgauguaucaaucgugaaaacggagaccaguuacaagaaaaacggaacagguacuuuugcgcucaauaaggucaccaggaaguggcuuaugacagacugggaaaaaugcaagccacagaaaagcuccucuggccacauaaacgugaucgagguucgggaugaccugaccuuggcuacuucgacauauauuuguucaagcaguugcaccaucaauguggaucgcgaaacggcccaaauucaguuaaacacugacuccaucaaucauuucgagauagcagggaccacaauuaagacuggaugguuuaaaucuaccacacuggucgcccuagaucagaccugugagcaccucaaggugagcugcggcaagcaguccguacaauuccaugcuuguuuuaaccagcacaugucaugcguucgauuccugcaucguacgauccuuccggguaauauggcaaaaaguauuugucagaacaucgaaaucauuauacuggugggguugaucauucucaucuuucugcugcucugcauauuaacuaagacauacauuugcuauauccugcuucccaucuucauuccuuugagcuacgccuauggauacuuuuacaauaaagccuguaagaaaugcucucaguguggccuggucuaucacccauucaccgagugcggcuccaacugugugugcggggcuagauacgacacuucagaaaggaugaagcuacaccggaucagcggacucugucccgguuauaaaagucugcgcacagcgagagugcuuugcaagucuaagggcuccgcaagcauucugucgauauugaucucuauucucauccugauguuugucaccccuaucaauggguacaugauuacgaacgaguucgaugagggaaaauuaaccguugacucccugccagaugacaugcucucaaugauaaguaggcuuagcgcccugcaauucaucuuuacauugaauauugcuuguuccgugcuaguaacucuguugaccugccuguuccuuaucaucuuuuaucgguuccagcaucgcuuucugucuaaguacgccauuaacuguacagaaugcgacauguaucaccagaaaaagggcuugauauacaauggugauuucacuaacaaaugcaugaccuguacaugcggggaggugaacgacauggaaggacucaauaagcauaagaaacgauacaacugucugaucaaguauaaagcagcuugguuuuuaaaucugaccauuacuaucauuugccuaaugcucaucaaggauggcagcaugauggccgcggccgagacgaacauagaaacauguauggcaaaacccucacugaccacugacugcaccggcccuuuccuuaagauuacaaagugugaugagagucagaaagcucucccauuucaagagaucgccaagcagcuggucaaauccaaugugcucacccugcuugacaagcacauuguugaaaaacugccgaacgagaucgcugggagcuugucuauacucgauaagaagcagcacuaccaugaacaacuggccguggaguauggaaucuuaucaaaauacugcgacuauuacgaacuguauaagaguaauagcgguuacucccagucuacuuggggcacauaccuaagaucgcacgauuucgagauuugucuccugcuucccuaucaguacgucuguaggugcuuuaaaagcgggacgggaugcaccgacacuaaguucgaguuugaacagaaaaugaacgagacauauaauuccaagaacgauauguacaauucagacuucaccuuggcacugacagugcuccaucuggccaugcggggcacugcuaguaccuauaucauugacaacguauuacagaaaaauuacucuaacguuaucgaauaucugaauacgaccaagaacaacuucaagagcaaucaaguguuugguguccuuguggauuucacaauauacuugcuccgucacgcguccuacgcaaaauauaaccugccucagucacuaaagaaauuucgcagcgucucuuccgaccugacuaccauuagugggagaagcucuggccagaauaucguguccgaucuccaucaaggagacguuaucaagacaugccugaacauuaaacagcuuaauuguaucucaccaaagaguaggacuaccacgacaaacuugauuaccugcggcagcucgcagauauccguguacaaucugccccgggggcaguuauaugagucuguaacuacagaacacggaaccugugccggugauggccacugccucacugacuucaugccuaucaacagcgauuuucuggcuacccuuaagaaaucaaaguguuggacaacggacauuccaaauaucauuaaacuggucgagagugaugggaagaucuccugccaacccauagacgugggaucuuguaacguuagcggcaauaucuggaccauuacuaaaugcuccgauaacaaguacuauuacacagacaauaagcaugugcacgaugacgagaaagacaucggucauuauuguauggaagagaccugcaaguucguccgauuuccgauuaacgauaaauucgugucaaauugugaaugggacuugaaccacaucgagauaaacaagcucaaucagguagagcuggauaacauuaaugccuacaaaaaggugcuaacagaaaagcugacuagcagucucucuguuuuuaaauacaagcugacccagaaccuuccucacgucauccccaaauucaaguauaucacgauucaggggacacaaaccguggacggcauagagaauaguuuuaucgaaguggagauuccagcauugagcggagccgcuucgggcuucaaaaucaugacuaaggaaaacaaugagcuguuugaugccauuuuauacgucaaacaggcaucauucucuaguaucuauaagaagauauacaccacagggccuacuaucggaauuaacaccaaacaugacgagaagugcacaggugcgugccccguuaaucucccacacuccacgggcuggcugaccuucgcuaaagaacgcacuagcacaugggggugugaggaauauggaugccuugccaucaacgauggcuguguguuugguucuugccaggacauuaucaaggaugagauguacauauucaaaaaggaaaccgaggagguggcacugguagaaauuuguaucagcuuuaaucauaagacuuucugcacagacgucgauuccaccacgcccaucauuacugacacccuagaggcccaauuuaaaacaguggaaucauauaagcucccuaaccacguugcucugaaacagcauaaguuguacguggggcagaucaaugauuucggcgucuacaaaaaggccuguggaaacgugcagaagauaaauaacaccauuuauggcgaggggacuccaagauuugacuaccugugccacuuagcaaaaaggaaggacguucucgugcggaaauguuucgauaacgacuauaauaguugcagccugcuuacaaucgcugaugaccugcgcuuggaagaggauggagagaagcucaaaguaauuaacuacagaaagguccugggcucuaugaaguuuaaagcccuauucggugacaucagguauaaguccuuuaccgaagauauagagcuggacguggaagcgucaugugccgggugcauuaauugcuucgauaacauccacugugagaucaaacuuacaaauggacucgacacuuccugcagcuucgaguccucuugugaugcuuuuaacucgcguauucuguucaauagcaaccaacauguguacucaaccaaguugaucugcacgaaagaacagacaaaggcauuugagauuaagauauguggcaaaaccaucaaggccgaccuggucguuacugaagcuaaaccgauuuuagagcucacccccaucgaccagacauccuauaucaaggaagaggauacucggugcgguaccugguucugucgacugacgaaagagggcuuuagugugcuucuggaaccuuucaagaauuuguuugggucuuaccucggaauugccuacacaauaaucauugcacugcuaugccuguucguauuuaucuauauuauccuuccaaugauaaugaaacucaaggaggugcugaagcagaacgaaaucgcguaccaaaaagagcagaagaaaagauga

SEQ ID NO: 10942 - RNA, 4332 nt, Artificial Sequence
  derived and/or modified CDS sequence (opt3) from BWAV/PGAV(191B-07)__KJ867180.1__GP
augaucuacauuuauauauucguggccaucuuucccgcuauuuacgcaaucccugacagcuauuccagaugcuucaccggcgggacagucguuaaggagauguggucuaaagaugccgugacugaacuguguauuaaggacgauguaucaaucgugaaaacggagaccaguuacaagaaaaacggaacagguacuuuugcgcucaauaaggucaccaggaaguggcuuaugacagacugggaaaaaugcaagccacagaaaagcuccucuggccacauaaacgugaucgagguucgggaugaccugaccuuggcuacuucgacauauauuuguucaagcaguugcaccaucaauguggaucgcgaaacggcccaaauucaguuaaacacugacuccaucaaucauuucgagauagcagggaccacaauuaagacuggaugguuuaaaucuaccacacuggucgcccuagaucagaccugugagcaccucaaggugagcugcggcaagcaguccguacaauuccaugcuuguuuuaaccagcacaugucaugcguucgauuccugcaucguacgauccuuccggguaauauggcaaaaaguauuugucagaacaucgaaaucauuauacuggugggguugacuauccucauuuuucugcugcucugcaucuuaacaaagaccuacauauguuauauucugcuucccaucuucaucccuuugagcuacgccuacggauauuuuuacaauaaggcuugcaagaaaugcucucaguguggccuggucuaucacccauucacugagugcggcuccaacugugugugcggggccagauacgacacaucagaaaggaugaagcuacaccggauuagcggacucugucccgguuauaaaagucugcgcaccgcgagagugcuuugcaagucuaagggcuccgcaagcauccugucgauuuugauaucuauccucauucugauguuugucacgccuaucaauggguacaugaucaccaacgaguucgaugagggaaaauuaacaguugacucccugccagaugacaugcucucaaugauuaguaggcuuagcgcccugcaauucauauuuacuuugaauaucgcuuguuccgugcuaguaacccugcucacaugccuguuccuuauuaucuuuuaucgguuccagcaucgcuuucugucuaaguacgccauuaacuguacugaaugcgacauguaccaccagaaaaagggcuugaucuauaauggugauuucaccaacaaauguaugacauguaccugcggggagguggacgauauggaaggacucaacaagcauaagaaacgauacaauugccugauaaaguauaaagcagcuugguuuuuaaaccugacuaucacgauuaucugccuaaugcucauuaaggacggcagcaugauggccgcggccgagucaaauaucgaaacauguauggcaaaacccagucugaccacugauugcaccggcccuuuccuuaagauaacaaagugugacgagucccagaaggcuuugccauuucaagagauugccaaacagcuggucaaaagcaacgugcucacccugcuugauaagcacaucguugaaaaacugccgaaugagauugcugggucuuugucaauccucgacaagaagcagcacuaccaugaacaacuggccguggaguauggaauauuaaguaaauacugcgauuauuacgaacuguacaagagcaacuccgguuauucucagucgacuuggagaacauaccuaaggagccacgacuucgagaucugucuccugcuucccuaucaguacgucugccgguguuuuaaauccggcacggggugcaccgauacuaaguucgaguuugaacagaaaaugaaugagacauauaacucaaagaaugacauguacaacagugacuucaccuuggcacugacagugcuccaucuggccaugcguggaacugcuucuaccuauauuaucgauaauguauuacagaaaaacuacagcaauguuauugaauaccugaacacgaccaagaauaacuucaaguccaaccaaguguuuggcguccuuguggacuucacaaucuauuugcuccgccacgcgucauacgcaaaauauaaucugccucagagccuaaagaaauuuagaucugucuccagugaucugacuaccauaagcgguaggucuuccgggcagaacauugugucagaccuccaucaaggcgauguuaucaagacaugucugaauaucaaacagcuuaacugcauuaguccacggagccgaacuaccacgacaaauuugauuaccugcggaacuucgcagaucuccguguacaaccugccccgcggccaguuauaugagucuguaacaaccgaacacgggacuugugccgacgauggacacugccucaccgacuucaugccuauaaauagcgauuuucuggcuacacuuaagaagucaaaauguuggacgaccgacaucccaaacauuaucaagcuggucgagagugaugguaaaauuuccugccaacccaucgacgugggcucuuguaauguuagcgggaacauauggacuaucacaaagugcuccgauaauaaauacuauuacaccgacaacaagcaugugcacgacgaugccaaggacauuggacauuacuguauggaggaaacaugcaaauucgucagauuuccgaucaaugauaaguucgugucaaacugugagugggacuugaaucacauugaaaucaacaaacucaaccagguagagcuggauaauauaaacgcauauaagaaagugcuaacugagaagcugaccagcagucucucuguuuuuaaguacaaacugacgcagaaucuuccucacgucauucccaaguucaaauauaucacaauccagggcacccaaacuguggacgguauugaaaacuccuuuauagagguggaaaucccagccuugagcggggcugccucgggcuucaagauuaugaccaaagagaauaacgaacuguuugaugcaaucuuauacgucaagcaggcgucauucucuaguauuuauaaaaagaucuacacaacuggaccuaccauaggcaucaauacaaagcaugacgagaaaugcacgggggcuugucccguuaaccucccacacaauaccggauggcugacuuucgccaaggagaggacauccaccugggguugcgaagaguauggcugccuugcaauuaacgauggguguguguuuggaagcugccaggacaucauuaaagaugaaauguacaucuucaagaaagagacugaagagguggcccugguagagauauguauuucuuuuaaucauaagacauucugcaccgacgucgauagcacgacucccaucaucaccgacacacuagaagcucaauuuaagaccguggaguccuacaaacucccuaaccacguugcccugaagcagcauaaauuguaugugggccagauuaaugacuucggugucuacaagaaagcaugugggaacgugcagaagaucaauaacacuauauauggcgaaggaacaccacgguuugauuaccugugccacuuagcuaagcgcaaagacguucucgugagaaaguguuucgauaacgacuauaauucaugcagucugcuuaccauugccgaugaccugagguuggaggaagauagcgagaaacucaagguaaucaacuaccguaaaguccugggcucuaugaaguuuaaggcgcuauucggggacauucgguauaaauccuuuacagaggauaucgaacuggacguggaggccucaugugcuggaugcauaaauuguuucgauaacauucacugcgaaaucaaacuuacuaauggccucgacaccaguugcagcuucgaguccucuugugacgcauuuaacucgcgaauccuguucaauagcaaccaacauguguacucaacgaaauugauuugcacaaaggagcagaccaaagccuuugaaaucaagauuugugguaagacuauaaaagcugaucuggucguuaccgaggccaagccgaucuuagaacucacacccauugaccagacuuccuacaucaaagaggaagauaccagaugcgggacgugguucuguaggcugacaaaggagggauuuagugugcuucuggagccuuucaaaaauuuguuuggcucuuaucucgguaucgcauacaccguaauuauagcgcugcuaugccuguucguguuuaucuauauuauccuuccaaugauuaugaagcucaaagaaguccugaagcagaacgagaucgccuaccaaaaggaacagaaaaagcgcuga

SEQ ID NO: 10943 - RNA, 4326 nt, Artificial Sequence
  derived and/or modified CDS sequence (opt3) from CEV(283)__KX817313.1__GP
augaucuucaugcugauucucuuugccguggcugcagccagccccgucuaccagagaugcuuccaagacggcgcgauaguuaagcagaacccuuccaaagaggcugugaccgaaguaugucuuaaggaugacgugucuaugaucaaaacagaggccagguauacuaaaaauucaacgggggucuuuaguaacaauguggcaauucggaaguggcugguuagcgauuggcacgacugccgcccacgaaagguggucggaggucauaucaacgugauugaaguaggcgaugacuugaccuuacacacagaguccuacguuuguucugccgauugcacuaucgggguggacaaggaaaccgcucagguccgucugcagacagauaccacuaaucauuucgagauagcaggaacaaccgugaaaucgggcugguuuaagucaacgacuuauaucagccuagaccaaaccugugagcaccucaaagugaguugcgguccgaaguccauucaguuccaugccuguuuuaaccagcacaugucuugcgucagauuccugcacaggacaauccuucccgggagcauugcuaauuccaucugucagaacguugaaauaauuauccuggugacuuuggcccuccugauuuuuauccugcucucaaucauuaguaaaaccuacauaugcuauuuacugaugccuaucuucauuccaaucgcguacauauauggacuuauuuacaauaagagcuguaagaaaugcaaguugugcggccugguauaccaucccuuuacagaguguggcacccacugcguguguggggcacgguaugauacgucugaccgcaugaaacuacauagagccuccggacucugcccugguuacaagucacugagggcugcccgggucauguguaaaagcaagggcccagcaaguauccuuucuaucauuacugcugugcugaucuugacauucguuacccccauuaacgccaugauggugggggaauccaaagagacuuuugagcucgaagaacugccugaugacauguuagaaauggcgaauaaccugaauacauauuacaugcucugcgucgccaacuaugcagugaccuggagccuucugauaguagcuuugaucauuggacuacuguucaagaaguaccaacaccgcuuccucgacaucuaugccauguacugugaggaaugcgauauguaccacgaccgaucgggcaucaaauggaauggugauuuuacgaacaagugugggcauugcaccuguggacaguaugaggacgcuucuggccugcuuguucacagaaaaacauacaacugccugauucaguauaaguccaaauggauaaugaauuucuuggugacuuacgucauccucgugcuguuaaaggauucagucgugauuguucaggccaagggcguggacuuuagugagugcaucgaagcagagaaaguaagguggaacuguaccgggccauucgucaaucugggaaacugcgaaaagaaacaaaagaaagagccguauagcaauauugccgcucagcuaaagggucucggcgcgaucuccauacuggaugugcccaucauugcaucuaucccugaagacauugccggggcccuucgguacaucgaggaucagcguagcuaucauucacaauugacaguugaguacgcuaugcugacucgcuacugugacuauuacacccaguuuagugauaacuccggauauagccagacaaccuggagaguguaccucaggucucacgacuucgaagcaugcguccuguauccaaaucagcauuuuugucggugcgugaagcacggcgacaaauguucaaguagcaacugggauuucgccuccgagaugaagaauuacuauucugguaaacaaucgaaguuugacaaagaucuuaaccuggcuuugacuagccuccaccaugccuuccgagggacguccucaaguuacauagcaggccuguuaucuagcaaggcgaaugacgaacugguacaguacacauccaagauucgcgagaaauuucccggaaacgcucuacucaaggccgugaucgauuauauugcauacaugaaaggccugaccgaaaugucaaauuucaagaaagacgaguuuugggaugagcuuguuuaugucccugacccaacuaagcccccgaaauugagcagaucuuccgggaccguguacgauuucaagagugccacaagcaaccugggagaaaagaauugcaaagacgugaagggugucguuugucucucuccuagguccggcgugaccuaugauucaaucauagcuugcggggagggaaguagccccaacaucuaccggauuccaaaaacuggcguguaucagucgaacuccgaaccuucuaauuacuguguaagcgacucacacugccuggaggauuucgaggucaucaaccaggaagaguuagacgccauuaagaaaagucgcugcugggaaguggacuaccuguaugcaaaucccuccaagcaaucugaugguaucagaagcuguaggaugcgugacgcugggcauugcaacguuacaacgaaucgguggccaauaauucagugugaugacaacaaguacuauuacuccgagcuucagcgagauuaugacaaagaacaggauaucggccacuuuugcuugucacccagauguaccacugugagguucccuauccacccaaagcaugucagcaauugcgacuggcaagugagucacucuacaguugauaaaguggacguacauaaccucgaggauauugagcaguaccgcaaggccaucacccagaaacugcaaaauucccuaagcauuuuuaaguaugcgcggacaaagaaccugccgcacauaaaacccaucuacaaguacauuacuaucgaaggaaccgagacggccgaaggcauugagucggcuuauaucgaaucagagauaccugcacucgccgggaccucuaucggauucaaaauuaauacaaaggaggguaaacaucugcuugacgucaucgcuuacgugaagcaggccaguuauuccagcuuguacaacaagauguaugugacuggcccaaccgucgggauuaauacaaaacacgaugaacuguguacuggacccugcccuguuaacgugccacacucugacggcugguuaaccuuugcaagagagaggacgagcuccugggguugugaagaguucgggugccucgcgaucucagacggcuguguauuuggaaguugccaggaucugauaaaggaggagcuugccguguaccgcaaagagacagaagaggcuaccaaugucgaacugugcuugacuuucagcgacaagacauauuguaccgagcucaaccccauuacuccgaucaucaccaaccuguuugaggugcaguucaaaacaguugaaacguacucucuaccucgaguggucgccgugcaaaaucaugagauucggauaggccagaucaacgaucuggggauuuacuccaagggaugcggcaauguucagaaagugaacaauaccaucuaugguaacggggucccaaaguuugacuaccucugucaccuggcaucacguaaggaaguaauugugagaaaaugcuucgauaaugacuuucaggcuuguaaguuccuucaaagucccccuagcuauagguuggaggaagaugacggauccaucacuguuauagauuacaaaaagauccugggcacaauuaaaaugaaggccaucuuaggugacgugaaguauaaaaccuucgcagagaacauugauaucacagccgagggcgucugcacugggugugugaauugcuuugaaaacauacauugugagcucaccauucacacgacaaucgaggcuucuugccccguaaccucgccauguacucuguuccaugaccgcauccuuauuaccccugacgaacacaaguacgcgaugaaagugaucugcacagaaaagcagacuggaacccugcccuuuaaaauaugcaauagcaaggucgaugccacacuaacgcucguugaggcaaagccaauucuggaguuggcuucaguggaccagaccgccuauauccgggaaaaagaugagagauguaagacuuggaugugcagggugcgagacgaaggcauucaggucauccuggagccguucaaaaacuuauuuggguccuacauaggaauuuucuacacaaguauccucaucgugauuaccaucuuuauuauaaucuauguuauucugccuaucuguuucaaacuuaaggauacucugcaaaagcacgaagacgccuacaagcgcgagaugaaaauccgguga

SEQ ID NO: 10944 - RNA, 4326 nt, Artificial Sequence
  derived and/or modified CDS sequence (opt3) from CEV(BFS283)__AF123483.1__GP
augaucuucauucugauacucuuugccguggcugcagccagccccgucuaccagagaugcuuccaagacggcgcgaucguuaagcagaacccuuccaaagaggcugugaccgaaguaugucuuaaggaugacgugucuaugauuaaaacagaggccagguauacuaagaacucaacgggggucuuuaguaacaauguggcaauccggaaauggcugguuagcgauuggcacgacugccgcccacgaaagguggucggaggucauauuaacgugaucgaaguaggcgaugacuugaccuuacacacagaguccuacguuuguucugccgauugcacuauagggguggacaaggaaaccgcucagguccgucugcagacagauaccacuaaucauuucgagaucgcaggaacaaccgugaaaucgggcugguuuaagucaacgacuuauauuagccuagaccaaaccugugagcaccucaaagugaguugcgguccgaaguccauccaguuccaugccuguuuuaaccagcacaugucuugcgucagauuccugcacaggacaauucuucccgggagcaucgcuaauuccauaugucagaacguugaaauuaucauucuggugacuuuggcccuccugaucuuuauccugcucucaauuauaaguaaaaccuacaucugcuauuuacugaugccuauuuucaucccaauagcguacauuuauggacuuaucuacaauaagagcuguaagaaaugcaaguugugcggccugguauaccaucccaucacagaguguggcacccacugcguguguggggcacgguaugauacgucugaccgcaugaaacuacauagagccuccggacucugcccugguuacaagucacugagggcugcccgggucauguguaaaagcaagggcccagcaaguauucuuucuaucauuacugcugugcugauauugacauuuguuacccccaucaacgccaugauggucgggggauccaaagaaacuuucgagcucgaggaacugccugaugacauguuagagauggcgaauaaccugaauacauauuacaugcucugcgugaccaacuaugccgugacguggagccuucugauuaucgcauuggcuaucggccuacuguuuaagcgcuaccaacaccgauuccucgacauuuaugccauguacugugaagagugcgauauguaccacgacagaucggguauaaaguggaauggggauuucaccaacaaauguggacagugcacauguggccaguaugaagacgcuucuggccugcuuguacauaggaagacuuacaacugccugauccaguauaaauccaaguggauuaugaauuuucuuaucaccuacguuauucucgugcuguuaaaagauucagucgugaucguccaagccaaggggacagacuucagugagugcauagaugcagacaagaucaaauggaacuguacuggaccauuugugaaucuggguaacugcgagaagaaacagaagaaagaaccguauagcaauauugccgcucagcuaaagggccucuccgcgaucucuauucuggauguucccaucauagcaagcauuccugaggacaucgccggggcccuucgguacauugaagaucaacguucauaucacagucaguugaccguggaguacgcuaugcugacacgcuacugugacuauuacacccaguucuccgacaacagcggauauucucagacuacguggagaguauaccucaggucacaugucuuugaagcaugcauccuguauccaaaucaacacuucugucggugcgugaagcauggcgauaaauguaguagcuccaacugggacuuugccucugagaugaagaauuacuauucggguaaacagaacaaguucaauaaagaucuuaaccuggcuuugacaagccuccaccacgccuuucgagggaccuccucaaguuacauagcaggccuguuaucuacuaaggcgaaugacgagcugguucaguacaccagcaagauccgcgaaaaauuccccggaaacgcucuacucaaggccauuaucgauuauauugcauacaugaaaggccugacagagauguccaauuuuaagaaagacgaguucugggaugaacuuguguaugucccugacccaaccaagcccccgaaauugucaagagggagcgaaacuguguacgauuuuaagucugccacauccaaccugggagagaagaacugcaaagacguaaagggugugguuugucucaguccuaggagcggcgucacguaugauucuaucauagcuugcggggagggauccucacccaauauuuacaaaaucccaaagaccggcguguaucagaguaacagcgaaccuucgaauuacuguguguccgacucucauugccuggaggauuucgaagucaucagccaagaggaguuagacgccauuaaaaagucacggugcugggaaguugacuaccuguaugcaaaucccccaaagcagagugauggugugcgcuccuguagaaugaaagacgcugggcacugcaaugugacuacaaacagguggcccaucauucagugugaugacaauaaguacuauuacucugagcuucagcgugauuaugacaaagaacaagauauaggccauuucugcuugagcccucggugugccaccguacgauuuccaauccacccgaagcacauuuccaacugcgacuggcaggucucacauagcacaguggauaaaguuaaugugcacaaccucgaggacaucgaacaguacagaaaggcgauuacucagaagcugcaaaauagucuaucuaucuucaaauaugccaggaccaagaaccugccccauauaaaaccuaucuacaaguacauuacgaucgagggaaccgagacagcugaaggcauugaguccgcauauaucgaaagcgagauaccagcccucgcugggacuucgauuggauuuaaaaucaauaccaaggaagguaagcaucugcuugaugucaucgccuacgugaaacaggcaucauauucuaguuuguacaacaagauguauguuacaggccccacuguggggauuaauaccaaacacgacgagcuguguacgggaccuugcccaguaaacgucccccacuccgauggcugguuaacauucgcgcgcgagcggaccagcucuugggguugugaagaguuugggugccucgccauaagcgacggcuguguguucggauccugccaggaccugaucaaggaggaacuuacuguguacagaaaagaaacagaggaggcuaccaacgucgaacugugcuugacuuuugccgauaagaccuauuguacagagcucaauccgguuacgccuauuaucaccaaccuguucgaagugcaauuuaaaacuguagagacauacucacuaccaaggguggucgcagugcagaaucacgagauucgcaucggccagauaaacgaccuggggguuuacaguaagggaugcggcaaugugcagaaggucaacaauaccaucuaugguaacggggugcccaaauucgauuaccucugucaucuggcuagccgaaaggaaguuauugugcggaaaugcuuugacaaugauuuccaagccuguaaguuucuucagucuccucccuccuaucguuuggaggaagacgauggaucaaucacagucauugacuacaaaaagauccugggcacuauaaagaugaaagcaauuuuaggugauguaaaguauaaaaccuucgccgagaacaucgacaucacggcugaaggcgugugcacaggguguauuaauugcuucgagaacauccacugugagcucaccauacauacuaccauugaagcgaguugcccaguuacaagcccuuguacucuguuucacgauagaauccuuauuacccccgacgagcauaaguacgccaucaaagugauaugcacagaaaagcagacgggaacccugccauucaagauuugcaauuccaaaaucgacgcaacucuaacacucgucgaggcuaagccgauccuggaauuggccccuguggaucagaccgccuauauuagggagaaagacgagcgcuguaagacuuggauguaccggguaagagaugaaggcauccaagugauucuggagcccuuuaaaaacuuauucgggucuuacauaggaaucuuuuauacaucgauucucgucguuaucgcuauguucaucauuguguacgugauacugccaaucugcuuuaaguugaaggacacccugcagaggcacgaagaugcauauaaacgagagaugaagauucgcuga

SEQ ID NO: 10945 - RNA, 4329 nt, Artificial Sequence
  derived and/or modified CDS sequence (opt3) from CHATV(Mohko ILO8-3)__KF719222.1__GP
augaugaucuucauucugauacucuuugccgugagcgcugcaucccccgucuaccagagaugcuuccaagacggcgccaucguuaagcagaacccuucuaaagaggcggugaccgaaguaugucuuaaggaugacgugucaaugauuaaaacagaggcuagguaugucaagaaugccacugggaucuacaguaacaauguggcaauucggaaauggcugguuagcgauuggcacgacugccgcccacgaaagguguccggaggucauaucaacgucauagaagugggcgaugacuugucuuuacacacggagucguauguauguucagccgauugcaccaucgggguugacaaggaaacagcucaggugcgucugcagacugauaccacaaaucauuuugagauugcaggaaccacugucaaaagcggcugguucaagaguacaaccuacaucacgcuagaccaaacuugugagcaccucaaaguguccugcgguccgaagucugugcaguuucaugccuguuucaaccagcacaugagcugcgucagauuucugcacaggaccauucuucccggguccaucgcuaauucaauaugucagaacauugaaaucauuauccugguuacauugacucuccugaucuucgugcugcucaguauuuuaagcaaaaccuauauaugcuaccugcuuaugccuaucuuuauuccaaucgccuauauauacggaauuaucuacaauaagucuuguaagaaaugcaaguugugcggccugguauaucaucccuucacagaguguggcacccacugcguguguggggcgcgguacgauacguccgaccgcaugaaacuacauagaucaagcggacucugcccugguuauaagagucugagggcagcccgggucauguguaaaucuaagggcccagcuuccauccuuagcauuaucacugccauucugguguugacauuuguuacccccauaaacucgauggugaucggggaaucuaaagaggucuucgagcucgaggaacugccugaugacauguuagaaauggcacugaagauuaaucucuacuauuuugugugcguaaucaacuacgcuguuacuuggucccuugugaucgucgcccuguugauugcgcuaauauucaagaaauaucaacaccgcuuccugaaucucuacgccauguacugugaggaaugcgacauguaucacgaucgaaucggacugaagagaaacggcgacuuuacaaauaaauguaggcagugcaccuguggucaguacgaggaugcaacggggcuuaugacccaucggaagacauauaacugccuggugcaguacaaaucaaaguggauuuugaacuuccucaucacuuauaugauucugaccuuaaucaaggacagugcuauaaucguccaagccgcuggaacagauuuuagcgccugccuggaggcacaguccguggacuggaauuguacuggcccauuccuaaaccucggcaauugccagaaacaacagaagaaagaaucuuacgccaacauugcuacccagcugaaggggcuucaggcgaucagcguuuuggaugugccgaugauugcaaauauccccgaggacauagccggagcucugcguuauauugaagagaaagauacauuucacguacaacucaccgccgaauacgcaaugcugacucgcuacugugacuauuacacgcaguucgccgauaacucagguuauagucagacaaccuggagagucuaccuuaggucccaugacuuugacgcuugcauccuguauccuaaucagcacuucugucggugcgugaagcauggcgauaaguguucuagcucaaacugggacuuugccaaugagaugaaaaacuacuauagugggaagcaaaauaaauucgauaaggacuugaaccucgcacugauggcgguucaccacgcuuuucgaggaacuagcuccgccuacauugcaaccauguuaucuaaaaagucgaauaacgaucuggugacauacaccaauaagaucaaagagaaguucccaggcaacgcccuacucaaagcuauaauggacuauaucagcuacaugaagggucuguccgaaaugacuaacuuuaaauaugaugaguucugggacgaucuuuugcauaagcccucaccuacaaaugccccaccccugagucgcgacucugaaccgagcuacaacuucaaauccgucauuucaagcagaucugugaaguccugcaagaaugugaaaaacguaguuugucucaguccuaggagcggggucucuuaugauuccauccuggcaugcggcgagcccaauggaccaucaguguacaagaaaccuagugacggcguguuucagagcaacucggauaagacgauguauuguuuagcugacucccacugccuggaagacuucgaggucguuucucaggaggaacuugaugccauuaaaaagagcaagugcugggugaccgaguaccccaaugugaaauugucaaagcucagugacgggaucacuuccugucggaugaaagauucuggaaagugcaacguagcggccaaucgcuggccaauaauucagugugaaaacgacaaauuuuacuauagcgagcugcaaaaugauuacgacaagacacaggauaucggucauuucugccuaucccccggcuguucaaccaucagauuuccuauuaaccagaagcacaucagcaauugcaacuggcaggucaguaggucuuccauugcuaaaauagacgugcacgauaucgaggacauugaucaauaucguaaggcaaucacacagaaacugcagacugggcucagccuguucaaguacgccaaaaccaagaaucuuccacauauuaagccgaucuauaaauacauaacgaucgaaggaaccgagacagcugaaggcauugagucggccuauaucgaaucagagauucccgcauuggcggguacuucuaucggguuuaagauaaacaguaaagagggcaagcaccuguuagacauuguuggauacgugaaauccgccagcuacucuagcgucuauaccaagcucuacuccacaggcccuacuucagggaucaacaccaaacaugaugaacuguguacgggaccaugccccgugaauaucaaccaccaaacagguuggcuuaccuucgcuaaggagcggacaaguagcuggggcugugaagaguuugggugccuggccauuucugacggauguguuuucggcuccugccaggacauagugcgagaugaauugucaguauauagaaaggagacagaggaagucaccgacguggagcucugccugacuuuuagugauaaaaccuacuguacaaaucuaaacccuaucacgccaauuaucaccgaccuguucgaagugcaguuuaagacugucgagacauauagccuccccaggauuguugcaauccagaaucaugaagugaaaauaggucaaaucaacgaucuggggguauacuccaagggcugcggaaaugugcagaaagucaacggcaccguguaugggaauggaguuccgaaguucgacuaccuuugucacuuggcuucucgcaaggaggugauuguccggaaaugcuucgauaacgacuaccaggccuguaaguuucugcagacuccugcaucguauagauuagaggaaagcucaggcacugugaccguuaucgauuacaaaaagauucucgguacgaucaaaaugaaggccauacugggggacgugaaguauaaaacauucgcugauaaugucgacaugaccgcggagggauccugcgccggcuguauuaacugcuuugaaaauauccacugugagcuuacucugcauaccacaaucgacgcaaguugcccaguaacuucucccuguaccguguuccacgauaggauucuaaucacaccuaacgagcauaaguacgcuaugaaaguuauaugcacggaaaagcccgguaauacccucacuauuaaaaucugcggcacaaagauugacgccagccuggccuugaucgaugcuaagccaauacuggaguuagcaccuguggaccaaaccgccuauauucgcgaaaaagaugagcgauguaagacuuggaugugccggguccgugacgaagggcuccaggugauccuggagcccuuuaaaaaccuuuucggauccuacaucggcaucuuuuauacauucauuauuuguauaaucguacuguugauugugaucuacaucguccucccaauuugcuuuaagcugagagauacccuaaggcagcacgaggacgcguacaaacgcgaaaugaagauacgguga

SEQ ID NO: 10946 - RNA, 4329 nt, Artificial Sequence
  derived and/or modified CDS sequence (opt3) from CHATV(Mohko M07-1)__KF719225.1__GP
augaugaucuucauucugauacucuuugccgugagcgcugcaucccccgucuaccagagaugcuuccaagacggcgccaucguuaagcagaacccuucuaaagaggcggugaccgaaguaugucuuaaggaugacgugucaaugauuaaaacagaggcuagguaugucaagaaugccacugggaucuacaguaacaauguggcaauucggaaauggcugguuagcgauuggcacgacugccgcccacgaaagguguccggaggucauaucaacgucauagaagugggcgaugacuugucuuuacacacggagucguauguauguucagccgauugcaccaucgggguugacaaggaaacagcucaggugcgucugcagacugauaccacaaaucauuuugagauugcaggaaccacugucaaaagcggcugguucaagaguacaaccuacaucacgcuagaccaaacuugugagcaccucaaaguguccugcgguccgaagucugugcaguuucaugccuguuucaaccagcacaugagcugcgucagauuucugcacaggaccauucuucccggguccaucgcuaauucaauaugucagaacauugaaaucauuauccugguuacauugacucuccugaucuucgugcugcucaguauuuuaagcaaaaccuauauaugcuaccugcuuaugccuaucuuuauuccaaucgccuauauguacggaauaauuuacaauaagucuuguaagaaaugcaaguugugcggccugguauaucaucccuucacagaguguggcacccacugcguguguggggcgcgguacgauacguccgaccgcaugaaacuacauagaucaagcggacucugcccugguuauaagagucugagggcagcccgggucauguguaaaucuaagggcccagcuuccauccuuagcaucauuacugccauccugguguugacauuuguuacccccauuaacucgauggugauaggggaaucuaaagaggucuucgagcucgaggaacugccugaugacauguuagaaauggcacugaagaucaaucucuacuauuuugugugcguaauuaacuacgcuguuacuuggucccuuaucaucguggcccuguugauugcgcuaauauucaagaaauaucaacaccgcuuccugaaucucuacgccauguacugugaggaaugcgacauguaucacgaucgaaucggacugaagagaaacggcgacuuuacaaauaaauguaggcagugcaccuguggucaguacgaggaugcaacggggcuuaugacccaucggaagacauauaacugccugguccaguacaaaucaaaguggauuuugaacuuccucaucacuuauauggugcugaccuuaauuaaggacagugcuaucauaguccaagccgcuggaacagauuuuagcgccugccuggaggcacaguccguggacuggaauuguacuggcccauuccuaaaccucggcaauugccagaaacaacagaagaaagaaucuuacgccaacaucgcuacccagcugaaggggcuucaggcgauuagcguuuuggaugugccgaugaucgcaaauauucccgaggacaucgccggagcucugcguuauauagaagagaaagauacauuucacguacaacucaccgccgaauacgcaaugcugacucgcuacugugacuauuacacgcaguucgccgauaacucagguuauagucagacaaccuggagagucuaccuuaggucccaugacuuugacgcuugcauucuguauccuaaucagcacuucugucggugcgugaagcauggcgauaagugugggagcucuaaccgagacuuugccaaugagaugaaaaacuacuauucaggaaagcaaaauaaauucgauaaggacuugaaccucgcacugauggcgguucaccacgcuuuucgcggcacaaguagcgccuacaucgcaaccauguuauccaaaaagucuaauaacgaucuggugacauacaccaauaagauuaaagagaaguucccagguaacgcccuacucaaagcuaucauggacuauauaucguacaugaaggggcugagcgaaaugacuaacuuuaaauaugaugaguucugggacgaucuuuugcauaagcccuccccuacaaaugccccaccccugucaagagacagugaaccgucuuacaacuucaaaagcgucaucuccucaaggagcgugaagucuugcaagaaugugaaaaacguaguuugucucuccccucggaguggcgucagcuaugauucuauucuggcaugcggagagcccaauggcccauccguguacaagaaaccuucagacgggaucuuucagaguaacagcgauaagacgauguauuguuuagcugacucgcacugccuggaagacuucgagguggucucccaggaggaacuugaugccauuaaaaagucuaagugcuggguuaccgaguaccccaaugugaaauugagcaagcucucagacggaaucacaaguugucgcaugaaagauuccgguaagugcaacguggcggccaauagauggccaauaauucagugugaaaacgacaaauuuuacuauucugagcugcaaaaugauuacgacaagacucaggauaucggccauuucugccuaagccccggguguuccaccaucagguuuccuauuaaccagaagcacaucucaaauugcaacuggcagguaagccguaguucuauugcuaaaauagacguccacgauaucgaggacauugaucaauaucggaaggcaaucacacagaaacugcagacuggacucucccuguucaaguacgccaaaaccaagaaucuuccacauauuaagccgaucuauaaauacauaacgaucgaaggcaccgagacagcugaagguauugagagcgccuauaucgaaucggagauucccgcauuggcggggacuucaaucggcuuuaagauaaacucuaaagagggaaagcaccuguuagacauugugggcuacguuaaaagugccuccuacagcucuguguauaccaagcucuacagcacagggccuacuuccggaaucaacaccaaacaugaugaacuguguacggguccaugccccgucaauaucaaccaccaaacaggcuggcuuaccuucgcuaaggagcgaacuucaaguugggggugugaagaguuuggaugccuggccauuagcgacggcuguguguucgguucuugccaggacauaguuagagaugaauuguccguguauaggaaggagacagaggaaguaaccgacgucgagcucugccugacuuuuucagauaaaaccuacuguacaaaucuaaacccuaucacgccaauuaucaccgaccuguucgaagugcaguuuaagacuguggagacauauagucucccccgcauugucgcaauccagaaucaugaaguuaaaauagggcaaaucaacgaucugggcguguacagcaagggaugcggcaauguacagaaagugaacgggaccgucuauggaaauggcgugccgaaguucgacuaccuuugucacuuggcuucccggaaggagguuauugugagaaaaugcuucgauaacgacuaccaggccuguaaguuucugcagacuccugcaucuuauagguuagaggaaaauucggguacugucaccgugaucgauuacaaaaagauucucgggacgaucaaaaugaaggccauacugggagacguuaaguauaaaacauucgcugauaacguggacaugaccgcggagggcagcugcgccgguuguauuaauugcuuugaaaacauccacugugagcuuacucugcauaccacaaucgacgcaucaugcccagucacuucccccuguaccguauuccacgaucgcauucuaaucacaccuaaugagcauaaguacgcuaugaaagugauaugcacggaaaagcccggcaacacccucacuauuaaaaucugcgggacaaagauugacgccagucuggccuugaucgaugcuaagccaauacuggaguuagcaccuguugaccaaaccgccuauauucgagaaaaagaugagcgguguaagacuuggaugugccgugugagagacgaaggacuccaggucauccuggagcccuuuaaaaaccuuuucggcucuuacaucgggaucuuuuauacauucauuauuuguaugauagugcuguugaucguaauuuacaucgugcucccaaucugcuuuaagcugagggauacccuacgccagcacgaggacgcguacaaacgggaaaugaagauuagauga

SEQ ID NO: 10947 - RNA, 4329 nt, Artificial Sequence
  derived and/or modified CDS sequence (opt3) from CHATV(Mohko M07-2-83)__KF719228.1__GP
augaugaucuucauucugauacucuuugccgugagcgcugcaucccccgucuaccagagaugcuuccaagacggcgccaucguuaagcagaacccuucuaaagaggcggugaccgaaguaugucuuaaggaugacgugucaaugauuaaaacagaggcuagguaugucaagaaugccacugggaucuacaguaacaauguggcaauucggaaauggcugguuagcgauuggcacgacugccgcccacgaaagguguccggaggucauaucaacgucauagaagugggcgaugacuugucuuuacacacggagucguauguauguucagccgauugcaccaucgggguugacaaggaaacagcucaggugcgucugcagacugauaccacaaaucauuuugagauugcaggaaccacugucaaaagcggcugguucaagaguacaaccuacaucacgcuagaccaaacuugugagcaccucaaaguguccugcgguccgaagucugugcaguuucaugccuguuucaaccagcacaugagcugcgucagauuucugcacaggaccauucuucccggguccaucgcuaauucaauaugucagaacauugaaaucauuauccugguuacauugacucuccugaucuucgugcugcucaguauuuuaagcaaaaccuauauaugcuaccugcuuaugccuaucuuuauuccaaucgccuauauguacggaauaauuuacaauaagucuuguaagaaaugcaaguugugcggccugguauaucaucccuucacagaguguggcacccacugcguguguggggcgcgguacgauacguccgaccgcaugaaacuacauagaucaagcggacucugcccugguuauaagagucugagggcagcccgggucauguguaaaucuaagggcccagcuuccauccuuagcaucauuacugccauccugguguugacauuuguuacccccauuaacucgauggugauaggggaaucuaaagaggucuucgagcucgaggaacugccugaugacauguuagaaauggcacugaagaucaaucucuacuauuuugugugcguaauuaacuacgcuguuacuuggucccuuaucaucguggcccuguugauugcgcuaauauucaagaaauaucaacaccgcuuccugaaucucuacgccauguacugugaggaaugcgacauguaucacgaucgaaucggacugaagagaaacggcgacuuuacaaauaaauguaggcagugcaccuguggucaguacgaggaugcaacggggcuuaugacccaucggaagacauauaacugccugguccaguacaaaucaaaguggauuuugaacuuccucaucacuuauauggugcugaccuuaauuaaggacagugcuaucauaguccaagccgcuggaacagauuuuagcgccugccuggaggcacaguccguggacuggaauuguacuggcccauuccuaaaccucggcaauugccagaaacaacagaagaaagaaucuuacgccaacaucgcuacccagcugaaggggcuucaggcgauuagcguuuuggaugugccgaugaucgcaaauauucccgaggacaucgccggagcucugcguuauauagaagagaaagauacauuucacguacaacucaccgccgaauacgcaaugcugacucgcuacugugacuauuacacgcaguucgccgauaacucagguuauagucagacaaccuggagagucuaccuuaggucccaugacuuugacgcuugcauucuguauccuaaucagcacuucugucggugcgugaagcauggcgauaagugugggagcucuaacugggacuuugccaaugagaugaaaaacuacuauucaggaaagcaaaauaaauucgauaaggacuugaaccucgcacugauggcgguucaccacgcuuuucgaggcacaaguagcgccuacaucgcaaccauguuauccaaaaagucuaauaacgaucuggugacauacaccaauaagauuaaagagaaguucccagguaacgcccuacucaaagcuaucauggacuauauaucguacaugaaggggcugagcgaaaugacuaacuuuaaauaugaugaguucugggacgaucuuuugcauaagcccuccccuacaaaugccccaccccugucacgcgacagugaaccgucuuacaacuucaaaagcgucaucuccucaagaagcgugaagucuugcaagaaugugaaaaacguaguuugucucuccccuaggaguggcgucagcuaugauucuauucuggcaugcggagagcccaauggcccauccguguacaagaaaccuucagacgggaucuuucagaguaacagcgauaagacgauguauuguuuagcugacucgcacugccuggaagacuucgagguggucucccaggaggaacuugaugccauuaaaaagucuaagugcuggguuaccgaguaccccaaugugaaauugagcaagcucucagacggaaucacaaguugucggaugaaagauuccgguaagugcaacguggcggccaaucgcuggccaauaauucagugugaaaacgacaaauuuuacuauucugagcugcaaaaugauuacgacaagacucaggauaucggccauuucugccuaagccccggguguuccaccaucagauuuccuauuaaccagaagcacaucucaaauugcaacuggcagguaagcaggaguucuauugcuaaaauagacguccacgauaucgaggacauugaucaauaucguaaggcaaucacacagaaacugcagacuggacucucccuguucaaguacgccaaaaccaagaaucuuccacauauuaagccgaucuauaaauacauaacgaucgaaggcaccgagacagcugaagguauugagagcgccuauaucgaaucggagauucccgcauuggcggggacuucaaucggcuuuaagauaaacucuaaagagggaaagcaccuguuagacauugugggcuacguuaaaagugccuccuacagcucuguguauaccaagcucuacagcacagggccuacuuccggaaucaacaccaaacaugaugaacuguguacggguccaugccccgucaauaucaaccaccaaacaggcuggcuuaccuucgcuaaggagcggacuucaaguugggggugugaagaguuuggaugccuggccauuagcgacggcuguguguucgguucuugccaggacauaguucgagaugaauuguccguguauagaaaggagacagaggaaguaaccgacgucgagcucugccugacuuuuucagauaaaaccuacuguacaaaucuaaacccuaucacgccaauuaucaccgaccuguucgaagugcaguuuaagacuguggagacauauagucuccccaggauugucgcaauccagaaucaugaaguuaaaauagggcaaaucaacgaucugggcguguacagcaagggaugcggcaauguacagaaagugaacgggaccgucuauggaaauggcgugccgaaguucgacuaccuuugucacuuggcuucccgcaaggagguuauugugcggaaaugcuucgauaacgacuaccaggccuguaaguuucugcagacuccugcaucuuauagauuagaggaaaauucggguacugucaccgugaucgauuacaaaaagauucucgggacgaucaaaaugaaggccauacugggagacguuaaguauaaaacauucgcugauaacguggacaugaccgcggagggcagcugcgccgguuguauuaauugcuuugaaaacauccacugugagcuuacucugcauaccacaaucgacgcaucaugcccagucacuucccccuguaccguauuccacgauaggauucuaaucacaccuaaugagcauaaguacgcuaugaaagugauaugcacggaaaagcccggcaacacccucacuauuaaaaucugcgggacaaagauugacgccagucuggccuugaucgaugcuaagccaauacuggaguuagcaccuguugaccaaaccgccuauauucgcgaaaaagaugagcgauguaagacuuggaugugccgggugcgugacgaaggacuccaggucauccuggagcccuuuaaaaaccuuuucggcucuuacaucgggaucuuuuauacauucauuauuuguaugauagugcuguugaucguaauuuacaucgugcucccaaucugcuuuaagcugagagauacccuaaggcagcacgaggacgcguacaaacgcgaaaugaagauucgguga

SEQ ID NO: 10948 - RNA, 4326 nt, Artificial Sequence
  derived and/or modified CDS sequence (opt3) from CHATV(LEIV-15854)__HQ734820.1__GP
augaucuucauucugauacucuuugccgugagcgcugcaucccccgucuaccagagaugcuuccaagacggcgccaucguuaagcagaacccuucuaaagaggcggugaccgaaguaugucuuaaggaugacgugucaaugauuaaaacagaggcuagguaugucaagaaugccacugggaucuacaguaacaauguggcaauucggaaauggcugguuagcgauuggcacgacugccgcccacgaaagguguccggaggucauaucaacgucauagaagugggcgaugacuugucuuuacacacggagucguauguauguucagccgauugcaccaucgggguugacaaggaaacagcucaggugcgucugcagacugauaccacaaaucauuuugagauugcaggaaccacugucaaaagcggcugguucaagaguacaaccuacaucacgcuagaccaaacuugugagcaccucaaaguguccugcgguccgaagucugugcaguuucaugccuguuucaaccagcacaugagcugcgucagauuucugcacaggaccauucuucccggguccaucgcuaauucaauaugucagaacauugaaaucauuauccugguuacauugacucuccugaucuucgugcugcucaguauuuuaagcaaaaccuauauaugcuaccugcuuaugccuaucuuuauuccaaucgccuauguauacggaauaauuuacaauaagucuuguaagaaaugcaaguugugcggccugguguaucaucccuucacagaguguggcacccacugcgucuguggggcgcgguacgauacguccgaccgcaugaaacuacauagaucaagcggacucugcccugguuauaagagucugagggcagcccgggugauguguaaaucuaagggcccagcuuccauccuuagcaucauuacugccauccugguuuugacauuugugacccccauuaacucgauggucauaggggaaucuaaagagguguucgagcucgaggaacugccugaugacauguuagaaauggcacugaagaucaaucucuacuauuuuguaugcguuaugaacuacgcugugacuuggucccuugucauuguggcccuguugaucgcgcuaaucuucaagaaauaucaacaccgcuuccugaaucucuacgccauguacugugaggaaugcgacauguaucacgaucgaauuggacugaagagaaacggcgacuuuacaaauaaauguaggcagugcaccuguggucaguacgaggaugcaacggggcuuaugacccaucggaagacauauaacugccugguccaguacaaaucaaaguggauauugaacuuccucaucacuuauauggugcugaccuuaauuaaggacagugcuaucauuguucaagccgcuggaacagauuuuagcgccugccuggaggcacaguccguggacuggaauuguacuggcccauuccuaaaccucggcaauugccagaaacaacagaagaaagaaucuuacgccaacaucgcuacccagcugaaggggcuucaggcgauaagcguauuggaugucccgaugaucgcaaauauucccgaggacaucgccggagcucugcguuauauugaagagaaagauacauuucacgugcaacucaccgccgaauacgcaaugcugacucgcuacugugacuauuacacgcaguucgccgauaacucagguuauagucagacaaccuggagaguuuaccuuaggucccaugacuuugacgcuugcauccuguauccuaaucagcacuucugucggugcgugaagcauggcgauaaguguucuagcucaaacugggacuuugccaaugagaugaaaaacuacuauagugggaagcaaaauaaauucgauaaggacuugaaccucgcacugauggcgguccaccacgcuuuucgaggaacuagcuccgccuacauagcaaccauguuaucuaaaaagcugaauaacgaucuaauuacauacaccaauaagaucaaagagaaguucccaggcaacgcccuccugaaagcuauuauggacuauaucucguacaugaagggucuuagcgaaaugacuaacuuuaaauaugaugaguucugggacgauuugcugcauaagcccuccccuacaaaugccccaccccucucacgcgacagugaaccgucuuacaacuucaaaagcgugauauccucaagaagcguaaagucuugcaagaaugugaaaaacguugucugucuguccccuaggaguggggcaagcuaugauucuaucuuagcuugcggcgagcccaauggaccauccguguacaagaaaccuucagacggcguguuucagaguaacagcgauaagacgauguauugucuggccgacucgcacugccuugaagacuucgaggucguuucccaggaggaauuggaugcgauuaaaaagucuaagugcugggugaccgaguaccccaaugugaaacucagcaagcugucagacgggaucacaaguugucggaugaaagauuccggaaagugcaacguagccgcuaaucgcuggccaauuauccagugugaaaacgacaaauuuuacuauucugagcuacaaaaugauuacgacaagacacaggauauaggucauuucugccugagccccggcuguuccaccauuagauuuccuaucaaccagaagcacaucucaaauugcaacuggcaggucagcaggaguucuauugcaaaaaucgacgugcacgauauugaggacauagaucaauaucguaaggccaucacacagaaacuccagacugggcugucccuuuucaaguacgcuaaaaccaagaauuugccacauauuaagccgaucuauaaauacauuacgaucgaaggaaccgagacagccgaaggcauagagagcgcauauaucgaaucggagauucccgcgcuggccgguacuucaaucggguuuaagauuaacucuaaagagggcaagcacuuacucgacaucguuggauacgugaaaagugcuuccuacagcucugucuauaccaagcuguacagcacaggcccuacuuccgggauaaacaccaaacaugaugaacuuuguacgggaccaugccccgugaauauuaaccaccaaacagguuggcugaccuucgccaaggagcggacuucaaguuggggcugugaagaguuugggugcuuggcaaucagcgacggauguguuuucggcucuugccaggacaucgugcgagaugaacucuccguauauagaaaggagacagaggaagucaccgacguggagcugugccuaacuuuuucagauaaaaccuacuguacaaaucugaacccuauuacgccaauaaucaccgaccucuucgaagugcaguuuaagacugucgagacauauagucugcccaggauuguugcugugcagaaucaugaaguaaaaaucggucaaauuaacgaucuugggaucuacagcaagggcugcggaaaugugcagaaagucaacggcaccguguaugggaauggaguuccgaaguucgacuacuugugucaccuggccucccgcaaggaggugauaguccggaaaugcuucgauaacgacuaccaggcauguaaguuuuuacagacuccugccucuuauagacucgaggaaaauucgggcacugugaccguuaucgauuacaaaaagauucuggguacgaucaaaaugaaggcuauucuuggggacgugaaguauaaaacauucgcggauaacgucgacaugaccgccgagggaagcugcgcaggcuguaucaauugcuuugaaaacauacacugugagcugacucuacauaccacaauugacgcuucaugcccaguaacuucccccuguaccguguuccacgauaggauccucaucacaccuaaugagcauaaguacgccaugaaaguuauuugcacggaaaagcccgguaacacccugacuaucaaaauaugcaguacaaagauugacgccucuuuggcucugaucgaugcaaagccaauuuuagagcucgccccuguggaccaaaccgcguauauccgcgaaaaagaugagcgauguaagacuuggaugugccggguccgugacgaaggccuucaggugauacuggagcccuuuaaaaaccuguucgggagcuacauuggaaucuuuuauacauucaucauuuguguaaucguguugcucauugucauauacaucguucugccaauuugcuuuaagcuaagagauacccugaggcagcacgaggacgcuuacaaacgcgaaaugaagauccgguga

SEQ ID NO: 10949 - RNA, 4326 nt, Artificial Sequence
  derived and/or modified CDS sequence (opt3) from CHATV(LEIV-17756)__EU621834.1__GP
augaucuucauucugauacucuuugccgugagcaccgcuucccccgucuaccagagaugcuuccaagacggcgcaaucguuaagcagaacccuucuaaagaggccgugacagaaguaugucuuaaggaugacgugucaaugauuaaaacugaggcgagguauauccggaaugcuacggggaccuuuaguaacaaugucgccauucgcaaguggaucgugagcgauuggcacgacugccgaccaaagaagguuuccggaggucauauaaacgugaucgaagucggcgaugaccugucuuugcacacagagucguacguguguucagcagauugcacuauugggguagacaaggaaaccgcccagguucguuuacagacagauaccacuaaucauuucgagaucgcuggaacaaccgugaaaagcggcugguuuaagaguacgacuuauauuacccuggaccaaacaugugagcaccuaaaagucuccugcgguccgaagucugugcaguuccaugcauguuuuaaccagcacaugagcugcgugagauuccuccacaggacuauccugcccggguccauagccaauucaauuugucagaacaucgaaauuaucauccuugucacccugacauugcucauuuuuguucugcugaguauacucagcaaaaccuacaucugcuauuuacugaugccuauuuucaucccaauagcuuacauuuauggaaucaucuacaauaagucuuguaagaaaugcaaacuuugcggcuugguguaccaucccuuuacggaguguggcacucacugcguauguggggcccgguaugauacauccgaccgcaugaaacugcauagaucaagcggacuaugcccugguuacaagagucucagggcggcacgggugauguguaaaucuaagggcccagccuccauucugagcaucauuaccgcuauacuuguccugacuuucgugacacccaucaacucgaugguugugggggaaucuaaagaggucuuugaguuggaagaacucccugaugacaugcuggaaauggccuuaaagauuaauuucuauuacuucgugugcguaaugaacuaugcaguuaccuggggacugaucguggucgcucuccuuaucggccugauuuuuaagaaauaccaacaccgcuucuugaaucuauaugccauguacugugaggaaugcgacauguaccacgaucgaacgggucugaagagaaacggggacuuuaccaauaaauguaggcagugcacauguggacaguaugaggaugcgacuggccucaugacccaucggaagacauacaacugccuggugcaguauaaauccaaguggauacuuaacuuccugaucacuuacauggucuugacccucauuaaggacucagccaucgugguucaagcaacaggcaccgauuuuaguagcugccuggagacucaguccgugaauuggaacuguacggggccauucuuaaaucugggaaacugccagaaacaacagaagaaagaaucuuaugcuaauauugccacacagcuaaagggucuccaggcuaucagcguacuggacaugccgaugauagccucaauccccgaggauauugcaggcgcccuucguuacaucgaggagcgcgaaaccuuucacguccaauugacugcugaguaugcgaugcugaccagauacugugacuacuauacacaguucgcagauaacaguggguacucccagaccacuuggaggguguaucuccggagccaugacuuugaugccugcauucuguacccuaaucagcacuucugucgaugcguuaaacauggagacaaguguucuucaaguaacugggacuuugcuaaugagaugaagaacuauuacagcggcaaacaaaauaaguucgauaaagaccuuaaccuggccuugaugacaaugcaccacgcauuucgcgguacguccucugccuauaucgcugcccuccugucgaagagaagcaaugaugacuuaguggcauacaccaacaaaauaaaggaaaaguucccagggaaugcgcugcuaaaagcugucauggauuacauuuccuauaugaagucacucagugagaugucuaacuucaaauacgacgaauuuugggaugaccugcuucauaagcccaacccuacuaaagcccccagcuuguccaggggcgaugagccagcauauaauuucaagcuggccaucucaagccggucuaugaaauccugcaagaacgugaagaguguagugugucucagcccgcgcucuggaguuuccuacgacucaauucuggcuugcggcgaaccuaaugcccccaguguccacagaaaaccaagcgaugggguguuucagucgaacuccgacaagacaauguauuguuuagcagauucucauugccuggaggacuucgagguggucagccaggaggagcuugacgcuaucaaaaagucagaaugcuggguuaccgaguacccuaaugugaaauugaguaagcucuccgauggaauaaagucuuguaggaugaaagacagcgguaagugcaacguggccacaaaucguuggcccaucauucagugugagaacgauaaauuuuauuacuccgaacugcaaaaugacuacgauaagacucaggacaucggccacuucugccuaucaccaggguguagcaccauucgguuucccaucaaccagaaacacauaaguaauugcaacuggcagguaucucgauccagcauugcgaagaucgauguccauaauaucgaggacauugaacaauauagaaaggccaucacgcagaaacugcagaccucgcucucacuguucaaguacgcuaggacuaaaaaccuuccucacauuaagccaauauauaaauacaucacaauugagggaaccgaaacagcagagggcaucgagucugccuauauugaaagugagaucccggcuuuggccgguacuuccauaggguuuaagaucaauagcaaggaaggcaaacaucuguuagaugugauuggauacguuaagucugcaagcuauuccucaguguacaccaaacucuacaguacgggccccacaagcgggaucaacaccaagcacgacgagcuguguacuggaccuugcccagcgaacauuaaacaucaaacagguuggcuuaccuucgcccgcgaacggacuucuuccuggggcugugaggaguuugggugccuggcuaucucagauggaugugucuucggcaguugccaggacauagugagagaugaauugagcguuuauaggaaggagaccgaagaggugacagacguagaacucugccugacguuuuccgacaaaaccuacuguacuaaucuaaaccccauuacaccuaucaucaccgaucuguucgagguccaguucaagacaguggagacuuauucucucccacgcauuguggccauacagaaucacgaaaucaagauuggucaaaucaacgaccugggggucuacucgaaaggcugcggaaauguucagaaggugaacggcaccguauaugggaauggagugcccaaauuugauuaccuuugucacuuggcaagccgaaaggaggucauugugcggaaaugcuucgacaacgauuaucaggcuuguaaguuucugcagacgccggccucauaccguuuagaagaaaauuccggcacaguuaccgugaucgacuacaagaaaauacucgguacuaucaagaugaaagcaauucugggggaugucaaguauaaaaccuucgccgacaacguggauaucacagcugagggaaguugcacuggcuguauuaauugcuuugaaaacauccauugugagcuuaccauacacacaacgauugacgcgucuugcccuguuaccagcccauguacuguguuccaugauagaauccuggucacacccaaugaacacaaguacgccaugaagguaaucugcaccgagaaaccugguuccacucuagcaauuaagaucugcaacacaaaaauagacgcuucacucgcccugauugacgccaagcccaucuuggaacuggcuccaguggaucaaaccgcauauauuagggagaaagacgagcgcuguaagacguggaugugccggguuagagaugaaggcuuacaggugauccucgagccuuuuaagaaucuguucgggucuuacauaggaaucuuuuauacuuucgucauuagcaucauugcccuucugaucgugauuuacauaaucuugcccauuuguuuuaaacucagggacacccugcgaaagcaugaagaugcguauaaacgcgagaugaagauccgguga

SEQ ID NO: 10950 - RNA, 4326 nt, Artificial Sequence
  derived and/or modified CDS sequence (opt3) from CHATV(LEIV-18733)__HQ734821.1__GP
augaucuucauucuggugcuccuugccgucagcaccgcuucccccguuuaccagagaugcuuucaagacggcgcaauagugaagcagaacccuucuaaagaggccguaacagaagugugucugaaggaugacgucucaaugaucaaaacugaggcgagguauaugaagaaugcuacggggaccuucaguaacaauguggccauucggaaaugguugguuagcgauuggcacgacugccgcccaaagaagguguccggaggucauaucaacgucauugaagugggcgaugacuuaucucugcacacagagucguacguauguucagcagauugcacuaucgggguugacaaagaaaccgcccaggugcgacuacagacagauaccacuaaucauuuugagauagcuggaacaaccgucaagagcggcugguucaaaaguacgacuuauaucacccucgaccaaacaugugagcaccugaagguguccugcgguccgaaaucugugcaguuucaugcauguuucaaccagcacaugagcugcguccguuuucuucacagaacuguucugcccggguccauugccaauucaaucugucagaacauugaaaucauaauuuuggugacccucacacugcugaucuucguacucuuaaguauucugagcaagaccuacaucugcuaucuuuugaugccuaucuuuauuccaauagcuuacguguauggaaucauuuacaauaagucuuguaaaaagugcaaacugugcggccuagucuaccaucccuucacggaguguggcacucacugcguguguggggccagguaugauacauccgaccggaugaagcuccaucgcucaagcggacugugcccugguuacaaaagucuuagagcggcaaggguuauguguaagucuaaaggcccagccuccauccugagcauaauuaccgcuaucuuggugcucacuuuugucacacccaucaacucgauggugauuggggaaucuaaggagguauucgagcuggaagaguuaccugaugacaugcuggaaauggcccucaagaucaauuuuuauuacuucguuugcgugauuaacuaugcagucaccuggggacuuauaguggucgcucuguugaucggccuaguguucaaaaaguaccaacaccgguuucugaaucucuaugccauguacugugaggaaugcgacauguaccacgaucgcacgggucugaaacgaaacggggacuucaccaauaaguguagacagugcacauguggacaguaugaggaugcgacuggccuuauuacccauaggaaaacauacaacugccugguuaaguauaaguccaaauggaucuugaacuuucucaucacuuacauggugcugaccuuaauuaaggacucagccauaguaguccaggcagcuggcacagauuucagugccugccuggaggcucaaagcguggacuggaauuguaccgggccauuucuaaaccucggaaauugccagaaacagcaaaagaaagaauccuaugccaacaucgcaacucagcugaagggucuucaggccauuucuguuuuggauaugccgaugaucgcuagcauucccgaggacaucgcgggcgcacugcgguacauagaagagaaggaaacguuccacgugcagcucacagccgaguaugcuaugcugacccguuacugugauuacuauacucaauuugccgacaauucaggguacagucagaccacauggcgcgucuaucuuagaucccaugauuucgacgcaugcauccuguacccuaaccagcacuuuuguaggugcgugaaacauggagacaaguguucgucuucaaauugggauuucgccaacgagaugaaaaauuauuacaguggcaagcagagcaaauuugacaaggauuugaaccucgcucugaugaccguacaccacgccuuccgggguacuuccucugcauauauugcgacaauguuaucgaagaaaagcaauaacgaccugguggcuuacacgaauaagaucaaagaaaaguuuccagggaacgcccuacucaaagcaguuauggauuacauuuccuauaugaagucacugagugagaugaccaauuucaaauacgacgaguucugggaugaccuuuuguaucgacccaacccuacuaaggccccaucucugagccgcgaauccgaaacaucauacaacuuuaagcucgucaucagccccaaaucuaugaaguccugcaaaaaugugaagaguguggucugucugagcccgagaucuggcgcuuccuaugauucaauauuagccugcggagagccuaacggccccaguguuuacaggaaaccaagcgggggaguguuccaaagcaauuccgacaagaccauguauugucuggcagauucucauugccuugaggacuuugaagugauuggucaggaggaauuggaugcuaucaagaaaagcguaugcugggccgucgaguacccugacgugacacucucaaagcugagugacggcguuaaauccugucggaugaaggauucugggaaaugcaacguggcggccaaucgcuggcccauuauccagugugagaacgacaaguucuacuauagcgaacuacagaaugauuacgacaagacucaagauauaggacacuuuugccuguccccaggcuguucaaccgucagauuccccaucaaccagaaacauauuagcaauugcaacuggcaagugaguaggucuuccaucgcuaagauugacguucacgauaucgaggacauagaucaguaucguaaagcaauuacgcagaagcuccagaccagccugucgcuuuuuaaauacgccaagacaaagaauuugccucacaucaaaccaaucuauaaguacauuacuaucgaagguaccgagacagcugaagggauugagucagccuauauagagucugaaaucccggcacuggcgggcaccagugugggauucaaaauuaacuccaaggagggcaaacauuuacucgacaucauuggguacguaaagagcgccucuuacagcuccgucuauacuaaacuguacucaacgggacccacaagugguaucaauaccaagcacgaugaacuuuguacuggcccuugcccagcuaacauaaaucaucagaacggguggcugacauuugccaaggagcggaccagcucuuggggaugugaagaguucggcugcuuggcaaucuccgacgguuguguguuugggucaugccaagauauugugcgagacgagcucagugucuauagaaaagaaacugaggaaguuaccgacguggagcugugccuaacauucagcgauaagacguacuguaccaaccugaaucccaucacuccuauuaucacagaccucuuugaaguacaguucaaaaccguggagacauauucccugccaaggauagucgcuauucagaaccacgagaucaagaucggccagauuaaugaucuuggaguguacucuaaaggcugcgggaacguucaaaaggugaauggaacugucuauggcaacggugugcccaaguucgacuacuugugucaucuggccucgcgcaaagaaguuauagugcggaagugcuuugauaaugacuaccaggcauguaaauucuuacagaccccggccagcuauagacucgaggaaaacucagggacgaucacagucauugauuacaagaaaauccugggaaccauuaagaugaaggcuauccuuggcgacguaaaauauaagacuuuugcggauaauguggacauaaccguugaggguuccugcgccggcuguaucaacugcuucgagaauauucacugugaacugacaauccacacuaccauugaggcaaguugcccugugacaucuccauguacggucuuucaugauaggauccuaauaacccccaacgaacacaaauacgcuaugaaggugguaugcacugagaaaccugggaauacacucacccugaaggugugcaacacuaaggucgacgccagcuuggcccugauugacgcuaaacccaucuuagaacucgcaccaguugaucagacagccuauauccgcgagaaggacgagcgauguaaaaccuggaugugccgggugcgugaugaaggacugcaagugauucuugagccuuucaagaaucuguuuggcuccuacaucgggauauucuauacgauuaucauuucaaucauagucuugcucauugugaucuacaucauucugcccguuuguuuuaaacuaagagacacucugaggcagcaugaagaugcguacaagcgcgagaugaagguacgguga

SEQ ID NO: 10951 - RNA, 4326 nt, Artificial Sequence
  derived and/or modified CDS sequence (opt3) from CHATV(LEIV-22712)__HQ734822.1__GP
augaucuucauucugauacucuuugccgugagcgcugcaucccccgucuaccagagaugcuuccaagacggcgccaucguuaagcagaacccuucuaaagaggcggugaccgaaguaugucuuaaggaugacgugucaaugauuaaaacagaggcuagguauacuaagaaugccacggggaccuuuaguaacaaugucgcaauccggaaauggcuggugagcgauuggcacgacugccgcccaaagaagguuuccggaggucauauuaacgugaucgaagucggcgaugacuugucuuuacacacagagucguacguguguucagccgauugcacuauagggguagacaaagaaaccgcucagauccgacugcagacagauaccacuaaucauuucgagauugcaggaacaaccguuaagagcggcugguuuaaaaguacgacuuauaucacccuagaccaaacaugugagcaccucaagguguccugcgguccgaaaucuguccaguuccaugccuguuuuaaccagcacaugagcugcgugcguuuccugcacagaacugugcuucccggguccauugcuaauucaaucugucagaacauagaaauuaucauucuggucaccuugacacuccugaucuuuguucugcucaguaucuuaagcaagaccuacauuugcuaucugcuuaugccuauauucaucccaauugccuacguguauggaaucauauacaauaagucuuguaaaaagugcaaauugugcggccugguauaccaucccuuuacggaguguggcacucacugcguguguggggcgagguaugauacauccgaccggaugaagcuacaucgcucaagcggacucugcccugguuacaaaagucugagagcagccagggucauguguaagucuaaaggcccagcuuccgugcuuagcauuaucaccgccauccugguuuugacuuucgugacacccauuaacucgauggucgugggggaaucuaaggagguauuugagcucgaagaacugccugaugacauguuagaaauggcacugaagaucaauuucuauuacuucauuugcguuaugaacuaugcugugaccuggggacucauagucgugggccuucugaucgguuuggucuuuaaaaaguaccaacaccgguuccuaaaucuguaugccauguacugugaggaaugcgacauguaccacgaucgcacggggcucaaacgaaacggagacuuuaccaauaaguguagacagugcacauguggccaguaugaggaugcgacuggccugauuacccauaggaaaacauacaacugccuugugcaguauaaguccaaguggauccugaacuucuugaucgccuacaugacucucacccugauuaaagacucagcaauaaucguucaagcuacagggaccgauuuuauuaguugcuuagagacucagagcgugaauuggaacuguacgggaccauuccugaaucuagguaacugccagaagcaacagaaaaaggaaccguaugccaauaucgcuacacagcucaaaggccugcaggccauuuccguacuugacauccccaugauagcaaacaucccugaggauauugccggggcuuugcgguacaucgaagagaaggaaaccuuucacguccaacugacugcggaguaugcaaugcucacccguuacugugacuacuauacacaguucgccgauaauucuggauacagccagaccacuuggcgcguguaucugagaucacaugacuuugaugcuugcauucuuuacccaaaccagcacuucuguaggugcguuaagcauggcgacaaauguaguuccagcaauugggacuuugccaacgagaugaagaauuauuacucugguaaacaaucaaaguucgauaaagaccugaacuuggcacucaugacaaugcaccacgccuuucgggggacgaguagcgcuuauaucgccacccuguuauccaagaagcugaaugaugaccuagcagcguacacuaacaaaauaaaggaaaaauuccccggcaaugcucuccugaaggccaugauggauuacauuucuuauaugaaaucgcuuagcgagauggcaaacuucaaguacgacgaauuuugggaugacuugcugcauaaaccugauccaacaaaggcuccccuccugucccgaggaucagagccgguguauaacuucaaguuagucgugaguucucgcagcguaaaauccugcaagaaugugaaaucaguugucugucugagcccuagaucuggcguguccuacgacagugugcuugccugcggggaacccaacggaccaagcgucuauaggaagccuucugaugguguuuuucaguccaauucagacaaaaccaucuacuguuuggccgauagucacugccucgaggacuucgaggugauuagccaggaggagcuggacgcaaucaagaagucggaaugcugggugauagaguaucccaacguaaaacuaacaaagccauccgauggcaucaaaucuugucggaugaaggacagcgggaaaugcaaugucgcuacuaaccgcuggcccauuauccagugugagaauaacaauuuuuacuacucagaacugcaaaacgauuaugacaagacccaggauauuggacauuucugccucaguccuggcuguuccacgaucagauacccaauaaaucagaagcacauuucuaacugcaauuggcaagugagccacuccucaaucgccaaaaucgacguucauaacauugaggauaucgaacaguauaggaaggcgauuacccagaaacugcagacaagccuuaguuuguuuaaguacgccaaaacuaagaaucugccgcacauaaagcccaucuauaaauacauuaccaucgaggguacagaaacugcugaggggauugagucugcauauaucgaauccgagauaccugccuuagcuggcaccagcaucggauucaagauuaacucgaaagaaggcaagcaucuccuggacgugaucggguacgucaaaucagccucuuacaguuccguguauagcaagcuguacucuacgggaccaacaagcgguauuaacaccaaacacgaugagcuguguacuggccccugcccugaaaauaucaagcaucaaacagggugguugaccuuugcacgugagcggacuuccucauggggaugugaggaguucggcugccucgcgauaagugacgguuguguuuuugggagcugccaggauauugugaaggacgagcugucuguauaucgaaaagaaaccgaggaagucacagauguggagcuaugccugacguucuccgacaagaccuacuguacuaaccucaauccaaucacacccaucauuaccaaccuguuugaggugcaguucaaaacagucgaaacuuauucacuuccgagaauaguugccauccagaaucacgagauuaagaucggccaaauuaacgacuugggaguguacaguaaaggcugcgggaauguacagaaggugaacggaaccgucuauggcaauggugugccuaaguucgauuaccugugucacuuagcuagcaggaaagaaguuaucgugcgcaagugcuuugacaacgauuaccaggccuguaaauuccuccagacgccagcauccuaucggcuggaggaaaauucuggggcuauaacagucaucgacuacaagaaaauucuuggaaccaucaagaugaaggccauucugggcgaugugaaauauaagacuuuugcagacaacguugauaucaccgccgaagguucgugcacaggcuguauaaauugcuucgagaacauucauugugaacuaacuauccacaccacaaucgaggcuagcugccccgugacgucaccuuguaccgucuuucaugacaggauucucguaacucccaaugaacacaaauacgcgaugaaggugguuugcacagagaaaccaggguccacccuggugaucaaggucugcaacacuaagauagaugccaguuuggcacugauugacgcuaaaccuaucuuagagcucgcccccguggaucaaacagccuauauuagagaaaaggacgagcgcuguaaaaccuggaugugccgaguacgggacgaaggacuucaggugauccuugagccauucaagaaccuguuuggcucuuacauagggauuuucuauacguuuaucaucagcauuaucgucuugcucauuguuauauacaucauucugccgaucuguuucaaacuacgugauacucugagaaagcaugaagacgcuuacaagagggagaugaaaauccgcuga

SEQ ID NO: 10952 - RNA, 4332 nt, Artificial Sequence
  derived and/or modified CDS sequence (opt3) from INKV(KN3641)__U88059.1__GP
auggaggugcugaaccucaucuggcuucugaccuugugcagcgccucccccgucuuccagagauguuuucaagacggcgcuauuguuaagcagaauccuucuaaagaagcagugacagagguaugcuuaaaggaugacgugucaaugauaaaaacugaagccaaguacaucaaaaacacgaccgggacauucgcgaauaacauugcuaugaggaaguggcuggucgccgauuggcacgacugucggccacagaagaguagcggaggucauaucaaugugauugagguuggcgaugaccuaucccuccacacugaaucuuauaucugcucggcagauugugugauaaccgucgacaaagagacagcccagauccgccugcaaaccgauaacacuaaucauuuugagguggcugggacaaccguaaagucaggaugguucaaaagcacgacuuacauuacccuugaccagacaugcgaacaccugaagguuaguuguggcccgaaauccauccaguuucaugcaugcuucaaccagcacaugucuugugugcgauuuuugcaccguacuauucuccccgguagcaucgccaauuccauaugccaaaacauugagaucauuauccuggucacccugucacucgugaucuucauuuuucuaacaauagugaguaagaccuaugucuguuaccugcuuaugccuaucuucauuccaaucgcuuauauauacggguggauuuauaauaagagcugcaaaaagugcagauuguguggacugguuuaccaucccuuuacggaaugcggcacucacugugugugcggcgccagguacgagacaucugaucggaugaaacuacaucgcgcguccgggcucuguccuggauauaagaaccugagagcagccaggguaaugugcaaaucaaaggguccagcuagcgugcuuaguaucaugaccgccguccugaucuugacuuucgugacacccauuucugcaaugguuaucggcgaguccagcgaaguguacacccucggggaccugccugaugacauggucgagauggcugaacgggugaauauuuauuaccagauaaucauuaucaacuauucgaucacguggguauuuuuacugcucggacuuauuauagccuacuucuuccgcaaauaucagcaccgauuucugucuuucuacgcgauguacuguaaggagugcgacauguaucacgaaagagccggcuugaccuacuggggugauuuuacaaauaaguguaggcagugcacuugugggcaauucgaggacguuaccggacuaauggugcauaaaaaguccuauaacugcaucauuaaauacaaggcaaaauggauccgggauaugcugauuacauaucuccugaucaugcuuauaaaggacucacuguuguuugucggcgcuacuggcaccgauuucgccgcuugcaucgacgagaagacagugaccuggaaccguacugggccauuucucaaucugggacgcugugauaaaagucagaagaaaacggguuacacagacauugccgaucaguuaaagggccugggggcaaucagcguccuagacauuccgaugaucaaaaagaugcccgaugaaauauccggaucucucaagugcauugacgaccuggagacccaccaugaacaacuuacugccgaguaugcuuucuugaccagauacugugauuacuauacacaguacaccgacaacagcggcuauucacagacuguguggaggacauaccugcggagucacgauuuuggugcgugcguuguguauccuaaucagcauuucugucgaugcguaaaacacggggacaaguguaacuccgcaaaaugggauuuugccaaugaaaugaagacguucuacaccggccaaaaagcuaaguuuaacaaggaccucaaucuggcccuucuggucuugcacaaagcauuccgcggaacuggcacaagcuauaucgccgagucuauggcuagaaaggauaacaggucaaugacccauuucgcccucgagauuaaaaagaaauuuccaacaaaugcacuguuaacugcgcugaucgacuacauaaguuaccuacagagccccgcugaaauguccaccuucgagcucgaugaagacugggaggauuuuaaguauaaaccugaaccaacggagucuccccagcugcggucgcaccgcaccgaccaguacaacuucaagaaugccgauagcaacuccaaugugaagguuugcaaaaacauccaaaaggugucauguauuaguccgagaucuagggcaaaauuugagaauaucauugccugcggggaacaugcuaacccuagcgucuauacaaugcccaacguguccaucuaccagucaaauagcgagcguucucacuauuguauagccgacucccacugccuugaagaguacgagguaguggaaacugaguugcugaacgcacucaagaaaaguaagugcugggcucgggaaauggacgauauuguucugcauaagcaggucgacggauuacgaagcuguagaaugaaagauaccgguaauugcaacgugcaggagaaugacuggacaaucgugcugugugaaaacggcaauuauuacuacucugaggcccacagggauuaugacaaggaucaagacgucgggcauuucugccuuuccccacgcuguucaacuauccgguacccuauuaguaaaagacacaucaagaacugcgauuggcagauuagccauucgaccauagacaaaaucuccguucaggaguuggcggauauugaacaguauaagaaggccaucucucaaaaacuccagacgagccugucaauuuuuaaguacgugaaaacaaagaaucuaccccacaucaaaccagcuuauaaguacauaaccguggagggaguagaaacugucgagggcaucgaaaacgcauucauugagagugagauccccgcccuggcugguacagccauuggguuuaagaucaauuccagggaaggcaacuaucucauggacgugauaggauacguuaaaucuggcagcuacuccgcaaccuauacuaagcuguacauuaccgggccuacaaucggagugaauacgaaacacgaugagaaguguaccgguccaugcccggcgaucauugaccauaaagaaggcuggcuuacuuucgccaaggggcgcacaucaaccuggggaugugaggaauuuggcugcuuggcugucagcgacgguuguguguucgggaguugccaggauauaaucaaagacgagcuggccguucaccgaaagacaacugaggaacccaccacgguggaguuaugccucacauuuucugauaagaccuauuguacuaaccugaaugcaauuaccccuaucauuacagacaaauucgaaguacaauucaagacugucgaguccuacacccuuccacggaucauagcuaucaaaaaccaugagauuaaggugggccagaucaacgaucugggaguguauagcaaaggcugcgggaauguccagaagauuaacggaacaaauuacggcaacgguuugcccaaguuugacuaucucugucaccuggccgggcguaaagaaguuaucauaagaaagugcuucgauaaugacuaccaggcauguaaauuucuacaaucgccuccaucauacaggcuggaggaacaucagggaacggugaccguaauugauuauaagaaaauccucggcacuaucaagauggaggccauucugggugacgugaaguaccgcaacuaucagucuaauaucgaaauaaacgcuaaaggcacaugcgcgggguguauuaauugcuucgagaacauccacugugaguuuaccauucacacuacagucgaagccaguugccccaucgugaccgauuggguuuccuuccaugaccggauacuuauuacgccggacgagcacaaguacgcauugaaaguggucugucaggaaaagccuaaacugagcuuaaaguuuaagaucugcaauacuaacaucgaugcuucuaugaccgugguugacagcaaaccaauucucgagcuggcccccguggaucaaacaaccuauaucagagaaagggacgagcgaugcaagacuuggaugugucgcguccgggaugagggauuccagguaauucuugaaccuuuuaaaaaucuguucggcuccuacauagggaucuuuuauacaggaauuuuaugcaucgugugucuccugaucguuauuuacauaaucuugcccauuugcuucaagcugagagacaccuuaaggcagcucgaggaugccuacaaaaaggaagugaagauccguuga

SEQ ID NO: 10953 - RNA, 4332 nt, Artificial Sequence
  derived and/or modified CDS sequence (opt3) from INKV(SWAR83-161)__U88060.1__GP
auggaggugcugaaccucaucuggcuucugaccuugugcagcgccucccccgucuuccagagauguuuucaagacggcgcuauuguuaagcagaauccuucuaaagaagcagugacagagguaugcuuaaaggaugacgugucaaugauaaaaacugaagccaaguacaucaaaaacgcgacggggaccuucgcuaauaacauugccaugaggaaguggcuggucgcagauuggcacgacugucggccacagaagaguagcggaggucauaucaaugugauugagguuggcgaugaccuaucccuccacacagaaucuuauaucugcucggccgauugugugauaacugucgacaaagagaccgcucagauccgccugcaaacagauaacaccaaucauuuugagguggcagggacuacaguaaagucaggaugguucaaaagcaccacguacauuacucuugaccagaccugcgaacaccugaagguuaguuguggcccgaaauccauccaguuucaugccugcuucaaccagcacaugucuugugugcgauuuuugcaccguacaauucuccccgguagcaucgcuaauuccauaugccaaaacauugagaucauuauccuggucacucugucacucgccaucuucauauuuuuaaccauagugaguaagacauauguguguuaccugcuuaugccuaucuucauuccaaucgcguauauauacggguggauuuauaauaagagcugcaaaaagugcaaauuguguggacuggucuaccaucccuuuaccgaaugcggcacgcacuguguuugcggcgcaagauacgagacuucugauaggaugaagcuacaucgggccuccgggcucuguccuggauauaaaaaccugcgcgcugccagagugaugugcaagucaaaagguccagcaagcguacuuaguaucaugacagcuauccugauuuugaccuucgugacucccaucucugccauggucauuggcgaguccagcgaaguguacacacucgacgagcugccugaugacaugguucagauggcggaaagggugaauauauauuaccagaucauuaucaucaacuauucgauuaccugggccuuuuuacuguucgggcucguccuugcauacuucuuuaagaaguaucagcaccgguuccugucuuuuuacgcuauguacuguaaagagugcgacauguaucacgaacgcgccggauugacguacuggggcgauuucaccaauaagugucgacaaugcacauguggucaguuugaggacgugacugggcuaaugguacauaaaaaguccuauaacugcauaaucaaauacaaggcuaaguggauuagagauauccugauuaccuaucucaucauaaugcugaucaaagacucacuucuguucguuggagccacaggcacugauuuugcagccugcauugacgagaagaccgugacauggaacuguaccggcccauucuugaaucucgggaaaugcgauaagagucagaaaaagaucggauacgcugacauugcggaucaacugaaggguuuaggcgcaaucagcguccuggacauaccgaugauuaaaaggaugcccgaugaaaucuccgggucucuaaaguauauugacggacucgagacuuaccacgaacagcugacggccgaguacgcuuuucuuacacgguauugugacuacuauacccaguacacugauaacagcggcuauucacagaccguguggcguacauacuugcgcagucaugacuucggugccugcgucguguauccuaaucaacacuuuuguagaugcguuaaacauggggauaaguguaacuccgcaaaaugggacuucgccaaugaaaugaagaccuuuuacacuggccagaaggcuaaauucaacaaggaucugaaucucgcccugcuugugcugcacaaagcauucaggggaacaggcacgagcuacaucgcggagucuauggcucggaaggacaaccgaucaaugacccacuuugccuuggagauuaaaaagaaauucccaacuaaugcacuccugacagccuuaaucgauuauauuaguuaccugcagagccuagcugaaauguccaccuuugagcucgacgaagauugggaggacuucaaguauaagcccgaaccuacagaggccccacagcugcgcucucauagaacugaucaauacaacuuuaaaaaugcagacucgaacagcaauguaaaggucugcaaaaacauccagaagguguccuguauuucacccaggagucgggcuaaauucgagaauaucauagccugcggggaacacgcgaacccgucuguuuauaugaugccuaacgugagcauuuaccaguccaauucagagcgcagccauuauuguaucgccgauucucacugccuugaagaguacgaggucguggaauccgaguugcugaacgcucucaagaagaguaaaugcugggcaaaggaaauggacgacaucguacugcacaaacagagcgauggauuaagaucuuguaggaugaaggacaccgguaauugcaacgugcaagagaaugauuggacgauuguucugugugaaaacggcaauuacuauuacuccgaggcccaucgugacuaugauaaagaccaggaugucgggcacuuuugccuuucaccccgguguaguaccauccgauacccaauuaacaagagacauauaaggaauugcgacuggcagaucagccacucgacaauugauaagaucuccgugcaggaguuggcugacauugaacaauauaaaaaggccaucucucagaaacuccagacuagccugucaauauucaaguacgugaaaaccaagaaccuaccucauaucaagcccgcauauaaauacauuacagucgagggaaucgaaacuguugagggcauugaaaaugcguuuaucgagagugagauaccagcccuggcugguaccgccauuggguucaagaucaacucccgcgaaggcaauuaccucauggaugugaucggauaugugaaaucugcaagcuacuccgcuacguauacaaagcuguacaccacuggccccacaauugggguaaacaccaaacacgacgagaaguguacuggaccuugcccaccgauaaucgaucacaaagaagguuggcuuaccuuugccaaggagcggacaucaacguggggcugugaagaguucgggugcuuggcagucagcgacggauguguguuuggcaguugccaagacauuaucaaggaugagcuggccguuuauagaaaaaccacugaagaguuaacaaccguggaacucugccugacauucucugacaagacuuacuguaccaaucuuaacgcuauuacgcccaucauaacagauaaauucgagguccaguuuaagaccguggaguccuauacucugccuaggaucauugcgaucaaaaaccaugaaauuaagguuggucagaucaaugacuuggggguguacagcaagggcugcggaaacguacagaaaauaaauggcaccaacuacgggaauggagucccaaaguucgauuaucucugucaccuggccucgcgcaaagaggugauuauccgaaagugcuuugacaacgauuaccaagcauguaaauuccuacagucacccccuucuuaucggcuggaagaacaucagggcacagugacugucaucgacuacaagaagauucucgguaucauaaaaaugaaggcuauucugggggauguuaaauauaagaauuaccagaguaacaucgaaauuaaugccgagggaaccugcgccggcuguaucaacugcuuugagaauauacacugugaguucacaauucauacgaccguggaggcuuccugcccaaucguaacugacugugugagcuuucacgaucguauccuuauuacacccgacgaacacaaauaugcauugaaggucgugugccaagagaagccgaaacugucuuuaaaguucaaaaucugcaacaccaauauugacgccagcaugacuauaguugauuccaagccuauccucgaacuggcgccaguggaccagacaaccuacauuagagagaaagaugagagguguaagacguggaugugccgcguccgggacgaagguuuucaggugauccuugagcccuucaagaaccuguuuggcucauacaucgggauuuucuauacuggaauacuauguaucauuugccuccugaucguuauuuacaucauauugccuaucuguuucaaacugagagauaccuuaaggcagcaugaagacgcuuauaagaaagagaugaagauucgauga

SEQ ID NO: 10954 - RNA, 4332 nt, Artificial Sequence
  derived and/or modified CDS sequence (opt3) from INKV(Lovanger)__KU681435.1__GP
auggaggugcugaaccucaucuggcuucugaccuugugcagcgccucccccgucuuccagagauguuuucaagacggcgcuauuguuaagcagaauccuucuaaagaagcagugacagagguaugcuuaaaggaugacgugucaaugauaaaaacugaagccaaguacaucaaaaacgcgacggggaccuucgcuaauaacauugccaugaggaaguggcuggucgcagauuggcacgacugucggccacagaagaguagcggaggucauaucaaugugauugagguuggcgaugaccuaucccuccacacagaaucuuauaucugcucggccgauugugugauaacugucgacaaagagaccgcucagauccgccugcaaacagauaacaccaaucauuuugagguggcagggacuacaguaaagucaggaugguucaaaagcaccacguacauuacucuugaccagaccugcgaacaccugaagguuaguuguggcccgaaauccauccaguuucaugccugcuucaaccagcacaugucuugugugcgauuuuugcaccguacaauucuccccgguagcaucgcuaauuccauaugccaaaacauugagaucauuauccuggucacucugucacucgccaucuucauauuuuuaaccauagugaguaagacauauguguguuaccugcuuaugccuaucuucauuccaaucgcguauauauacggguggauuuauaauaagagcugcaaaaagugcaaauuguguggacuggucuaccaucccuuuaccgaaugcggcacgcacuguguuugcggcgcaagauacgagacuucugauaggaugaagcuacaucgggccuccgggcucuguccuggauauaaaucacugcgcgcugccagagugaugugcaagagcagggguccagcaaguguacuuucuaucaugacagcuauccugauuuugaccuucgugacucccaucuccgccauggucauuggcgagagcucggaaguguacacacucgacgagcugccugaugacaugguucagauggcggaacgggugaacauauauuaccagaucauuaucaucaauuauucuauuaccugggccuuuuuacuguucgggcucguccuugcauacuucuuuaaaaaguaucagcaccgcuuccuguccuuuuacgcuauguacuguaaggagugcgacauguaucacgaacgagccggauugacguacuggggcgauuucaccaacaaauguagacaaugcacauguggucaguuugaggacgugacugggcuaaugguacauaagaaaucauauaauugcauaaucaaguacaaagcuaaguggauuagggauauccugauuaccuaucucaucauaaugcugaucaaggacagucuucuguucguuggagccacaggcacugauuuugcagccugcauugacgagaaaaccgugacauggaacuguaccggcccauucuugaaccucgggcggugcgauaagagccagaaaaagaucggauacgcugacauugcggaucaacugaaagguuuaggcgcaaucuccguccuggacauaccgaugauuaagcguaugcccgaugaaaucucugggagccuaaaguauauugacggacucgagacuuaccacgaacagcugacggccgaguacgcuuuucuuacacgcuauugugacuacuauacccaguacacugauaauucaggcuauagucagaccguguggagaacauacuugaggucccaugacuucggugccugcgucguguauccuaaccaacacuuuugucggugcguuaaacauggggauaaguguaauagcgcaaaaugggacuucgccaacgaaaugaagaccuuuuacacuggccagaaagcuaaguucaauaaggaucugaaccucgcccugcuugugcugcacaaagcauuccgaggaacaggcacgucuuacaucgcggagucaauggcucgcaaggacaauagaaguaugacccacuuugccuuggagauuaaaaagaaauucccaacuaacgcacuccugacagccuuaaucgauuauauuagcuaccugcagucccuagcugaaaugucuaccuuugagcucgacgaagauugggaggacuucaaguauaaacccgaaccuacagaggccccacagcugaggucgcaucggacugaucaauacaauuuuaagaacgcagacagcaauuccaacguaaaggucugcaaaaauauccagaaggugucauguauuaguccccgcucuagagcuaaauucgagaacaucauagccugcggggaacacgcgaauccgagcguuuauaugaugccuaacguguccauuuaccagucaaacagcgagaggucucauuauuguaucgccgauucccacugccuugaagaguacgaggucguggaaagugaguugcugaaugcucucaagaaaagcaagugcugggcaaaggaaauggacgacaucguacugcacaaacaggccgauggauuacguucuugucggaugaaggacaccgguaacugcaaugugcaagagaacgauuggacgauuguucugugugaaaauggcaacuacuauuacuccgaggcucaucgagacuaugauaaagaccaggaugucgggcacuuuugccuuucacccagauguaguaccaucagguacccaauuaauaagcgccauauacggaacugcgacuggcagaucagccacucgacaauugauaaaaucuccgugcaggaguuggccgacauugaacaauauaagaaggcaaucucucagaaacuccagacuagccugucaauauucaaguacgugaaaaccaagaaucuaccucauaucaaacccgcguauaaguacauuacagucgagggaguugaaacuguggagggcaucgaaaacgccuuuauugagagugagaucccagcucuggccgguaccgcaauaggguucaagauuaauuccagagaaggcaacuaccucauggaugugaucggauauguaaaaucugcuagcuacuccgccacguauacaaagcuguacaccacuggccccacaaucggggucaauaccaaacacgacgagaaguguacuggaccuugcccaccgauuauagaucacaaagaagguuggcuuaccuuugcaaaggagaggacaucaacguggggcugugaagaguucgggugcuuggccgugagcgacggauguguuuuuggcaguugccaagacaucauuaaagaugagcugguggucuaucgcaagaccacugaagaguuaacaaccguggaacucugccugacauucucugacaagacuuacuguaccaaccuuaaugcuaucacgcccauuaucacagauaaauucgagguucaguuuaagaccguggaguccuauacucugccucgaauaaucgcgauuaaaaaccaugaaaucaagguaggucagauuaacgacuugggggucuacagcaaaggcugcggaaaugugcagaagaucaacggcaccaauuacgggaacggauggccaaaguucgauuaucucugucaccuggccucgcggaaagaggugauaauucguaagugcuuugacaaugauuacaaagcauguaaguuccuacaaucacccccuucuuauagacuggaagaacaucagggcacagucacuguuaucgacuacaaaaagauccucgguaccauuaagaugaaagcuauccugggggaugugaaguauaaaaacuaccagaguaauauagaaauuaacgccgagggaacaugcgccggcuguaucaauugcuuugagaacauucacugugaguucacgauccauaccacuguagaggcuuccugcccaauagugacagacugugucagcuuucacgauaggauucuuaucacccccgacgaacacaaguaugcauugaaagugguuugccaggagaagccgaagcugucuuuaaaauucaagaucugcaauacuaacauugacgccagcaugacaaucguggauuccaaaccuauucucgaacuggcgccagucgaccaaaccacguacauacgcgagaaggaugagcgguguaaaacuuggaugugcagagugagggacgaagguuuucagguuauccuugagcccuucaagaaucuguuuggcucauacauugggaucuucuauaccggaauccuauguauuauaugccuccugaucauuaucuacauuaucuugccuauauguuucaagcugcgagauacauuacgccagcaugaagacgcuuauaaaaaggagaugaaaauccgguga

SEQ ID NO: 10955 - RNA, 4332 nt, Artificial Sequence
  derived and/or modified CDS sequence (opt3) from INKV(Lovanger)__KX554936.1__GP
auggaggugcugaaccucaucuggcuucugaccuugugcagcgccucccccgucuuccagagauguuuucaagacggcgcuauuguuaagcagaauccuucuaaagaagcagugacagagguaugcuuaaaggaugacgugucaaugauaaaaacugaagccaaguacaucaaaaacgcgacggggaccuucgcuaauaacauugccaugaggaaguggcuggucgcagauuggcacgacugucggccacagaagaguagcggaggucauaucaaugugauugagguuggcgaugaccuaucccuccacacagaaucuuauaucugcucggccgauugugugauaacugucgacaaagagaccgcucagauccgccugcaaacagauaacaccaaucauuuugagguggcagggacuacaguaaagucaggaugguucaaaagcaccacguacauuacucuugaccagaccugcgaacaccugaagguuaguuguggcccgaaauccauccaguuucaugccugcuucaaccagcacaugucuugugugcgauuuuugcaccguacaauucuccccgguagcaucgcuaauuccauaugccaaaacauugagaucauuauccuggucacucugucacucgccaucuucauuuuucuuaccauagugaguaagacauauguguguuaccugcuuaugccuaucuucauuccaaucgcguauauauacggguggauuuauaauaagagcugcaaaaagugcaaauuguguggacuggucuaccaucccuuuaccgaaugcggcacgcacuguguuugcggcgcaagauacgagacuucugauaggaugaagcuacaucgggccuccgggcucuguccuggauauaaaucacugcgcgcugccagagugaugugcaagagcagggguccagcaaguguacuuucuaucaugacagcuauccugauuuugaccuucgugacucccaucuccgccauggucauuggcgagagcucggaaguguacacacucgacgagcugccugaugacaugguucagauggcggaacgggugaacauauauuaccagaucauuaucaucaauuaugggauuaccugggccuuuuuacuguucggacucguccuugcauacuucuuuaaaaaguaucagcaccgcuuccugucuuuuuacgcuauguacuguaaggagugcgacauguaucacgaacgagccggcuugacguacuggggugauuucaccaacaaauguagacaaugcacaugugggcaguuugaggacgugacuggacuaaugguacauaagaaauccuauaauugcauaaucaaguacaaagcuaaguggauuagggauauccugauuaccuaucucaucauaaugcugaucaaggacucacuucuguucguuggcgccacaggcacugauuuugcagccugcauugacgagaaaaccgugacauggaacuguaccgggccauucuugaaccucggacggugcgauaagagucagaaaaagaucgguuacgcugacauugcggaucaacugaaaggcuuaggggcaaucagcguccuggacauaccgaugauuaagcguauccccgaugaaauuuccggaucucuaaaguauaucgacggccucgagacuuaccacgaacagcugacggccgaguacgcuuuucuuacacgcuauugugacuacuauacccaguacacugauaauagcgguuauucacagaccguguggagaacauacuugaggagucaugacuucggggccugcgucguguauccuaaccaacacuuuugucggugcguuaaacauggcgauaaguguaauuccgcaaaaugggacuucgccaacgaaaugaagaccuuuuacacuggacagaaagcuaaguucaauaaggaucugaaccucgcccugcuugugcugcacaaagcauuccgaggcacagggacgagcuacauagcggagucuauggcucgcaaggacaauagaucaaugacccacuuugccuuggagaucaaaaagaaauucccaacuaacgcacuccugacagccuuaauugauuauaucaguuaccugcagagccuagcugaaauguccaccuuugagcucgacgaagauugggaggacuucaaguauaaacccgaaccuacagaggccccacagcugaggucucaucggacugaucaauacaaucuuaagaacgcagacucgaauagcaacguaaaggucugcaaaaauauucagaagguguccuguaucucaccccgcaguagagcuaaauuugagaacauaauugccugcggagaacacgcgaauccgucuguuuauaugaugccuaacgugagcaucuaccaguccaacucagagaggagccauuauuguaucgccgauucucacugcuuggaagaguacgaggucguggaauccgagcugcucaaugcucugaagaaaaguaagugcugggcaaaggaaauggacgacauuguauuacacaaacaggccgauggucugcguagcugucggaugaaggacaccggcaacugcaaugugcaagagaacgauuggacgaucguucuuugugaaaaugggaacuacuauuacucugaggcucaucgagacuaugauaaagaccaggaugucggacacuucugcuugucccccagauguucaaccauuagguacccaauaaauaagcgccauauccggaacugcgacuggcagauuagucacagcacaaucgauaaaauuucggugcaggagcucgccgacaucgaacaauauaagaaggcaauaucccagaaacugcagacuucucuaagcaucuuuaaguacgugaaaaccaagaaucugccucauauuaaacccgcguauaaguacaucacagucgagggcguugaaacuguggaggguauugaaaacgccuucaucgagucagagauaccagcucucgccgggaccgcaauuggcuuuaagaucaauaguagagaaggaaacuaccugauggaugugaucggcuauguaaaauccgcuucuuacagcgccacguauacaaaguuauacaccacugggcccacaauuggagucaauaccaaacacgacgagaaguguacugguccuugcccaccgauaaucgaucacaaagaaggcugguugaccuucgcaaaggagaggacauccacgugggggugugaagaguuuggaugccuggccgugucagacggcuguguuuucgguagcugccaagacauuaucaaagaugaguuagcuguguaucgcaagaccacugaagaacucacaaccgucgaacugugccuuacauuuagugacaagacuuacuguaccaaccugaaugcgauuacgcccaucauaacagauaaauucgaggugcaguucaagaccguugagucuuauacuuugccucgaaucauugccaucaaaaaccaugaaauuaagguggggcagaucaacgaccucggcguauacuccaaaggaugcggcaauguccagaagauaaacgggaccaauuacggaaacggccugccaaaguuugauuaucuaugucaccuggcaagccggaaagaggugauuauccguaagugcuucgacaaugauuaccaggcuuguaaauuucuccaaucgcccccuucauauagacuggaggagcaucaggguacagugacugucaucgacuacaagaaaauucuugggaccaucaagaugaaggccauauugggagauguuaaauauaagaacuaccagucuaauauugaaaucaacgccgagggcacaugcgcugguuguauuaauugcuucgagaacauccacugugaauuuacgauacauaccacuguggaggcaaguugcccaauuguaacagacuguguguccuuccacgauaggauccugaucacccccgacgaacacaaauaugccuuaaaggucgugugccaagagaaaccgaagcucagccugaaguuuaaaauuugcaauacuaacaucgacgcgucuaugacaauuguugauagcaagccuauacuugaacuggcuccaguggaccagaccacguacauccgcgagaaagaugagcgguguaagacuuggaugugcagagucagggacgaaggcuuccaggugauucuagagcccuuuaaaaaucucuucggguccuacaucggaaucuuuuauaccggcauucuguguauaaucugcuugcugauuguuaucuacauuaucuuaccuauauguuucaagcuccgagauacacugcgccagcaugaagacgccuauaagaaagagaugaagauccgguga

SEQ ID NO: 10956 - RNA, 4335 nt, Artificial Sequence
  derived and/or modified CDS sequence (opt3) from JSV__AF123487.1__GP
auggaggugcugaaccucaucuggcuucuggccuugugcagcgcuucccccgucuuccagagauguuuucaagacggcgcaauuguuaagcagaauccuucuaaagaagccgugaccgagguaugcuuaaaggaugacgugucaaugauaaaaacagaagcgaaguacgucaaaaacacuacggggaccuucgcuaauaacaucgccaugaggaaguggcugguggcagauuggcacgacugucggccacagaagaguagcggaggucauauuaauguuaucgaggugggcgaugaccuaucccuccacacagaaucuuauauuugcucggccgauugugucaucacuguggacaaagagaccgcucagauacgccugcaaacagauaacaccaaucauuuugagguagcagggacuacaguuaagucaggaugguucaaaagcaccacguacaucacucuugaccagaccugcgaacaccugaaggugaguuguggcccgaaauccauucaguuucaugccugcuucaaccagcacaugucuuguguccgauuuuugcaccguacaauccuccccgguagcauugcuaauuccaucugccaaaacauagagauuaucauucuggugacucugucacucgugaucuucaucuuuuuaaguauugucagcaagaccuauguuuguuaccugcuuaugccuauauucaucccaauugccuuuaucuauggguggauauacaauaagucuugcaaaaagugcaaauuguguggacugguguaucaucccuucacagaaugcggcacccacuguguaugcggcgcgagauacgagacguccgauaggaugaagcuacaucgggcaucagggcucuguccuggauacaaaagccugcgcgccgcuagagugaugugcaagaguaaagguccagccucuauucuuuccaucaugacugcaauccugauuuugacauuugucacccccaucagcgcuauggugauuggcgagucgucugaaguuuauacucucgacgaucugccugacgacauggugcagauggccgagagggucaacauauacuaucagaucauuaucaucaauuacggggugacaugggcguucuuacugcucggacuuauucuggccuauuucuuuaagaaguaccagcacaaauucuuggauuuuuaugcaauguacugugaagagugcgacauguaccacgaaaaguccggccuaacccauuggggugauuucacgaacaaaugucggcaaugcaccugugggcaguuugaggacguagcuggacugaugauacaccgcaagucauauaauugccucguuaaauacaaggcccgauggaucagagauauucugaucauguaucuugcuaugauucugaucaaggacagucucuuguucgugggcgccagcggcacagauuuugcagccugcauagacgagaaagucgugacuuggaacuguaccgggccauuccugaacuuaggaaggugcgauaagucccagaaaaagacaaauuacgaagguaucgcuaaccaacugaaaggccuaggggucauuucugugcucgacaucccgaugauuaagaauaugcccgaugagaucagcggaucacugaaguauauagacagucuugaaacuuaccaugagcaguugaccgcggaauaugcauuucugacacgguacugugacuacuauacccaguacacugauaacuccggcuauagccguacgguuuggcgcacauaccucagaucucacgacuucggugccugcgugguauauccuaaucaucaccuguguaggugcgucaaauacggggauaaguguaacucagcuaaaugggacuuugccaaugagaugaagaccuucuauacuggccagaaagugaaguuuaacaaggaucuuaaucuggcauugcucguucugcacaaagccuuccggggaaccggcacagcuuacguggccgaggcaauggcgcgaaaggacaacgggaguauggcucauuucgccuuagaaauucgcaaaaaguuuccaaccaaugcacugcuagccgcucucaucgauuacauugucuaucugcaaagccuugccgagaucgcaacuuucgaauuggacgaggauugggaagacuuuaaauacaagcccgagccuacagaguccacgccacaggcuagaucucacaggaacgaucaguauaauuucaaaaacgccgaaucgaauagcaacaccaaggugugcaagaacguacagaaagugcuguguauaucaccccgguccaaggcgaaauuugagaauaucauugccugcggagaacaugcuaacccgaguguuuacaugaugccuaaugucucuaucuaucaaagcaacuccgagcgcucacacuacuguauugcagacagccacugccucgagaaguaugaagugguggagacugaacuguuaaaugcccugaaaaagucuaagugcugggcuaaagagauggaugacaucguccuucauaagcaguccgacgguuugagaaguuguaggauaaaagauacaggcaacugcaauguucaggaaaacgacuggaccauugugcucugugagaaugggaacuacuacuauagcgaggugcacaaggauuacgacaaagaucaggacguaggacauuucugccugucuccccguuguacaacuauccgguauccaaucucccgaagacacauuaggaagugcgaauggcaaaucucacauaguaccauugauaagauaagcguccaggagcuagccgacaucgaacaguacaaaaaggcaauuucgcagaaacugcaaacgucccucucuaucuuuaaguaugugcgcaccaaaaaucugccucacauuaagcccgcguacaaguauaucacaguugagggcguggaaacuauagaggguaucgagaacgccuucauugaaagcgagaucccagcucuugccgggaccgcaauuggcuuuaaaaucaauucacgggaaggaaacuacuugauggaugucauaggcuacgugaagagugcuuccuauucugccguuuacacaaaacuguauacuaccgggcccacgauuggaaucaauacaaagcacgacgagaaauguaccgguccuugcccagcagugaucgaucauaaggacggcugguuaacuuucagcaaagaaagaacauccaccugggggugugaggaguuuggaugccucgccguaucagauggcugugucuucgguagcugccaggacauuauaaaggacgaacuggcuguguacaggaagacuaccgaggaacuuacaacgguggagcugugcuugaccuuuagugauaaaacuuauuguacaaaccucaacgcgaucaccccgauuaucacagacaaguucgagguccaguucaaaacuguugaaucuuacacccugccccgcgugauugccaucaagaaucacgagauaaaaguagggcaaaucaacgaucuaggcguguauuccaagggaugcggcaauguccagaaggugaacgggacgaauuacggaaacggcagcccucgauuugacuaccugugucaucucgcaucgcggaaagaaguuauucugcguaagugcuucgauaaugacuaucaggcuuguaaauuucuucagucaccaucuaguuacagauuggaggaacaccaagguacagugaccgucaucgauuauaagaaaauucuggggacuaucaagaugaaggccauauuaggagacgugauuuacaucaacuaucagaauaacaucgagauuaaugccgaggguaccugcgcuggcuguaucgauugcuucgaaaacauacauugugaguuuacaauucacacuaccguugaagcauccugccccaucacaacggagugugugagcuuccacgacaggauucucaucaccccugaugaacauaaauacgcccugaagauagucugccacgacaaaccaaagguaucucuuaaauuuaagauuugcaauacuaacguggacgcggcuaugacaaucguugauagcaagcccauccuggagcuagccccgguggaccagaccacuuauauucgcgagaaagaugaacgguguaagacauggaugugcagagucagggacgagggcuuccaggugauccucgaaccuuuuaaaaaucuguucggguccuacauuggaauauuuuacaccggcaucuugucaauuaucugucuguuaaucguaguguauauuauacucccaaucugcuucaagcugcgagauacgcuucgccaacaugaggacgcauaccggaaagaaaugaagauuagauga

SEQ ID NO: 10957 - RNA, 4335 nt, Artificial Sequence
  derived and/or modified CDS sequence (opt3) from JSV(BFS 4474)__KX817319.1__GP
auggaggugcugaaccucaucuggcuucuggccuugugcagcgcuucccccgucuuccagagauguuuucaagacggcgcaauuguuaagcagaauccuucuaaagaagccgugaccgagguaugcuuaaaggaugacgugucaaugauaaaaacagaagcgaaguacgucaaaaacacuacggggaccuucgcuaauaacaucgccaugaggaaguggcugguggcagauuggcacgacugucggccacagaagaguagcggaggucauauuaauguuaucgaggugggcgaugaccuaucccuccacacagaaucuuauauuugcucggccgauugugucaucacuguggacaaagagaccgcucagauacgccugcaaacagauaacaccaaucauuuugagguagcagggacuacaguuaagucaggaugguucaaaagcaccacguacaucacucuugaccagaccugcgaacaccugaaggugaguuguggcccgaaauccauucaguuucaugccugcuucaaccagcacaugucuuguguccgauuuuugcaccguacaauccuccccgguagcauugcuaauuccaucugccaaaacauagagauuaucauucuggugacucugucacucgugaucuucaucuuuuuaaguauugucagcaagaccuauguuuguuaccugcuuaugccuauauucaucccaauugccuuuaucuauggguggauauacaauaagucuugcaaaaagugcaaauuguguggacugguguaucaucccuucacagaaugcggcacccacuguguaugcggcgcgagauacgagacguccgauaggaugaagcuacaucgggcaucagggcucuguccuggauacaaaagccugcgcgccgcuagagugaugugcaagaguaaagguccagccucuauucuuuccaucaugacugcaauccugauuuugacauuugucacccccaucagcgcuauggugauuggcgagucgucugaaguuuauacucucgacgaucugccugacgacauggugcagauggccgagagggucaacauauacuaucagaucauuaucaucaauuacggggugacaugggcguucuuacugcucggacuuauucuggccuauuucuuuaagaaguaccagcacaaauucuuggauuuuuaugcaauguacugugaagagugcgacauguaccacgaaaaguccggccuaacccauuggggugauuucacgaacaaaugucggcaaugcaccugugggcaguuugaggacguagcuggacugaugauacaccgcaagucauauaauugccucguuaaauacaaggcccgauggaucagagauauucugaucauguaucuugcuaugauucugaucaaggacagucucuuguucgugggcgccagcggcacagauuuugcagccugcauagacgagaaagucgugacuuggaacuguaccgggccauuccugaacuuaggaaggugcgauaagucccagaaaaagacaaauuacgaagguaucgcuaaccaacugaaaggccuaggggucauuucugugcucgacaucccgaugauuaagaauaugcccgaugagaucagcggaucacugaaguauauagacagucuugaaacuuaccaugagcaguugaccgcggaauaugcauuucugacacgguacugugacuacuauacccaguacacugauaacuccggcuauagcaaaacgguuuggcguacauaccuccgcucucacgacuucggugccugcgugguauauccuaaucagcauuuuuguagaugcgucaaguacggggauaaauguaacucagcuaagugggacuucgccaaugagaugaaaaccuuuuauacuggccaaaaggugaaguucaacaaagaucugaaucuugcacuguugguucuccacaaggccuucaggggaaccggcacagcuuacguggccgaggcaauggcgcggaaagacaacgggaguauggcucacuuugcccuggaaauucgaaagaaauucccaaccaaugcauuacuggccgcucuaaucgauuacauugucuaucuccagagccuggccgagaucgcaacuuuugaacuugacgaggauugggaagacuucaaguacaaacccgagccuacagaguccacgccacaggcucgcucucauagaaacgaucaguauaauuuuaagaacgccgaaucgaauagcaacaccaaggugugcaaaaacguacaaaagguguuguguauaucccccaggucaaaagcgaaguucgagaauaucauugccugcggagaacacgcuaacccgaguguuuacaugaugccuaaugucucuaucuaucagagcaacuccgagcggucacauuacuguauugcagacagccacugccuggagaaauaugaagugguggagacugaacuccugaaugccuuaaagaagucuaaaugcugggcuaaggagauggaugacaucguccugcacaaacaguccgacggucuucgcaguuguagaauaaaggauacaggcaacugcaauguucaggaaaacgacuggaccauuguguugugugagaaugggaacuacuacuauagcgaggugcauaaagauuacgacaaggaucaagacguaggacacuuuugccucucucccagguguacaacuauccguuauccaaucucccggcgacauauuagaaagugcgaauggcagaucucacacaguaccauugauaaaauaagcguccaggagcuggccgacaucgaacaguacaagaaagcaauuucgcaaaagcuacagacgucccugucuaucuucaaauaugugaggaccaagaaucucccucauauuaagcccgcguacaaauauaucacaguugagggcguggaaacuauagaggguaucgagaacgccuuuauugaaagcgagaucccagcucuggccgggaccgcaauuggcuucaagaucaauucacgcgaaggaaacuaccuuauggaugucauaggcuacgugaaaagugcuuccuauucugccguuuacacaaaguuguauacuaccgggcccacgauuggaaucaauacaaaacacgacgagaaguguaccgguccuugcccagcagugaucgaucacaaagacggcuggcugacuuuuagcaaggaacggacauccaccugggggugugaggaguucggaugcuuagccguaucagauggcugugucuuugguagcugccaggacauuauaaaggacgaacucgcuguguacagaaaaacuaccgaggaacugacaacgguggagcuuugccugaccuucagugauaagacuuauuguacaaacuugaacgcgaucaccccgauuaucacagacaaauucgagguccaauuuaagacuguugaaucuuacacccuccccagggugauugccaucaaaaaucaugagauaaagguagggcagaucaacgaucugggcguguauuccaagggaugcggcaauguccagaaagugaacgggacgaauuacggaaacggcagcccucgcuucgacuaccuaugucaccuggcaucgcgaaaggaaguuauucuccggaaaugcuuugauaaugacuaucaggcuuguaaguuccugcaaucaccaucuaguuaccgucuugaggaacaucaggguacagugaccgucaucgauuauaaaaagauuuuggggacuaucaagaugaaagccauacugggagacgugaaguacaaaaacuaucagaauaacauugagaucaaugccgaggguaccugcgcuggcuguaucgauugcuuugaaaacauucacugugaguucacaauccauacuaccguugaagcauccugccccauaacaacggagugugugagcuuucacgacagaauuuuaaucaccccugaugaacacaaguacgcccucaaaauugucugccaugacaagccaaagguaucucugaaauucaagaucugcaauacuaacguggacgcggcuaugacaauaguugauagcaaacccauucuugagcuggccccgguggaccagaccacuuauaucagggagaaggaugaacgcuguaaaacauggaugugccgggucagagacgagggcuuucaagugauccuagaaccuuucaagaaucucuuuggguccuacauuggaaucuucuacaccggcauucugucaauaaucuguuugcugauuguaguguauaucaucuuaccaauuugcuucaagcucagggauacgcugcgacagcacgaggacgcauaccgcaaagaaaugaagauacgguga

SEQ ID NO: 10958 - RNA, 4323 nt, Artificial Sequence
  derived and/or modified CDS sequence (opt3) from LUMV__AF123484.1__GP
augauccugguguuauucuuugucgcccuuagcgcugcaggccccguuuaccagagaugcuuccaagacggggccauugugaagcaguccccuucuaaacaggcgguaaccgaggugugucugaaggaugacgucucaaugauaaaaacagaagcuagguauuuuaagaacacuacgggaaucuacgccaauaacguggcaauucggaaaugguugguugccgauuggcacgacugccgcccaaagaaggugagugguggccauaucaaugucauugaggugggggaugacuuaacccugcacacagaggcuuauguauguaacgcagauugcaucauaggaguugacaaagaaacugcccaggugcgacuacaaaccgauacaaccaaucauuucgaaaucgcuggcacuacagucaagagcgguugguuuaaauccaccacguacauuacucucgggcagaccugugagcaccugaaggugucuugcggaccgaaaucgauccaguuccaugccuguuuuaaccagcacaugucaugcgugcguuuccuucacagaacaauucugcccggcagcaucgcgaauagugucugucaaaacauagagauuaucauuuugacuguucucacccugcugaucuuuacacucuuauccauccugucuaagaccuauauuugcuacauacuuaugccuaucuucauuccauuggcauauaucuacggccugauauacaauaagagcuguaaaaagugcaaacuaugcgggcucguguaucaucccuuuacggaauguggaacucacugcguauguggugccagguacgacacauccgaucggaugaagcugcaucgcgcuucaggccuuugcccuggguauaaaagucugagagccgcaagggugauguguaagagcaaaggaccagcuucugucuuguccauuaucaccgccgugcucauccugacuuucauuacacccaucaacgcgaugauugccggcgagacccaggaaacguuuaaguuagaggaccugccugaugacaugcucucaauggcaaugaagauaaauauguacuauaucaugugcaugcuuaacuacguugcuaccuggagcuucauuuucugugcccugaucaucgcuuugauuuuuaaaaaguaucagcacaaauuccuaaguuacuacgccauguauugccaggagugugacauguaccacgaucggucuggucugaaguauaaugggggauuuacaaacaaaugccgccaauguacuugcggccaguacgaagacgcaaccggccucauggcccaucgaaagacauauaauugccugauacaguacaaguccaaauggcuugugaacuuccugaucacuuauauuaucuugaugcucauuaaggauagcguccugaucgugcacgcugaggggaccgacuuugaaaaauguucgucugauauaaacaucguauggaauugcacaggaccauucuuaucccuggguaacugugagaagaaacaaaagaaggaaucauacaaugacauugcggcacagcuaaaaggccucgaugccaucaguguucuggacauuccgaugaucagcaagauacccgaggauauugcuggggcccuuagauuuaucgaggaacagaacuccuaccaugugcaguugaccgucgaguaugcaaugcugacuagguacugcgacuauuacacgcaauucucugauaauagcggauauucacagacaaccuggcggacuuaccuccguagucacgacuuugaagccuguauucuguauccuaaccagcauuucugccgcugugugaaacacggcgacaagugcuccagaagcaauugggauuuugcuaacgagaugaaaaauuacuacucugguaagcagucaaaguauaacaaagaccuuaaucuggccuugaugaguuuccaccaugcauuuagggggaccagcuccuucuacacagcgaagcuccugcgggaaaagaaaaccgaggagcucaaaaacuauaucgauaagauacgaacugaauacccaggcaaugcucugcuaaaagccgucaucgacuauauuaaguacaugaugggacucacagaggugucuaacuucaagcacgaugaaaugugggacgauuuuaucuucgagaaucccucgacgcgcagcucccugucaagaaacagugaaucuagcuaugacuuuaaaaccaacauuaauuccgauccuacuaacacauguaagaauaucaaagcaguuaccugccuuucaccaaagagcggcgugucuuucgacuccguaauagccuguggggagaguaaccaacccagcauuuaccagaaaccgaggaagcaggucuaccagucuaauuccgagcaaacacauuuuugcuugcuggauacucacugccucgaaggauaugagaccgugggugaagagguucugucagcuaucaagaaaaguaaguguugggagacggacuucaccgaauacauccaguuuaaacagagcgauggcgugcggucgugccgcaugaaggacuccggggaguguacagucacuaccaacaaauggccuauuaucuuaugcgaaaauaacagauauuacuauucugagcugcacaaggacuacgauaaggaccaggauauuggacauuucugucuuagccccaggugcaauacaauacguuauccaaucaaccaaaaucacauuucaaacuguacuuggcaagugcggcauaauaacaucgacaaaauugaaguacacgaguuggaggaucucgaacaguaccgaaaggccaucacccagaaacugcagacgagucuaacacuguuuaaguacuccagaaccaaaaaucucccucauauaaagcccaucuauaaguacauuacuaucgagggcacagaaaccgcagaggguauugaaucugcuuauaucgagagcgagauaccagcccuggcggggacuuccauuggcuucaaaaucaccucaaagagcggaaaacaccuuuuggacgugaucaguuacguuaagucugccuccuauagcgcugucuacacaaaacuguauacgaccggccccacuauuggggugaacacaaagcacgaugaauuaugcaccggaucguguccugugaacgucccacauaauacagguuggcucacuuuugcaagggagcgcaccucaucuuggggcugcgaagaguucgggugucuggccauaagugacggaugcguuuuuggcuccugccaggauaucauuaaagacgaacuuacgguguaccgggaggagacagaagagaccacuaacguggaacuguguuugaccuucgcugauaagacauacugcacuaaucucaacgccaucaccccgauuaucacagaccaguucgagguacaauuuaagacggucgaggcauauagccugcccagaauaaucgcggugaggaaucacgaaauuaugguuggucagaucaacgauauugggguguacucuaaaggcuguggaaauguccagaagaucaacaauaccaacuauggcaauggggugccuaaauucgacuaccuaugccaucuggccagccgcaaggagguuauaauucgaaaauguuuugacaacgauuaucaggcuugcaaguuccuccaaacuccagccuccuaccggcuggaagaggaaggaggcucagugacaguaaucgacuauaagaaaauccuugguaccauuaagaugaaagcaaucuugggggaugucaaguacaaaacuuuugcugacaauguggauauaacaguggagggagccuguaccggcugcauuaacuguuucgacaauauccacugcgagcugacgauucauaguacugucgaagcaagcugucccaucaccucuuccugcacaguuuuucacgaucguauauuaauuaccccuaacgagcacaaguacgccaucaaggugaucugcaacgguaaaccaggcauuucacuccccuucaagaucuguaauacuaaaguagacgcugcgaugacacugaccgaugccaagcagauucuugaacuggcaccgguggaccagacaacuuauauaaaagagaaggaugaaagaugcaagaccuggauguguaggguccgcgacgaggggcuacaggugaucuuugagccuuucaaaaaccucuuuggaaguuacauuggcaucuucuauacguucguuaucuuucugguggucauuuucauagugaucuacauuguuuugccaaucugcuuuaagcugcgggacacauuaagacaacaugaagaugcuuauaaaagggagaugaagauucgauga

SEQ ID NO: 10959 - RNA, 4323 nt, Artificial Sequence
  derived and/or modified CDS sequence (opt3) from LUMV(SAAr 1881)__KX817325.1__GP
augauccugguguuauucuuugucgcccuuagcgcugcaggccccguuuaccagagaugcuuccaagacggggccauugugaagcaguccccuucuaaacaggcgguaaccgaggugugucugaaggaugacgucucaaugauaaaaacagaagcuagguauuuuaagaacacuacgggaaucuacgccaauaacguggcaauucggaaaugguugguugccgauuggcacgacugccgcccaaagaaggugagugguggccauaucaaugucauugaggugggggaugacuuaacccugcacacagaggcuuauguauguaacgcagauugcaucauaggaguugacaaagaaacugcccaggugcgacuacaaaccgauacaaccaaucauuucgaaaucgcuggcacuacagucaagagcgguugguuuaaauccaccacguacauuacucucgaccagaccugugagcaccugaaggugucuugcgggccgaaaucgauccaguuccaugccuguuuuaaccagcacaugucaugcgugcguuuccuucacagaacaauucugcccggaagcaucgcgaauagugucugucaaaacauagagauuaucauuuugacuguucucacccugcugaucuuuacacucuuauccauccugucuaagaccuauauuugcuacauacuuaugccuaucuucauuccauuggcauauaucuacggccugauauacaauaagagcuguaaaaagugcaaacuaugcggccucguguaucaucccuuuacggaaugugggacucacugcguauguggagccagguacgauacauccgaccggaugaagcugcaucgcgcuucaggucuuugcccuggcuauaaaagucugagagccgcaagggugauguguaagagcaaagggccagcuucugucuuguccauuaucaccgccgugcucauccugacuuucauuacacccaucaacgcgaugauugccggagagacccaggaaacguuuaaguuagaggaucugccugacgacaugcucucaauggcaaugaagauaaauauguacuauaucaugugcaugcuuaacuacguugcuaccuggagcuucauuuucugugcccugaucaucgcuuugauuuuuaaaaaguaucagcacaaauuccuaaguuacuacgccauguauugccaggagugugauauguaccacgaccggucuggccugaaguauaaugguggguuuacaaacaaaugccgccaauguacuugcggacaguacgaagaugcaaccggccucauggcccaucgaaagacauauaauugccugauacaguacaaguccaaauggcuugugaacuuccugaucacuuauauuaucuugaugcucauuaaggacagcguccugaucgugcacgcugagggcaccgauuuugaaaaauguucgucugacauaaacaucguauggaauugcacagggccauucuuaucccugggaaacugugagaagaaacaaaagaaggaaucauacaaugauauugcggcacagcuaaaaggucucgacgccaucaguguucuggauauuccgaugaucagcaagauacccgaggacauugcuggcgcccuuagauuuaucgaggaacagaacuccuaccaugugcaguugaccgucgaguaugcaaugcugacuagguacugcgauuauuacacgcaauucucugacaauagcggguauucacagacaaccuggcggacuuaccuccguagucacgacuuugaagccuguauucuguauccuaaccagcauuucugccgcugugugaaacacggagauaagugcuccagaagcaauugggacuuugcuaacgagaugaaaaauuacuacucuggcaagcagucaaaguauaacaaagaucuuaaucuggccuugaugaguuuccaccaugcauuuagggguaccagcuccuucuacacagcgaagcuccugcgggaaaagaaaaccgaggagcucaaaaacuauaucgacaagauacgaacuaaauacccagggaaugcucugcuaaaggccgucaucgauuauauuaaguacaugaugggccucacagaagugucuaacuucaaacacgacgagaugugggaugacuuuaucuucgaaaaucccucgacgcgcagcucccugucaagaaacagugagucuagcuaugauuuuaagaccaacauuaauuccgacccuacuaacacauguaaaaauaucaaggcaguuaccugccuuucaccaaaaagcggagugucuuucgauuccguaauagccuguggcgaaaguaaccaacccagcauuuaccagaagccgaggaagcaggucuaccagucuaauuccgagcaaacacauuuuugcuugcuggacacucacugccucgagggguaugaaaccgugggagaggaaguucugucagcuaucaaaaagaguaaauguugggagacggauuucaccgaguacauccaguuuaagcagagcgacggugugcggucgugccgcaugaaagacuccggcgaauguacagucacuaccaacaaguggccuauuaucuuaugcgagaauaacagauauuacuauucugaacugcacaaggauuacgacaaagaucaggacauugggcauuucugucuuagccccaggugcaauacaauacguuauccaaucaaccaaaaucacauuucaaacuguacuuggcaagugcggcauaauaacaucgauaagauugagguacacgaauuggaggaccucgagcaguaccgaaaagccaucacccagaagcugcagacgagucuaacacuguuuaaauacuccagaaccaagaaucucccucauauaaagcccaucuauaaauacauuacuaucgaaggaacagagaccgcagaaggcauugagucugcuuauaucgaaagcgagauaccagcccuggcggguacuuccauuggguucaagaucaccucaaaaagcggcaagcaccuuuuggaugugaucaguuacguuaaaucugccuccuauagcgcugucuacacaaagcuguauacgaccggacccacuauuggcgugaacacaaaacacgacgaguuaugcaccgggucguguccugugaacgucccacauaauacaggauggcucacuuuugcaagggaacgcaccucaucuugggguugcgaggaguucggcugucuggccauaagugaugggugcguuuuuggauccugccaggacaucauuaaggaugaacuuacgguguaccggaaggaaacagaggagaccacuaacguggaacuguguuugaccuucgcugacaaaacauacugcacuaaucucaacgccaucaccccgauuaucacagaucaguucgagguacaauuuaagacggucgaagcauauagccugcccagaauaaucgcggugaggaaucacgagauuaugguuggccagaucaacgacauugguguguacucuaaaggguguggcaauguccagaagaucaacaauaccaacuauggaaauggcgugccuaaauucgacuaccuaugccaucuggccagccgcaaggagguuauaauucgaaaguguuuugauaacgacuaucaggcuugcaaauuccuccaaacuccagccuccuaccggcuggaagaggaagggggaucagugacaguaaucgauuauaagaaaauccuuggcaccauuaagaugaaagcaaucuugggugacgucaaguacaagacuuuugcugauaauguggacauaacaguggagggggccuguaccggaugcauuaacuguuucgauaauauccacugcgaacugacgauucauaguacugucgaggcaagcugucccaucaccucuuccugcacaguuuuucacgaccguauauuaauuaccccuaacgagcacaaauacgccaucaaggugaucugcaacggcaaaccagguauuucacuccccuucaagaucuguaauacuaaaguagaugcugcgaugacacugaccgacgccaagcagauucuugaacuggcaccgguggaucagacaacuuauauaaaggagaaagacgaaagaugcaagaccuggauguguaggguccgcgacgagggccuacaggugaucuuugaaccuuucaaaaaccucuuugggaguuacauuggaaucuucuauacguucguuaucuuucugguggucauuuucauagugaucuacauuguuuugccaaucugcuuuaagcugcgggauacauuaagacaacaugaggacgcuuauaaaagggagaugaagauucgauga

SEQ ID NO: 10960 - RNA, 4329 nt, Artificial Sequence
  derived and/or modified CDS sequence (opt3) from MELV__U88057.1__GP
augaucgcccugauuuuccucauagcuaucgcagccgcgagccccguguaccagagaugcuuucaagacggcgggauugucaagcagaacccuuccaaagaugcuguuaccgaggugugucuuaaggacgauguaucuaugaucaaaacagaagccaaguauaugaaaaaugacacuggaacguucucaaacaauguggcaaugaggaaguggcuggucgccgauuggcacgacugccggccacagaagaguagcgguggccauauuaacgugaucgagguuggggaugacuuguccuuacacaccgaggcuuacauauguucugcagauugcaugaucucgguggacaaagagacagcccagauucgccugcaaacugauucaaccacacauuuugaaaucgcuggaaccacugucaagagcggcugguucaaaaguacaaccuauauuacgcuagaccagacuugugagcaccucaagguguccugcgguccgaaaucuauccaguuucaugccuguuucaaucagcacaugagcugcguacgauuucugcaccguaccauacuucccggguccauugcgaacucaaucugucaaaauauugagaucaucauucugguuacauugacucuccugauauucaucuuucugaguauucucagcaagaccuacaucugcuauauauuaaugccuauguucauuccaguggcauacaucuauggauggaucuacaacaagucuuguaaaaagugcaaacugugcggccuugucuaccaucccuuuacagaauguggcacccacugcguguguggggccagauaugagacguccgauaggaugaaguugcaucggucaagcggacugugcccugguuacaaaagucuacgcgcugccagagugauguguaagucuaaaggcccagcauccauucucagcguccugacugcuguucuuauccugacauucgugacccccaugaaugccuugacucucgggucgucugaagagaacuauaagcuggagaauuuaccugacgacaugcuggauauggcggaaaggauugacauauacuaucucuccaucauucuuaacuacucaaucacauggggacugguaaucuugcuaggccugaccuuuauucucuuccggcgcuuccagcaccgauuucugaauugcuaugccauguacuguagugagugcgauauguaccacgacaagaacggucuugugagaaauggggauuucacgaacaaauguaggcagugcaccuguggacaguaugaagacgcagcuggccugauaauccaucaaaagagcuacaacugcuugauuaaauauaaggccaaauggauccggaauauucuccugacauacaucauauuaauccugauuaaggauuccguccuacucacuucugcugagggcccagacuuuagcgugugcaucgaacagaaggccauuucauggaacuguaccgggccguuccugaaucuuggacguugcgagaaaacacagaagaaagcaaguuaugccacuaucgcuacccaauugcgcuccauagaugcgauuagcguucuggacauccccaugauugcaaagaucccugaggauauaucuggugcccucaaauacaucgaaucacugaagacauaucacgagcagcuuaccgcugaauacgccaugcugacuagauacugugacuauuacacgcaguuuagugacaacagcggcuauucccagacaucuuggaggaaguucuugcggucgcaugauuuugagagcugcauuaucuacccaaaucaacacuucugucgaugcgugaaacaggacgaaaaguguuccucagcaaaaugggauuuugccagugagaugaagggguucuaucucaacaaacaggcuaaguuuaauaaggaccugaacuuagcccugucuaccuuccauaaagcauuucgcggaacucccauuagcuacgucaccgagcuaaucuccaagaauaaaaacucaagccuccugauguaugugucugaaauaaagagaaaauucccuggcaaugcgcuuuugguagcucugcucgauuucauuauguaccugcaguccuuaagugagaucagcgguuuugaacugggggacgagugggaagauuucaaguacgacccagagcccacagagccggcccuuaugccuaggucucaccgguccgaucaauauaacuuuaaaaaugcagccucaguuaguaagaccaagacuugcgaaaacaucaaacgcguguugugucucagccccagaucgagggcuacauucgacgaugucguggccugcggcgaguuugcaaauccauccgucuacaugcugccuaacauuacgaucuaucagucuaacauugaacguagccacuacuguauagcugacucacauugccuagaggaguucgaacuggugaagcccgagcuccugaccgcccuuaaaaagaguacuugcugggcgggagaaaucgaugacauuguuuugcacaaacaguccgacggccugcggucuugucgaaucaaggauacagggaccugcgacguguuaggaaaugaguggacaauuguacucugugaaaacaauaacuuuuauuacagcgagguccauagagauuaugacaaggaucaggacaucggucacuucugccuguccccaagguguaauauaauccgcuaccccauuaacccucggcacaucagaacuugcaaauggcaaauuucacauagcaccaucgauaagauaacggugcacgagcuugccgacauugaacaguacaaaaaggcuaucacccagaaacugcagaauaguuugucuaucuuuaaguauaagaggacuaaaaaccucccacauauuaagccgauauacaaauauaucgcaauugagggcacagaaaccguugaggggaucgaaaaugccuacauugaguccgagauccccgcucuggccggaacagcaauaggcuucaagaucaacagcaaagaugguaaucaccuaauggacgugauuggguaugucaagucggcgucauacucuaguacuuauaccaagcuguacacgacaggcccuaccaucggaauuaacacuaaacaugaugaaaaguguacaggcuccugcccaacccaagugaaacacaagacuggguggcucaccuuugccaaagagcgcacaagcacguggggaugugaagaguucgguugccuggcuaucucugacggcuguguauuugggagcugccaggauauaauuaaggacgaacuuaccguguaccgaaaaacuacagacgagguuaccgaguuggaacugugcuuaacauucgccgauaagacuuauuguaccaaucucaacgcagucacgcccaucaucacagacaaguucgaggugcaguuuaaaaccguggaauccuacucacugccucggauuaucgcugucaagaaucacgagauaaaaguuggacaaauuaacgauaucggcguguauaguaaggguugcgggaacgugcagaaaguaaauggcacuagcuacggaaacggcgucccaaaguucgacuaucuuugucaucuggccucucguaaggaggugaccauuagaaaaugcuuugauaaugacuaccaggcauguaaguuccuacagacacccuccucauauaggcucgaagaacaccaagggacuguuaccaucauagauuacaaaaagauucugggaaguaucaaaaugaaggccaucuugggcgacgugaaguacaaaaacuaugcuagcaauauugauaucaacgcggaagguuccugcgccggguguauuaauugcuuugagaacauacauugugaguucacaauccacucuacggucgaaaccucgugccagauugagagcgacuguacuucauuucaugaucgcgugcugaucacaccgaaugaacacaaguacgcauuaaaacucaucugccacgacaagccugcuuccagucugaaauucaagauuugcaacaccaagguugaggccgccaugacucuuguggacgcucggccaauaaucgaacuggcacccguagaucagacagccuauauuagagagaaagacgaaagguguaagaccuggaugugccgaguccgcgaugagggaauccaggugauuuuugagccuuucaaaaauuuguuuggcucuuacaucgguauauucuaugcgaucgugauuuguaucauuguccucuuccugaucguuuacauagugcuacccauuugcuuuaagcugaaagacacgcuuaagcaacaugaagaugcuuauaagcgggagaugaaaaucagauga

SEQ ID NO: 10961 - RNA, 4326 nt, Artificial Sequence
  derived and/or modified CDS sequence (opt3) from SAV__AF123486.1__GP
augaucccccuccucuuccuugugacccuggucagcgccggcccuguuuuucagagaugcuuccaagacggggcuauugugaagcagaacccauccaaagaggcaguaacagaaguguguauaaaggaugacgucucuaugaucaaaacugaggccagguacgugcgcaauucaaguggaguuuuuagcaacaauguggcguugaggaagugguuagucuccgauuggcacgacugcaaaccgaagaaggugucugguggccauauuaacguaaucgaaguugggaaugaucugacgcuacacaccgagucguauguguguucagcugacugcacaauuggaaucgauaaagaaacugcccagauacgacuccagaccgacacaaccaaccauuucgaggucgcaggcacuacaguuaagagcgguugguuuaaaaguaccacguacaucacucuggaucaaaccugugagcaccuuaagguguccugcgggcccaaaucuauucaguuccaugccuguuuuaaucagcacaugagcugcguccguuuccugcacagaacaaucuugccuggauccauggcuaacucaauuugucagaauaucgaaauaauuauccucacuacccuggcacugcucauauuuuuacugcuuacaaucuugaguaagaccuauaucugcuaccugcuaaugccaauuuucauacccaucgcccaucucuauggccugauuuacaacaagagcuguaaaaagugccaacuuugcggccugguuuaucacccuuuuacggagugugggacucauugcguguguggagcuagguacgaaacaucugaccggaugaaauugcaccgcgccuccggucucugcccaggcuacaagucacugagagcggcaaggguaauguguaaaagcaaggggcccgccaguaauuuaucuaucauaaccgcugugcugacucucacauucgucaccccuauuaacggacuuacgaucggcgauuccaaagaggugcugaauccagacgaguugccggaugacaugcuagaaauggcccagaagcugaacauguaucagcucaucugcauuaucaauuacaccgcaacauggagcauuauaaucauuggucuggcuguguuuuauaucuucaagaaauaccagcaccgguucuauaacuacuaugccauguacugucaagagugcgacauguaccaugaacgcucggggcuuaaguggaacggagauuuuacuaauaaaugucgacagugcaccuguggcgaguaugaagacgcggccggccugaucucucacagaaaguccuacaacugcuugcuccaguauaaaguuaagugggucaugaauuuccugacaauuuacguggcauuaauaauccugaaggauucaacucuaauuguacaagcugccgggaccgacuuuagugauugcaucgagacagaggaacugaacuggaauuguaccggacccuuccugaaccuugguaauugcgagaaaaagcagaaaaaggaaagcuauuccaacauugcugagcaguugaaaggccugcaggccaucucugugcucgacauaccucugaucgcacggauuccagaagauaucagcgggggacuucgguacauugagucaauccguacucaucacgcccagcugacggcugaguaugcgauguugacacgcuacugugacuaccauaagcucuuuggcgauaauagugguuauucccagaccacuuggagaauguaccugaggagccacgacuucggggcaugcauauuauaucccaaccagcacuuuugucggugcgugaagcauggcgaaaaauguucuucaaguagcugggauuucgccuccgagaugaagaauuacuauucuggaaaacagggcaaguuuaacaaagaccugaaucuagcucuccaaucgauucaccaugccuuccgagggaccagcuccucauacaucgcaacaauucugagugaaaagcgcaacgaccagcuugucgaguauauggaaaaguugagagagaaauuuaucggaaaugcccugcucagggcugugcuggauuucauaaccuacaugaagucuuuaacugagaugacaaacuuuaaacacgacgaguucugggaugaguucguccaucugccugccccaacgaaggcacccagcaugcggcgcuccgguaacgaaaauuacgacuuuaaagcgccgaccagcccugcuggcacuaagucaugcaaaaacaucaagaaugugguuugucuuucucccagauccggggccaguuaugaaggaauuguggcaugcggcgagccaagcgccccucagaucuucaagaugcccucugaauccauuuaccacaacaaugcugaucagucaauguauuguaucgccgacacacacugcuugcaagauuacaguccaguagaggacgaggaacucaacgcaauuaaaaagagcaaaugcugggaaaccgaguuuacaaaugcuguccccuucaagcagucggaugguauuagguccugucguaugcgggacucugggaacugcaaugugacuaccaaccuguggccuguuaugcagugugaugacggcaaauuuuauuacagcgagcaucagaaggauuaugacaaggaccaagauaucggacacuucugccuaucaccacgauguaauauggugagauuuccgaucagugagaaaaacauucuggccugcgacuggaucgucucccaucccaauauugauaagauagacgugcacucucucgaagaucuggaacaguacaaaaaggcgaucacgcagaaacuucaaaccagcuuguccauuuucaaguacgccaagacaaugaaccugccucacguaaaaccaaucuauaaguacauuucaaucgagggcacugaaaccgcugaggggguggagaaugcauuuauagaaagcgagauccccgccuuagcuggaacaaguauugguuucaaaguuaacucuaaggacggcaaacauaucauggauauuaucggguaugucaagacugccuccuacagcucgguguauaccaagcucuacacgacaucaccuaccacuggagugaacacaaaacacgacgaacuguguaccggcccaugccccaagcagauagagcauaaaaaugguuggauuacuuuuucuaaggaaaggaccaguuccugggggugugaggaguucggcugccuugcaaucagcgauggaugugucuuuggcucuugccaggacaucauuaaagaugaaaugagcguuuaucgcaaggagacagaagagacgaccauaguggagcugugcuugacuuucuccgacaaaacauacuguguggaacucaacccgguaaccccuaucauuacagaucuguucgagguccaguuuaagacuguggaaucauacacccuaccacggaucguugcggugaagaaucacgaggucaugguggggcaaauuaacgaccugggaguuuauaguaaaggcugcgguaaugugcagaagguaaacgggacggucuacggaaauggcgugcccaaauucgacuaucucugucaucuggccagcagaaaggaagugaucauaaggaaaugcuuugauaacgacuaccaggcuuguaaguuccuucagucuccuuccucauaucgcuuggaggaggaugccaguacagucagcaucauugacuacaagaaaauccuggguaccauuaagaugaaagcaaucuuaggcgauguucgauauaagacuuuuuccgaaucuauagacauuucggcugaggggaccugcacaggaugugugaauugcuucgaaaacauccacugugaguuuacuauccacagcaccguagaagccucaugccccguggucuccacauguacucucuuccaugaucggauucugaucggcccagacaaucacaaauacgcaaugaaggugauaugcaccgaggccccuaagacgagucuuucuuuuaaaauuugcaacacaaagguugaugcugcgaucaccauuguggacagcaaacccaucgucgagcuggccccaguggaucaaacugcauacauacgugaaaaggacgacagauguaaaacauggaugugcaggguucgcgaugaggggaugcaagugcuauccgaaccguucaagaaucucuuuggaucauauauuggcaucuucuacaccggucuggcugucuugaucauugcccugaucgccguauauauugugaugccuauauguuucaagguuaaagacaucuuaaagaaacaugaugacgcuuaccggagagagcucaagauuagguga

SEQ ID NO: 10962 - RNA, 4326 nt, Artificial Sequence
  derived and/or modified CDS sequence (opt3) from SAV(20230)__KX817331.1__GP
augauccccuuacucuuccuugugacccuggucagcgccggcccuguuuuucagagaugcuuccaagacggggcuauugugaagcagaacccauccaaagaggcaguaacagaaguguguauaaaggaugacgucucuaugaucaaaacugaggccagguacgugagaaauucaaguggaguuuuuagcaacaauguggcguugcgcaagugguuagucuccgauuggcacgacugcaaaccgaagaaggugucugguggccauauuaacguaaucgaaguugggaaugaucugacgcuacacaccgagucguauguguguucagcugacugcacaauuggaaucgauaaagaaacugcccagauacgacuccagaccgacacaaccaaccauuucgaggucgcaggcacuacagucaagagcgguugguuuaaaaguaccacguacaucacucuggaucaaaccugugagcaccuuaagguguccugcgggcccaaaucuauucaguuccaugccuguuuuaaucagcacaugagcugcgugcguuuccugcacagaacaaucuugccuggauccauggcuaacucaauuugucagaauaucgaaauaauuauccucacuacccuggcacugcucauuuuucugcugcuuacaaucuugaguaagaccuauaucugcuaccugcuaaugccaauuuucauacccaucgccuaucucuacggccugauuuauaacaagagcuguaaaaagugccaacuuugcggccugguuuaccauccuuuuacggagugugggacucacugcguguguggagcuagguacgaaacaucugaccggaugaaauugcaucgcgccuccggucucugcccaggcuauaagucacugagagcggcaaggguaauguguaaaagcaaggggcccgccaguaucuuaucuauaauuaccgcugugcugauccucacuuucgucacaccuaucaauggacuuaccauuggcgauuccaaagagguguuuaaccuggacgaguugccagaugacaugcuagaaauggcccagaagcugaauauguaccagcucaucugcauuauaaacuauacggcaaccuggagcaucauuaucaucggucuggcuguuuucuacauuuucaagaaauaucagcaccgguuuuacaauuauuacgccauguacugucaagagugcgacauguaucacgaacgcucggggcuuaaguggaacggagauuucacaaacaaaugucgacagugcacuuguggcgaguacgaagacgcggccggccugauaucucauaagaaauccuauaauugcuugcuccaguacaaggugaagugggucaugaacuuucugaccaucuauguggcauuaauuauccugaaagauucaacacuaauuguacaagcugccgggacugacuucagugauugcaucgagaccgaggaacucaauuggaacuguacaggaccguuucugaaucuugguaacugcgagaagaaacagaagaaagaaagcuacuccaauauagcugagcaguugaagggccugcaggccaucucuguucucgacauuccccugaucgcacggauuccugaagauaucagcgggggacuuagguauauagagucaauucggacccaccaugcccaacugacugcugaguacgcgauguugacgcguuacugugacuauuacaaacucuucggcgauaacagugguuauucccagacaaccuggcgcauguaccugagaagccacgacuuugaagcaugcaucuuauauccaaauaggcauuucugucggugcgugaaacacggggagaaguguucuucaaguagcugggauuuugccuccgaaaugaaaaacuacuauucuggcaagcagggaaaauucaauaaggaccugaaccuagcucuccagucgauucaccaugccuuucgaggcacuagcuccucauacaucgcaaccauacugagugagaagcgcaaugaccaacuugucgaauacaugaaaaaguugagagagaaauucaucgggaacgcccugcucagggcugugcuggauuuuauuacauauaugaagucuuuaaccgagaugacuaauuucaaacacgacgaguucugggaugaauuuguccaucugcccgccccuacaaaggcaccaagcaugcggcgcuccggaaacgaaaacuacgacuucaaagcgcccacgucaccggcugguaccaagagcugcaagaauaucaaaaacgugguuugucuuucuccuagauccggcgccaguuaugaggggauuguggcaugcggagagcccagcgccccacagaucuuuaagaugccuucugaauccauauaccacaauaacgcugaucagucaauguauuguauugccgacacucacugcuugcaggauuacagucccguagaggacgaggaacucaaugcaaucaaaaagagcaaaugcugggaaacagaguucaccaacgcugucccauuuaagcaaucggauggcaucagguccugucguaugcgggacucugguaauugcaacgugacaacuaaucuguggcccguuaugcagugugaugacgggaaguucuauuacagcgagcaucagaaagauuacgacaaggaccaggauauuggccacuuuugccuaucaccucgauguaacauggugagauucccaaucagugaaaagaauauucuggccugcgacuggauagucucccauccgaacaucgauaagauugacgugcacucucucgaggaucuggaacaauauaaaaaggcgaucacccagaaacuucagacgagcuuguccauuuuuaaguacgccaagaccaugaaucugccccauaucaaaccuauauauaaguacaucucaauugagggaacagaaacugcugagggcguagagaacgcauucaucgaaagcgagauuccagccuuagcugggaccaguaucggauuuaaaguuaauucuaaggacgguaagcacauaauggauauuaucggcuaugugaaaacagccuccuacagcucggucuauacuaagcucuacaccacggggcccacaaccggagugaacacuaaacacgacgaacuguguacaggcccuugcccaaagcaaaucgagcauaaaaacgguuggauuaccuucucaaaggaaaggacuucuaguugggggugugaggaguuuggcugccuugcaauauccgauggauguguguucggcagcugccaggacaucauuaaagaugaaaugucugucuaccgcaaggagaccgaagagacaacgaucguugagcugugcuugaccuucagcgacaagacuuauuguguggaacucaaucccgugacaccgauuaucaccgaucuguuugagguacaguucaaaacagucgaauccuacacucuaccucggauaguggcgguuaagaaccacgaggugauggucgggcagaucaaugaccugggaguguauucaaaaggcugcgguaacguucaaaaggugaaugggaccguauacggaaacggcgucccaaaauuugacuaucucugucaucuggccaguagaaaggaagugauuaucaggaagugcuucgauaaugacuaccaggcuuguaaauuucuucagagccccucuuccuaucgcuuggaggaggaugccucaacggugaguauuaucgacuacaagaaaauacuggguacaauuaagaugaaagcaaucuuaggcgauguccgauacaagaccuucagcgaauccaucgacauuucugcugaggggacuugcaccggauguguuaacugcuuugaaaauauccacugugaguucacaauacauucgacuguggaagccagcugcccuguagugucaaccuguacacucuuucacgaucggauucugaucggccccgacaaccacaaguaugcaaugaaagucauuugcacggaggccccaaagaccucccuuaguuucaaaaucugcaauacuaagguggaugcugcgauaacaauuguugacucuaaaccuaucguggagcuggcccccgucgaucagaccgcauacauccgugaaaaggacgacagauguaagacuuggaugugcagggugcgcgaugaggggaugcaaguucuacucgaaccauuuaaaaaccuguucggaagcuauauuggcaucuucuacacagguuuggcugugcugauuauagccuuaaucgccgucuauauuguaaugccgaucuguuuuaaggugaaagacauccucaagaaacaugaugacgcuuaccggagagagcugaagauuagguga

SEQ ID NO: 10963 - RNA, 4329 nt, Artificial Sequence
  derived and/or modified CDS sequence (opt3) from SDNV__AF123490.1__GP
augaucugcauucugcuccuuauagcccuggcuagcgcaucccccguguaccagagauguuuccaagacggcgccaucgucaagcaguauccugcgaaagaugcuguuaccgaggugugcuugaaggacgauguaucuaugauuaaaacacaggccaacuacaugaagaauacuacggggaccuuuucaaacaauguggcaaugaggaaaugguuagucgccgacuggcacgauugucggccacagaagaguagcggaggucauaucaacgugauugaaguuggcgacgaucugucccuacacacagaggcuuauaucugcucugcagacugugugauaucgaucgauaaggaaacugcccaaauucgccuccagaccgacucaacaaaucauuucgaggucagcgggaccacugugaaaaguggaugguuuaaguccacaaccuacaucacgcuggaucagacuugcgaacaccuuaaaguaucuuguggcccgaagucuauucaguuccaugcuugcuuuaaccaacacauguccuguguucgauuccugcaccguaccaucuugcccgguucaauggccaauaguauaugccagaacauugagaucauuauccucgugacacugacucugaugaucuuuauucucuuaaccauaaucagcaaaacauauauuuguuacauccugaugccuauauucauuccaaucgcguauaucuacggguggauuuacaauaagucuugcaagaaaugcaaacuuuguggauuggucuaucaucccuuuaccgagugcggcacgcacugugugugcggcgcaagauacgaaacuuccgacaggaugaagcugcaucggucaagcgggcuauguccuggauauaagagucuccgcgccgcuagagugaugugcaaaucuagggguccagccuccauccugagcauucuuacagcaguccugauauugaccuucguuacucccaugucggcucucgugaucggcagcuccgaggaacuguacaaguuagaugagcugccugacgacaugauugauauggccgagaaaguaaaccucuauuaccuugugaucguccugaauuauucagcgacauggggguugcuacugcucaugggaauccuggcccuucuguuuaagaaguaccagcacauuuucuugaacuacuaugcaauguacuguaccgaaugcgacauguaucacgauaaaaaggagcucacguacaauggcgacaguccaaccaacgcuuggcaguguacaugcggucaauaugaagaugccacugggcugauagugcaucagaaaagcuacaauuguuuaguuaaguauaaagugaaguggaucaagaacauucugaucauguacauuguccuaacccucaucaaagacuccgugcugauagcuucugccgagggaccggauuuugcaacaugcaucgaagagaagacuauuaccuggaacugcacaggccccuuccuuaauuugggccggugugacaaaacccagaagaaaacugauuacgccacgaucgcuagccaacugaaggggauugacgcgaucucaauacucgauguaccuaugauuaguaagaucccagaggacauuuccggagcacugaaauauaucgaaagccuuaagacauaccacgagcagcugaccgccgaauaugcuauguucacucgcuacugcgacuauuacacccaguuuucugauaacucagguuauagucagacaaccuggcgaacuuacuugagaagccaugacuucgagguuuguauagccuaccccaaucaacacuuuuguaggugcgugaaaaacggcgaaaagugcuccucugcacagugggauuucgccacagagaucaaaggguauuacacgggacggcagaauaaguuuaacaaggaccucaaucuggcuuuaaugaccuuccauacugccuuucguggcacagcaaccucguaugucacagagcugauuagcaaagguaagaacuccucacuacucauguacgcgagugcuaucaaaucuaaguucaaugggaacgcccugcuuaaagcauugcuggauuuuaugauguaucuccagagccugggcgaaauuuccggauucaaguuaacugacgagugggaagauuuuaaauacgaggaagaaccuaccgagcaaacgcugaugccacgcggccacagagggggacaguauaauuucaagaacgccgcuucaaaugguaagaccaaaguguguaagaacgucaaaaaggugcuuugcuugagccccaggucucgggccacauuugacgauguuaucgcauguggcgaacacgcuaauccguccguguacaugauaccuaacacuaccauuuaccagaguaacacagagcgaagccauuauugcaucgccgacucucacugucucgaagaguacgagcugguaaaacccgaacuacugacugcgcucaagaagucccgcugcugggccggggauaucgacaccauuguccugcauaaacagucagauggacuuagaaguugcaggaucaaggacacgggcagcuguaaugugauggguaacgacuggacaauuguuuugugcgaggauaauaaauauuacuauucggaagugcaccaagacuacgauaaggaccaggaugucgggcacuucugucuguccccacggugcaacaccauacgcuauccuaucucucccagacauauuaauagcuguaaauggcagaucucacacaguacuauuggcaagaucuccgugcaugaguuagcugacauagaacaguacaagaaagcaaucucucaaaagcuccagacaagccuguccauuuucaaauacgccaagaccaaaaaccuuccacacaucaagcccguauauaaguacauugcuaucgagggaacugagaccguggaaggcguugagaaugccuuuauagaaucagagauuccugcacuggcggggacagccaucggauucaaaaucaacagcaaggaagguuaucauuugauggauauuauaggcuacgucaaaagugcuucuuauuccagcacguacaccaagcucuauacuacagggccaaccaucggaauuaauacaaaacacgacgagaagugcacuggcucguguccggguaccauccaccauaaaacgggguggcugacauuuucaaaggagaggaccucuacuuggggcugcgaagaguucggaugucuagccgugagugauggcugcguguacggguccugucaggacauuaucaaggaugaacugaccgucuaccguaaaauaagcgacgagguuacagaaguggagcucugccugacuuuuucugauaagaccuauugcacaaaccuuaaugcagugacgcccaucauuaccgacaaauucgagguacaauuuaagacugucgaaagcuacuccuugccucggaucgugggaguucgaaaccacaaaauucagaucggccagauaaaugacauugguguguauucaaagggguguggaaacguccagaaggugaauggcacaaacuacgguaacggcguuccaaaauucgauuaucugugccauuuagcuaguagaaaggaggugaucaucaggaaauguuuugacaaugauuaccaagccugcaaguuccuccagacccccgcaagcuaucgccuggaggagcaccaggggacuguaacaauuaucaacuacaaaaagauacuuggaucuauuaagaugaaaccuuacugggucaugcugcgguauaagaauuacgccaacucccuagacaucaaugcugagggcaccuguucagggugcgugggauguuuugaaaacauucauugcgaguucacgauccacacuaccauagaagcgaguugucagauugagagcgauugcacaaccuuucacgacagaauccucgugacuccaaaugaacauaaauaugcccugaaggucaucugucacgauaaacccaagacaauuuucaacuucaagaucugcaauaccgagauugaggcagcuauagccaucguugacgccaaaccgauuaucgaauuggcuccuguggaucaaacagcauacaucagggagaaggacgaacgcugcaaaacuuggaugugucgaguacgggaugagggcauucaggugcuguuagaaccauuuaagaaccucuucgguuccuauauagggaucuuuuacaccauucugaucgucauuuucauccuugugauaaucauuuauaucauucugcccaucugcuuuaaauugcaggacacgcucaagcagcaugaggacgccuacaagcgugagaugaaaauaagauga

SEQ ID NO: 10964 - RNA, 4329 nt, Artificial Sequence
  derived and/or modified CDS sequence (opt3) from SDNV(BeAr103645)__KX817334.1__GP
augaucugcauucugcuccuuauagcccuggcuagcgcaucccccguguaccagagauguuuccaagacggcgccaucgucaagcaguauccugcgaaagaugcuguuaccgaggugugcuugaaggacgauguaucuaugauuaaaacacaggccaacuacaugaagaauacuacggggaccuuuucaaacaauguggcaaugaggaaaugguuagucgccgacuggcacgauugucggccacagaagaguagcggaggucauaucaacgugauugaaguuggcgacgaucugucccuacacacagaggcuuauaucugcucugcagacugugugauaucgaucgauaaggaaacugcccaaauucgccuccagaccgacucaacaaaucauuucgaggucagcgggaccacugugaaaaguggaugguuuaaguccacaaccuacaucacgcuggaucagacuugcgaacaccuuaaaguaucuuguggcccgaagucuauucaguuccaugcuugcuuuaaccaacacauguccuguguucgauuccugcaccguaccaucuugcccgguucaauggccaauaguauaugccagaacauugagaucauuauccucgugacacugacucugaugaucuuuauucucuuaaccauaaucagcaaaacauauauuuguuacauccugaugccuauauucauuccaaucgcguauaucuacggguggauuuacaauaagucuugcaagaaaugcaaacuuuguggauuggucuaucaucccuuuaccgagugcggcacgcacugugugugcggcgcaagauacgaaacuuccgacaggaugaagcugcaucggucaagcgggcuauguccuggauauaagagucuccgcgccgcuagagugaugugcaaaucuagggguccagccuccauccugagcauucuuacagcaguccugauauugaccuucguuacucccaugucggcucucgugaucggcagcuccgaggaacuguacaaguuagaugagcugccugacgacaugauugauauggccgagaaaguaaaccucuauuaccuugugaucguccugaauuauucagcgacauggggguugcuacugcucaugggaauccuggcccuucuguuuaagaaguaccagcacauuuucuugaacuacuaugcaauguacuguaccgaaugcgacauguaucacgauaaaaaggagcucacguacaauggcgacuuuaccaacaaaugucggcagugcacauguggucaauaugaagaugcuacugggcugauagugcaucagaagaguuacaauugcuuaguuaaauauaaggugaaguggaucaaaaacauucugaucauguacauuauccuaacccucauaaaggacagcguccugaucgccuccgcugagggaccagauuucgccacaugcauugaagagaaaacuaucaccuggaacuguacaggcccguuccuuaauuugggccgcugcgacaagacccagaaaaagacugauuacgcaacgauugccucucaacugaaggggaucgacgcuauaagcauucucgaugugcccaugaucucaaaaauuccugaggacaucaguggagcgcugaaguauauagaaucccuuaaaacauaccacgagcagcugaccgcagaauaugccauguuuacucgauacugugacuauuacacccaguucagcgauaacucugguuauucacagacaaccuggagaacuuacuugaggagucaugacuuugagguaugcaucgcuuacccaaaucaacacuucugucggugcguuaagaacggcgaaaaauguagcuccgcccagugggauuuugcaacagagauuaagggguauuacacgggaaagcagaauaaauucaacaaggaccucaaucuggccuuaaugaccuuucauacugcuuuccguggcacagccaccucuuaugugacagagcugaucucgaaagguaagaacagcucccuacucauguacgcaucagcgauuaaaaguaaguuuaaugggaacgcucugcuuaaagccuugcuggauuucaugauguaucuccagucucugggcgaaaucagcggauuuaaguuaacugacgagugggaagauuucaaguacgaggaggaacccaccgagcaaacgcugaugccucgcggccacagagggggacaguauaauuuuaaaaacgcagccuccaauucaaagaccaaagucugcaagaacgugaaaaagguccuuuguuugagcccaaggucucgggcuacauucgacgaugugauagccugcggugaacacgcaaaucccuccguuuacaugauuccgaacacuaccaucuaccagaguaacacagagcgaagccauuauuguaucgcugacucucacugccucgaagaguacgagcuggugaagccugaacuacugacugcccucaaaaagucccgcugcugggcgggcgauauugacaccaucguacugcauaaacagucagaugggcuuagaaguuguaggauuaaggacacgggaagcugcaaugucaugggcaacgacuggacaauaguguugugugaggauaauaaauauuacuauucggaaguucaccaagacuacgauaaggaccaggaugugggucacuucugccugucccccagauguaacaccauccgcuauccaauuucuccuagacauaucaauagcugcaaguggcagauuucacacaguacuaucgggaaaauauccguccaugaguuagccgacaucgaacaguacaagaaagcuauuucucaaaagcuccagacaagccuguccaucuuuaaauacgcaaagaccaagaaccuuccccacauuaaaccaguguauaaguacaucgccauagagggcacugagaccguagaaggaguggagaaugcuuucauugaaucagagauccccgcccuggcaggcacagcgaucggguuuaaaauuaacagcaaggaaggaaaucauuugauggauauaaucgguuauguuaaaagugccucuuacuccagcacguauaccaagcucuacacuacaggcccuaccauugggaucaacacaaaacacgacgagaaguguacuggaucgugcccaggcaccauucaccauaagacggguuggcugacauucucaaaagagaggaccucuacuugggggugugaagaguuuggcugccuagcugucagugauggauguguguauggcuccugccaggacaucauaaaggaugaacugaccguguaccguaaaaucagcgacgaggucacagaaguugagcucugccugacuuucucugauaagaccuacuguacaaaucuuaacgccgugacgccgauuaucaccgacaaauuugaggugcaauucaagacuguagaaagcuauuccuugccccggauugucggggugcgaaaucacaagauccagauaggacagauuaacgacaucggcguuuacucaaaagguugcgggaaugugcagaaggucaacggaacaaacuauggcaauggugugccuaaauuugauuaccugugucauuuagcaaguagaaaggagguuaucauuaggaaaugcuucgacaacgauuaucaggcuuguaaguuucuccaaaccccagccagcuaccgccuggaggaacaccagggcacugugacaaucauagacuauaagaaaauucuugggucuaucaagaugaaagcaauucugggagauguacgguacaagaauuacgccaacucccuagacaucaaugcugaggggaccugcgcgggcugugucggaugcuucgaaaacauacauugugaguuuacgauucacacuaccaucgaagccucaugccagaucgagagugauuguacaaccuuccacgaccggauucucgugacucccaaugaacauaaauaugcacugaaggugaucugccacgauaagccuaaaacaauuuugaacuucaagauaugcaauaccaaaaucgaggcugccauuacaaucgucgacgccaagccaaucauugagcuggcucccguugaucaaacugcauacauaagggaaaaagacgagcgcuguaagaccuggaugugccgagugcgggacgaaggcauccagguauuacucgagccguuuaagaaccuguucgguagcuauauugggaucuuuuacacgauucuuaucgugauauucauccuggucauuaucauuuauaucauauugccuauuuguuuuaaacuccaggauacacugaagcagcaugaagacgccuacaaacgugagaugaagaucagauga

SEQ ID NO: 10965 - RNA, 4326 nt, Artificial Sequence
  derived and/or modified CDS sequence (opt3) from SSHV__EU262553.1__GP
augaucugcauucugauacucuucgccgugaccgcugcaagccccgucuaccagagauguuuucaagacggcgccaucguuaagcagaacccuuccaaagaggcggugacagaaguaugccuuaaggaugacgugucuaugauuaaaacugaggcuagguauaucaagaaugccacgggggucuucucaaacaauguggcaauucggaaauggcugguuagugauuggcacgacugucgcccaaagaagaucaccggaggucauauaaacgugaucgaagucggcgaugacuugagcuuacacacagaguccuacgugugcucugccgauuguacuauugggguagacaaagaaaccgcucagguucgacugcagacagauaccacuaaucauuuugagaucgcaggaacaaccgugaagucgggcugguucaaaucaacgacuuauauuacccuagaccaaacaugcgagcaccucaaggucagcugugguccgaaaaguauccaguuucaugccugcuucaaccagcacauguccugugugcguuuucugcacagaacuauacuucccgggucuauugcuaauagcaucugccagaacauugaaaucaucauucuggugaccuugacacuccugauauucauccugcucuccgucuuaucaaagaccuacauuuguuaucugcuuaugccuguuuuuaucccaauagccuacgcguauggaauuaucuacaauaagaguugcaaaaagugcaaauuguguggccugguguaccaucccuucacggagugcggcacucacuguguaugcggggcaagguaugauacaagcgaccggaugaagcuacaucgcgccucuggacucuguccugguuacaaaucccugagagcugccagggugaugugcaagucaaaaggcccagcaagcauccuuagugucauuaccgcuauccugauuuugacuuuugugacacccauaaacucuaugguugugggggaauccaaggaggucuucgagcucgaacaacugccugaugacauguuagacauggcccugcggaucaauuuuuauuacuucguguguauuaugaacuaugcgguaaccuggggacucaucaucauuggccuucugauagguuugcuauucaagaaauaccagcaccgcuuuagcaaucuguaugccauguacugcgaggaaugugauauguaccacgaccgaucggggcucaagagaaacggagauuucacgaauaaaugcaggcaguguaccugcggccaguaugaggacgcaacaggccugaugacucaucggaagaccuacaacugccuuguucguuauaaagcuaagugggugaugaacuuucugaucgccuacauguugcucacacugauuaaggauucugcuaucgucgugcaagccgcagggacugacuucaccacauguuuagaaaccgagaauauuaacuggaauugcacuggaccauuucugaaccuagguaauugucagaaacagcaaaagaaagagccguaugccaacaucgcuacgcagcucaagggccugcaggcgauauccguccuugauaugcccaugaucgcaucaauuccugaagacaucgccggggcuuugcgcuacauugaggaaaaagagacauuccacgugcagcugaccgccgaauaugcaaugcucaguagauacugcgauuacuaugcccaauuuagcgacaauuccggauacucucagacuaccuggaggguuuaucugcggagccaugauuucgacgcuuguauccuuuacccaaaccagcacuuuugccgaugugugaagcauggcgacaagugcucaaguuccaaucgcgauuucgccaacgagaugaaaaauuauuacagcgguaagcagaacaaauuugacaaggaucugaauuuggcacucauggcgcugcaccacgcuuucagagggacaucuucagccuauauagcaaccauguuaaguaaaaagagcaacgacgaucugauugccuacacuaauaagaucaaagagaaguuucccggcaacgcucuacucaaagccauuguagacuacaucgcauauaugaagucccugucugaaaugucgagcuucaaauacgaugaguucugggacgaucuuuuguauaaguccgcuccuacaaaagccccaucacugaguaggggaucugaacccagcuacaacuuuaagcucgucguguccucacggagcauaaagucuuguaaaaauguuaaguccguggucugccugaguccgcgcagcggcgugucuuaugacuccaucauugcguguggggauccuaacggacccucaguauacagaaaaccaagugacgguguguuccaaagcaaugccgaucagucgacguauugcuuagcugacucccauugccuggaggacuuugaaguugucucucaggaggagcuugaugcaaucaagaaaagcaaguguugggaagccgaguacccugacgugaaguugucaaaacucaccgauggcgugaagaguugcaggaugaaagacuccgggaacuguaaugucgcugccaaccguuggcccauuauccagugcgaaaaugauaaguucuacuauucugagcugcaaaaagacuacgauaagacucaggacauaggacacuuuugucuaagcccaggcugcuccacaguucgguuccccauuaacccuaagcauaucucaaauuguaacuggcaagugagccgaaguucuaucgcaaaaauugaugugcacaauaucgaggacauugaucaguauagaaaggcgauaacccagaaacugcagacaucccucagccuguuuaaguacgccaaaacuaagaaccuuccacacaucaagccgauuuauaaauacaucaccauugaagguacggagaccgcugaagggaucgagucggccuauauagaaucagagauccccgcauuggcuggcacaucuauuggauucaagaucaccaguaaagagggcaagcaucuguuagacguaauuggguacgucaaauccgccagcuacucuagcaucuauacuaagcucuacacaacuggaccuaccuccgguauaaauacgaaacacgaugaacugugcacaggcccaugucccgcaaagauuaaccaucagaccggguggcuuacuuuugccaaggagaggacaucaaguuggggaugcgaagaguucggcugucuggcuaucagcgacgguugcguguuugggucuugccaagacaucauucgcgaugaauugaccguuuaucggaaagagacugacgaggugaccgaugucgaacucugucugacauucuccgacaagacguacugcaccaaucuaaacccuauaacuccaaucauuacagaucuguuugaggugcaguucaaaaccguugaaacauauucacuccccagaaucguggcgauucagaaccacgagaucaagauaggccagguaaaugaccugggagucuacaguaaaggcugugggaacgugcaaaaggugaauggaacugucuauggcaacgguguuccgaaguucgauuaccuuugccauuuggccagcaggaaagaagugaucguacgcaaguguuuugacaaugauuaccaggcaugcaaauuccugcaguccccugcuucuuaucgauuagaggaggacucggggaccgugacggucauugauuacaagaaaauccucggaacaauuaagaugaaggccauccugggcgacgugaaauauaagaccuuugccgacaacguugauaugacugcugaagguagcuguaccggcugcauaaauuguuucgagaacauucacugcgaacuuacacugcacacuaccaucgaggcaucauguccaaucguguccacaugcacggucuuucaugaccggauucuagugacccccaaugagcacaaauacgcccucaagguugugugcacugaaaaaccugggaacacacugaccauccguauauguaauacuaaggucgaggcgaguuuggcucugguagaugccaagcccauuuuagaacucgcaccaguggaccagacagccuauaucagagagaaagaugaaaggugcaagaccuggaugugucgcguucgggacgagggacugcaagugauucuugagccuuucaaaaaccuguuuggcucuuacaucgggauauucuauacguuuauuaucagcaucauugcuuugcucaucauuauauacaucguccugcccauuugcuucaagcuaagagauacucugaggaaacaugaagacgcauacaagcgagagaugaagauccgcuga

SEQ ID NO: 10966 - RNA, 4326 nt, Artificial Sequence
  derived and/or modified CDS sequence (opt3) from SSHV__K02539.1__GP
augaucugcauucugauacucuucgccgugaccgcugcaagccccgucuaccagagauguuuucaagacggcgccaucguuaagcagaacccuuccaaagaggcggugacagaaguaugccuuaaggaugacgugucuaugauuaaaacugaggcuagguauaucaagaaugccacgggggucuucucaaacaauguggcaauucggaaauggcugguuagugauuggcacgacugucgcccaaagaagaucaccggaggucauauaaacgugaucgaagucggcgaugacuugagcuuacacacagaguccuacgugugcucugccgauuguacuauugggguagacaaagaaaccgcucagguucgacugcagacagauaccacuaaucauuuugagaucgcaggaacaauugugaagucgggcugguucaaaucaaccacguauaucacucuagaccaaaccugcgagcaccucaaggucagcugugguccgaaaaguauacaguuucaugccugcuucaaccagcacauguccugugugcguuuucugcacagaacaauucuucccgggucuaucgcuaauagcauuugccagaacaucgaaaucauuauacuggugacuuugacccuccugaucuucauucugcucuccgucuuaucaaagacauacaucuguuaucugcuuaugccuguuuuuauaccaauugccuacgcguauggaaucaucuacaauaagaguugcaaaaagugcaaauuguguggccugguguaccaucccuucaccgagugcggcacgcacuguguaugcggggcaagguaugauacuagcgaccggaugaagcuacaucgcgccucuggacucuguccugguuacaaaucccugagagcugccagggugaugugcaagucaaaaggcccagcaagcauucuuagugucaucacagcuauucugauauugaccuuugugacucccaucaacucuaugguugugggggaauccaaggaggucuucgagcucgaacaacugccugaugacauguuagacauggcccugcggauuaauuuuuauuacuucguguguaucaugaacuaugcgguaacauggggacucaucauuauaggccuucugaucgguuugcuauucaagaaauaccagcaccgcuuuagcaaucuguaugccauguacugcgaggaaugugauauguaccacgaccgaucggggcucaagagaaacggagauuucaccaauaaaugcaggcaguguacgugcggccaguaugaggacgcaaccggccugaugacacaucggaagacuuacaacugccuuguucguuauaaagcuaagugggugaugaacuuucugauugccuacauguugcucacccugaucaaggauucugcuauugucgugcaagccgcagggacagacuucacuaccuguuuagaaacagagaauaucaacuggaauugcaccggaccauuucugaaccuagguaauugucagaaacagcaaaagaaagagccguaugccaacauagcuacucagcucaagggccugcaggcgaucuccguccuugauaugcccaugauugcaucaaucccugaagacauugccggggcuuugcgcuacaucgaggaaaaagagacguuccacgugcagcugacagccgaauaugcaaugcucaguagauacugcgauuacuaugcccaauuuagcgacaauuccggauacucucagaccacuuggaggguuuaucugcggagccaugauuucgacgcuuguauacuuuacccaaaccagcacuuuugccgaugugugaagcgcggcgacaagugcucaaguuccaauggugauuucgccaacgagaugaaaaauuauuacagcgggaagcagaacaaauuugacaaggaucugaauuuggcacucauggcgcugcaucacgcuuucagaggcaccucuucagccuauauugcaacaauguuaaguaaaaagagcaacgacgaucugaucgccuacaccaauaagauuaaagagaaguuucccggaaacgcucuacucaaagccaucguagacuacauagcauauaugaagucccugucugaaaugucgagcuucaaauacgaugaguucugggacgaucuuuuguauaaguccgcuccuacuaaagccccaucacugaguaggggcucugaacccagcuacaacuuuaagcucgucguguccucacggagcaucaagucuuguaaaaauguuaaguccguggucugccugaguccgcgcagcggggugucuuaugacuccauuaucgcguguggagauccuaacggucccucaguauacagaaaaccaagugacggcguguuccaaagcaaugccgaucagucgacauauugcuuagcugacucccacugccuggaggacuuugaaguugucucucaggaggagcuugaugcaauuaagaaaagcaaguguugggaagccgaguacccugacgugaaguugucaaaacucacggauggggugaagaguugcaggaugaaagacuccggaaacuguaaugucgcugccaaccguuggcccaucauacagugcgaaaaugauaaguucuacuauucugagcugcaaaaagacuacgauaagacccaggacauuggccauuuuugucuaagcccagguugcuccacuguucgguuccccaucaacccuaagcacaucucaaauuguaacuggcaagugagccgaaguucuauugcaaaaaucgaugugcauaauauugaggacauagaucaguauagaaaggcgaucacacagaaacugcagaccucccucagccuguuuaaguacgccaaaacaaagaaccuuccacacauuaagccgaucuauaaauacauuacuaucgaagggaccgagacggcugaaggcauagagucggccuauaucgaaucagagauucccgcauuggcuggaaccucuaucggcuucaagauuacaaguaaagaggggaagcaccuguuagacguaaucggauacgucaaauccgccagcugcucuagcauauacacuaagcucuauaccacagguccuacuuccggcauuaauaccaaacaugaugaacuguguacggggccaugccccgcaaagaucaaccaccagacaggauggcuuaccuuugccaaggagaggacuucaaguuggggcugugaagaguucgguugccuggcuaucagcgacgggugcguguuuggcucuugucaagacauuauacgcgaugaauugacaguuuaccggaaagagaccgacgaggugacugaugucgaacucugccugaccuucuccgacaagacauauuguacgaaucuaaacccuaucaccccaauuaucacugaucuguuugaggugcaguucaaaacaguugaaaccuacucacuccccagaauuguggcgauccagaaccaugagauaaagaucggacagguaaaugaccugggcgucuauaguaaagggugcggaaacgugcaaaaggugaauggcacagucuacgguaacgggguuccgaaguucgauuaucuuugucacuuggccagcaggaaagaagugauuguacgcaagugcuuugacaaugauuaccaggcauguaaauuccugcaguccccugcuucuuaccgauuagaggaggacucgggaacugugaccgucaucgauuauaagaaaauucucggcacgaucaagaugaaggccauacugggugacgugaaauacaagacauuugccgacaacguugauaugaccgcugaaggcagcugcacuggguguauuaauugcuucgagaacauccauugugaacuuacccugcacacaacuaucgaggcaucaugcccaauugugaguaccugcacagucuuucacgaccggauccuagugacgcccaaugagcauaaauaugcccucaagguuguguguaccgaaaaaccuggaaacacucugacaauacguauuugcaauaccaaggucgaggcguccuuggcucugguagaugccaagcccaucuuagaacucgcaccaguggaccagacugccuacauuagagagaaagaugaaagguguaagacauggaugugccgcguucgggacgagggccugcaagugauccuugagccuuucaaaaaccuguuugggucuuauauaggaauuuucuacaccuuuaucaucagcauuaucgcuuugcucauuauaaucuauauuguccugcccaucuguuucaagcuaagagauacgcugaggaaacacgaagacgcauacaagcgagagaugaagauccgcuga

SEQ ID NO: 10967 - RNA, 4335 nt, Artificial Sequence
  derived and/or modified CDS sequence (opt3) from SORV__AF123488.1__GP
auggaggugcugagccucaucuggcuucugaccuugugcuccgccucucccgucuuccagagauguuuucaagacggcgcuauuguuaagcagaacccuucaaaagaagcagugacagagguaugcuuaaaggaugacgugaguaugauaaaaacugaaacgaaguacgucaaaaauaccacagggacuuucgccaacaauaucgcgaugaggaaguggcugguggcugauuggcacgacugucggccacagaaguccuccggaggucauauuaacguuaucgaggugggcgaugaccuaucucuccacaccgaaucguauauuugcucagccgauugugucaucacaguggacaaagagaccgcacagauacgccugcaaacugauaauacaaaccauuuugagguagccgggaccacgguuaagagcggaugguucaaaaguacuaccuacaucacacuugaccagacuugcgaacaccugaagguguccuguggcccgaaaucuauucaguuucaugcuugcuucaaucagcacaugagcuguguccgauuuuugcaccguaccauccuccccgguuccauugcaaacucaaucugccaaaauauagagauuaucauucuggugacacugagucucgugaucuucaucuuuuuaaccauugucagcaagacguauauauguuaccugcuuaugccuaucuucauuccaaucgccuuuauauauggguggauuuacaacaagucuugcaaaaagugcaaauuguguggacugguuuaucaucccuucacugaaugcggcacacacugugugugcggcgcuagauacgagaccuccgauaggaugaagcuacaucgggccucagggcucuguccuggauacaaaagccugcgcgcggcaagaguaaugugcaagaguaaagguccagccucuauccuuuccauccugacugcuauuuugauccucacauuugugacccccauuagcgccauggucgugggcgagucgaaugaaauauauacgcuggacgauuuaccugacgacaugguucagauggcagagaggaucaacauuuacuaucagauccugaucauuaauuacggggugaccugggcuuuccuccuucugggauugguccuagccuauuucuuuaagaaguaccagcacaaauuccuggauuauuacgcgauguacugugaagagugcgacauguaucacgaaaagucuggcaugacauacuggggugauuuuacuaacaaaugucggcaaugcaccugugggcaguucgaggacgccacaggacucauggugcauaagaaauccuauaauugccugguaaaguacaaggcaaaauggauacgcaacauccuuauugcuuaucugaugaucauguugguuaaggauucacuccuguuugugggcgccacucgagcugacuucgccaguugcgucgaugagaaaaccgugacauggaacuguaccggcccauuuuuaaaucuggggagaugcgacaagacucagaaaaagacgggauacaaggauauugcaaaccaacuaaaaggucucggcgucaucagcauacuggacaucccgaugauugaaaagaugcccgaugagaucuccgggucucuuaaauauauugacagcuuggaaacauaccacgagcagcugaccgccgaauacgcuuuccucacuagguauugugacuacuauacccaguacacagauaauucaggauauagucagaccguguggcggacuuaccugcguucccaugacuuuggcgcgugcguuguguauccuaaccaacacuucugucgcugcguaaaguacgaugacaaauguaauagcgcaaagugggauuuugccaacgagaugaagacauucuacacggguagaaaagucaaguuuaauaaagaccuuaaccuggcuuugcucgugcugcauaaggccuucagggggaccggcacugcauauaucgccgaggcuauggcccggaaagauaauggaucuauggcacacuucgcguuagaaauacgaaagaaauuuccaacaaacgcucugcuagccgcacucauugacuacaucguuuaucugcagucacuugccgagauuaguaccuucgaauuggaggaagauugggaggacuuuaaguacaagcccgagccuacagaaagcacucugcagccacgcucccacagaucugaucaguauaauuucaaaaacgcugacucgaauagcaacgugaaggucugcaaaaaugugaagaaaguacucugugugucccccaggucacgggccaaguuugagaacaucauagcaugcggcgaacaugcuaacccgaguguuuacaugaugccuaauaucucuauuuaucaaagcaacuccgagcgcucacacuacuguaucgccgauagccauugccuggaggaauacgagauugucaauaccgaauuacugacggcgcuuaagaaaucuagaugcugggccaaggagauggacgacgugguguugcacaaacaguccgaugggcucaggaguugucguaucaaggacaccggaagcugcaacguccuggguaaugauuggacaauaguucuaugugaaaacggcaauuauuacuauucugagauucacaaagacuacgauaaggaccaggauguggggcauuucugccugagcccccgguguucaacuauccgauauccaaucaacagaaggcacauucgcaagugcgacuggcagaucagucauagcaccauugauaaaauaucggugcaagagcucgcugacaucgaacaguacaagaaagcaauuucccagaagcugcagacaucucuuagcaucuuuaaauauguaaagacuaagaauuugccucacauuaaacccgccuacaaguacaucaccgucgagggaacggaaacaauagagggcaucgaaaacgcuuucauugagucagagaucccagcccuggcagguaccgcgauuggguuuaaaaucaauagucgggaaggcaacuauuuaauggaugugauaggauacguuaaguccgccucuuauagcgcuacuuacacaaaacucuauaccacuggccccaccauugggaucaauacaagacaugacgagaaguguacgggaccuugcccagugaccaucgaucacaaagacgguuggcugacuuucuccaaggaaaggacaucaaccuggggcugugaggaauuugggugccuugccgucagcgacggauguguguucggcaguugccaagauauuauaaaggacgagcuggcaguuuaccgcaaaacaacugaggaauugaccacgguggagcucugccugacauuuucugauaagaccuauuguacuaaccuaaaugcuaucaccccgauuaucacagacaaauucgaaguacaguucaagacugucgaguccuacacccugccccgaauuaucgccgugaaaaaccacgagauaaaggugggucagaucaacgaucucggggucuacagcaagggcugcggaaauguucaaaaagugaacggcacaaauuaugggaacggaguaccuaaguuugacuaccugugucaucuugcaucgcggaaagaagugauuuugcguaagugcuucgauaaugacuaucaggccuguaaauuucugcagucaccagcuucuuacagauuagaggaacaccagggcacggucaccgugaucgauuauaagaagauucucgguaguaucaaaaugaaggcgauacugggggacguuaaauacaagaacuaucaauccaauauugagaucaacgccgaaggaacuugcgcaggcugugugaauugcuucgagaacauccauugugaguuuacaauucacaccacugucgaaacaagcugccccaucgugaccgauuguguuucuuuccaugacaggauacuuauuacgccugacgagcacaaauacgcucugaagaucgugugccaggauaagccaaaagucagccuaaaguuuaaaauuugcaauacuaacaucgacgccuccaugaccauaguagauucaaagcccauucucgaacuggccccgguggaccagacagcuuacaucaaagagaaggaugaacgcuguaagaccuggaugugccggguuagagacgaggguuuccaggugaucuuggagccuuuuaaaaaucuguucggcaguuauauugggaucuuuuacacuggaauuuuaagcgucauaugucuccugaucgugauuuauaucguacuuccaaucugcuucaagcugagggauacauugaaacaacacgaagacgcauacaagaaagagaugaagauucgauga

SEQ ID NO: 10968 - RNA, 4335 nt, Artificial Sequence
  derived and/or modified CDS sequence (opt3) from SORV(SORV-252)__JN815081.1__GP
auggaggugcugagccucaucuggcuucuggccgucugcuccgcuaaccccguuuuccagagauguuuucaagacggcgcaauugugaagcagaauccuucuaaagaagccguaaccgaggugugcuugaaggaugacgucucaaugauaaaaacagaagcgaaguacgugaaaaacacuacggggaccuucaguaauaacguugcuaugaggaagugguuaguggccgauuggcacgacugucggccacagaaaagcuccggaggucauaucaaugucauugaggugggcgaugaccugucucuacacacagaaucguauaucugcucagcagauuguguaauuacuguugacaaagagaccgcccagauccgccuccaaacagauagcaccaaccauuuugagguggcugggacuacagucaagaguggaugguucaaauccaccacguacauaacucuggaccagaccugcgaacaccuuaaggugucuuguggcccgaaaagcauccaguuucaugcaugcuucaaucagcacauguccugugugcgauuucugcaccguacaauuuugcccgguucaaucgccaacaguauuugccaaaauaucgagauaauuauccucgucacucugagccugauuaucuucaucuuucucaccauuguuucuaagacauauauauguuacuuacugaugccuaucuucauuccaaucgcuuuuauauauggguggauuuacaacaaguccugcaaaaagugcaaacuuuguggauugguguaucaucccuucaccgaaugcggcacgcacuguguaugcggcgccagauacgagacuucagauaggaugaagcugcaucgggcgagcgggcuauguccuggauacaaaagucuccgcgcagccagagugaugugcaagucuaaagguccagcuuccauccugagcauccuuacagccguccugauuuugaccuuugugacucccaucucggcaauuauaaucgacgagucuaaggaaauuuauacacucgaugaccugccugacgauaugguucagauggcugagaggaucaauaucuacuaucagauuuuacugauaaacuacggcgugaccugggccuuccuccuucugggguugauccuagcguauuucuuuaagaaauaccagcacaaguuccuggacuauuacgccauguacugugaagagugcgauauguaucacgaaaaauccggaaugacguacuggggcgacuuuaccaauaagugucggcaaugcacauguggucaguaugaggaugcagcugggcucaugguccauaaaaagucauacaacugccugauuaaguauaaagccaaguggaucaaaaauauucuuauccuguacuugauaaugauccucgugaaggacagucuguuauucguaggagcuacuggcaccgauuuugccgcaugcauugacgagaaaagcguuacauggaacuguacuggcccauuccugaaccuagggcgcugcgauaagccgcagaagaaagccuccuuuaaggacaucgcuaaucaacucaaaggacugggugugauuucuguccuugauauccccaugauagaaaagaugccugacgacauuagcggcucauugaaauauaucgauagucugcgaaccuaccacgagcagcucacagcggaauacgcauuccugaccagauauugugacuacuaugcccaguacacugauaacuccggguauagccagacgguguggaggacauaccuucggucucaugacuuuggagcuugcgucguguauccaaaucaacacuucugucguugcguuaaguacggcgauaaguguaacucagccaaaugggacuuugcaaaugagaugaagaguuucuacaccggucagaaagccaaguuuaacaaagaucugaauuuggcucuccugguguuacauaaggccuuccgcgggacuggcaccgcauauauugcggaaacacuggcuagaaaagacaacggaagcaugguacacuucgcccuagagaucaggaagaaguuucccaccaaugcacuccuggccgcucuuauagauuacaucgucuauuugcagucccuggccgagauuucuacuuucgaaccugaggaagacugggaggauucgaaauaccagccagaacccacagagagcgugcuccaaccgcgggcacaccgauccgaccaguauaacuuuaagaaugcugauucaaacaguaauguuaaagugugcaagaacaucaaaaagguccuguguauuucuccucgcagcagagccaaguucgagaauaucauagcgugcggcgaacaugccaaccccuccguguacaugaugccaaacacgucaauuuaucagagcaauucugagaggucccacuacuguaucgcugacagucauugcuuagaagaguacgagaucguaaacaccgaacugcuuacugcauuuaaaaagagccggugcugggccaaagagauugacgauaucguguugcacaagcagucugacgggcuccgcuccuguagaauuaaagauacaggaucaugcaauguucuggguaacgacuggaccauaguccuaugugaaaauggcaacuauuacuauagugaggugcacaaggauuacgacaaggaucaagacguggggcauuucugccugagcccuagguguaauacaauccguuaucccauuucgcggcgacacaucggagaaugcaacuggcagauuacucauuccaccaucgauaaaauaucuguccaggagcucgcugacaucgagcaguacaagaaagccauuagccaaaagcugcagacgucacuuaguaucuuuaaauauguuaagaccaagaauuugccacacauuaaacccgcauacagauacaucacagugggcgguacugaaaccauagaggggguggaaaacgcguucauugaguccgaaaucccugcccuggcuggcacagccaucggauuuaagauuaauucuagggagggcaacuauuuaauggauguaauaggguacgucaaaagcgcauccuauucagcuacuuacaccaagcucuauacgacaggaccaaccaucgguauuaauacuaaacaugacgagaaguguacaggcagcugcccggugaccaucaaccacaaagauggguggcugacuuucaguaaggaacgcaccucuacauggggaugugaggaauuuggcugccuugccguuuccgacgguuguguguucgggagcugccaggacauuaucaaggaugagcuggcagucuaccggaaaacgaccgaagaguugacuacaguggagcucugccugaccuuuucggacaagacauauuguacugaucuaaaugccauaacccccaucauuacggacaaauucgaaguucaauucaagacaguggagucauacacccugccuagaaucauugcuguaaagaaccacgaaaucaggacuggccagauaaacgaucucggagucuacucuaagggcugcgggaaugugcagaaggugaacggaaccaguuauggcaauggugucccaaaauuugacuaccugugucaucuugcgucccgcaaggagguuauuuugcgaaaaugcuucgauaacgacuaucaggccuguaaguuucugcaaagccccgcaucuuaccgguuagaggaacaccaggggacagugacuguaaucgauuauaaaaagauccucggaagcauuaagaugaaagcuaugcugggcgacgugaaguacaaaaauuaucaguccaacaucgagauaaaugccgaagguaccugcgccggcuguauugauugcuucgagaacauccauugugaauuuacaauucacacgaccgucgaggcuucaugcccuaucacuacagacugugugaguuuccaugaccguauacuuauuaccccagaggaacacaaguacgcacugaaaaucguuugccaggauaagcccaaggugagccuaaaauuuaagaucugcaauacuaacgucgaggccucuaugacaauuaucgacuccaaaccgauucucgaacuggcgccuguggaucaaaccacguacauaaaggagaaagacgaaagauguaagacuuggaugugcaggguucgcgaugagggguuccaggugaucuuggagccauuuaagaaucuguucggaucauauauuggcaucuuuuacaccggggucuuaaguaucauuugucuccugauaguaaucuauauuauccuucccauuugcuacaaacugcgggacacauugaagcagcacgaagaugcuuauaaaaaggagaugaaaaucagauga

SEQ ID NO: 10969 - RNA, 4335 nt, Artificial Sequence
  derived and/or modified CDS sequence (opt3) from SORV(NJO-94F)__KX817337.1__GP
auggaggugcugagccucaucuggcuucugaccuugugcuccgccucucccgucuuccagagauguuuucaagacggcgcuauuguuaagcagaacccuucaaaagaagcagugacagagguaugcuuaaaggaugacgugaguaugauaaaaacugaaacgaaguacgucaaaaauaccacagggacuuucgccaacaauaucgcgaugaggaaguggcugguggcugauuggcacgacugucggccacagaaguccuccggaggucauauuaacguuaucgaggugggcgaugaccuaucucuccacaccgaaucguauauuugcucagccgauugugucaucacaguggacaaagagaccgcacagauacgccugcaaacugauaauacaaaccauuuugagguagccgggaccacgguuaagagcggaugguucaaaaguacuaccuacaucacacuugaccagacuugcgaacaccugaagguguccuguggcccgaaaucuauucaguuucaugcuugcuucaaucagcacaugagcuguguccgauuuuugcaccguaccauccuccccgguuccauugcaaacucaaucugccaaaauauagagauuaucauucuggugacacugagucucgugaucuucaucuuuuuaaccauugucagcaagacguauauauguuaccugcuuaugccuaucuucauuccaaucgccuuuauauauggguggauuuacaacaagucuugcaaaaagugcaaauuguguggacugguuuaucaucccuucacugaaugcggcacacacugugugugcggcgcuagauacgagaccuccgauaggaugaagcuacaucgggccucagggcucuguccuggauacaaaagccugcgcgcggcaagaguaaugugcaagaguaaagguccagccucuauccuuuccauccugacugcuauuuugauccucacauuugugacccccauuagcgccauggucgugggcgagucgaaugaaauauauacgcuggacgauuuaccugacgacaugguucagauggcagagaggaucaacauuuacuaucagauccugaucauuaauuacggggugaccugggcuuuccuccuucugggauugguccuagccuauuucuuuaagaaguaccagcacaaauuccuggauuauuacgcgauguacugugaagagugcgacauguaucacgaaaagucuggcaugacauacuggggugauuuuacuaacaaaugucggcaaugcaccugugggcaguucgaggacgccacaggacucauggugcauaagaaauccuauaauugccugguaaaguacaaggcaaaauggauacgcaacauccuuauugcuuaucugaugaucauguugguuaaggauucacuccuguuugugggcgccacucgagcugacuucgccaguugcgucgaugagaaaaccgugacauggaacuguaccggcccauuuuuaaaucuggggagaugcgacaagacucagaaaaagacgggauacaaggauauugcaaaccaacuaaaaggucucggcgucaucagcauacuggacaucccgaugauugaaaagaugcccgaugagaucuccgggucucuuaaauauauugacagcuuggaaacauaccacgagcagcugaccgccgaauacgcuuuccucacuagguauugugacuacuauacccaguacacagauaauucaggauauagucagaccguguggcggacuuaccugcguucccaugacuuuggcgcgugcguuguguauccuaaccaacacuucugucgcugcguaaaguacggugauaaauguaauagcgcaaagugggacuuugccaacgagaugaagacauucuacacggggagaaaagucaaguuuaauaaagaucuuaaccuggcuuugcucgugcugcauaaggccuucaggggcaccggaacugcauauaucgccgaggcuauggcccggaaagacaauggcucuauggcacacuucgcguuagaaauacgaaagaaauuuccaacaaacgcucugcuagccgcacucauugauuacaucguuuaucugcagucacuugccgagauuaguaccuucgaauuggaggaagacugggaggauuuuaaguacaagcccgagccuacagaaagcacucugcagccacgcucccacagaucugaccaguauaauuucaaaaacgcugauucgaauagcaacgugaaggucugcaaaaaugugaagaaaguacucugugugucccccaggucacgggccaaguuugagaacaucauagcaugcggggaacaugcuaacccgaguguuuacaugaugccuaauaucucuauuuaucaaagcaacuccgagcgcucacacuacuguaucgccgacagccauugccuggaggaauacgagauugucaauaccgaauuacugacggcgcuuaagaaaucuagaugcugggccaaggagauggaugacgugguguugcacaaacaguccgacggacucaggaguugucguaucaaggauaccgguagcugcaacguccugggcaaugacuggacaauaguucuaugugaaaacgggaauuauuacuauucugagauucacaaagauuacgacaaggaucaggacgugggacauuucugccugagcccccgguguucaacuauccgauauccaaucaacagaaggcacauucgcaagugcgauuggcagaucagucauagcaccauugacaaaauaucggugcaagagcucgcugauaucgaacaguacaagaaagcaauuucccagaagcugcagacaucucuuagcaucuuuaaauauguaaagacuaagaauuugccucacauuaaacccgccuacaaguacaucaccgucgagggcacggaaacaauagaggguaucgaaaacgcuuucauugagucagagaucccagcccuggcagggaccgcgauuggcuuuaaaaucaauagucgggaaggaaacuauuuaauggacgugauaggcuacguuaaguccgccucuuauagcgcuacuuacacaaaacucuauaccacugggcccaccauuggaaucaauacaagacaugaugagaaguguacggguccuugcccagugaccaucgaccacaaagauggcuggcugacuuucuccaaggaaaggacaucaaccugggggugugaggaauuuggaugccuugccgucagcgacggcuguguguucgguaguugccaagacauuauaaaggaugagcuggcaguuuaccgcaaaacaacugaggaauugaccacgguggagcucugccugacauuuucugacaagaccuauuguacuaaccuaaaugcuaucaccccgauuaucacagauaaauucgaaguacaguucaagacugucgaguccuacacccugccccgaauuaucgccgugaaaaaccacgagauaaagguggggcagaucaacgaccucggcgucuacagcaagggaugcggcaauguucaaaaagugaacgggacaaauuauggaaacggcguaccuaaguuugauuaccugugucaucuugcaucgcggaaagaagugauuuugcguaagugcuucgacaaugauuaucaggccuguaaauuucugcagucaccagcuucuuacagauuagaggaacaccaggguacggucaccgugaucgacuauaagaagauucucgggaguaucaaaaugaaggcgauacugggagauguuaaauacaagaacuaucaauccaauauugagaucaacgccgaaggcacuugcgcagguugugugaauugcuucgagaacauccauugugaguuuacaauucacaccacugucgaaacaagcugccccaucgugaccgacuguguuucuuuccaugauaggauacuuauuacgccugacgagcacaaauacgcucugaagaucgugugccaggacaagccaaaagucagccuaaaguuuaaaauuugcaauacuaacaucgaugccuccaugaccauaguagacucaaagcccauucucgaacuggccccgguggaucagacagcuuacaucaaagagaaggacgaacgcuguaagaccuggaugugccggguuagagaugagggcuuccaggugaucuuggagccuuuuaaaaaucuguucgggaguuauauuggaaucuuuuacacuggcauuuuaagcgucauaugucuccugaucgugauuuauaucguacuuccaaucugcuucaagcugagggacacauugaaacaacacgaagaugcauacaagaaagagaugaagauucgauga

SEQ ID NO: 10970 - RNA, 4323 nt, Artificial Sequence
  derived and/or modified CDS sequence (opt3) from TAHV__AF123485.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggagaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccaaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauaugaagacgcagccgggcuccugacccacaggaagacauacaacugccuugugcaguauaaaagcaaguggcugacuaacuuuuugauuguauacaucauccucaugcugauuaaggauucgguuuuaauagugcaugcugacggaaccgauuucgagaaauguucuggcgaagucgacaucacauggaauugcaccggcccauuucugaaccuagggaauugugagaagaaacagaagaaagaauccuauaacaauauugcgacucaacucaagggacuggaugcaaucucagugcuugacauuccgaugaucaguaagauacccgaggauaucgccggugcuuugcgguucauugaggaacagcguagcuaccacguccagcugacggccgaguacgcaaugcucacacgcuauugcgacuacuauacccaguuuacugacaacuccggcuacucucaaaccacauggagaguguaucugaggagccaugauuucaaagccuguauccuuuacccuaaucagcacuuuugccgguguguuaagcacggggacaaaugcucaaguuccaacugggauuucgcuaaugaaaugaagaacuauuacagcggaaaacagucuaaguuugacaaggaucugaauuuggcccucaugucacugcaucacgcauuccgaggcaccaguagcuucuacauugcgaaauuacugaaggagaaaaagaacgaagaccuagugacuuaugcugagaaaaucaaggguaaauacccagggaaugcccuccugaaggcaauaauugauuauaucaaguacauggaggaccuuacagaaaugaacaauuuuaaacaugaugagaugugggacgauuucauuuuugaaguacccccuacgaaguccccaucuauccgcagauuggagucgagcuaugacuucaaaaccaacgucaacuccaaucccucacacauauguaagaacaucaaaacugugguuugccugaguccgaagucuggcgugagcuacgauuccauuaucgccuguggagaaccuucacagcccagcauuuauaggaagccagacucucaagucuuucaguccaaugcugaccagacacacuucugccucagugauacccauugccuggagaacuacgagacagugggcgaagagaucauagacgccauuaaaaagagcaaauguugggaaacugaguuuaccgaguacauccaguucaagcaaucugaugggguacgguccugccgcaugaaagacucaggagaauguacggugaccacaaauagauggccuaucauuuuaugcgauaacgacaaguuuuauuacagugagcugcagaaggauuaugacaaagaucaggacaucggucacuucugucuuagccccaggugcaauacuauucgucauccaauaaaccggaagcacaucucgaauuguaccuggcagguuucccauaacaauauugauaaaaucgaaguccacgaguuggaagaccucgagcaauacaagaaagcaauuacacagaagcugcagacuucucuaacccuguuuaaguauagcaaaacgaagaaccucccccacaucaaaccuauguacaaguauauaacaaucgagggcaccgaaacugcugaggggcuggaaucagccuacauugagagugaaaucccagcgcuugccggaacauccauuggcuucaaaaucaccucuaagagcgguaaacauuugcuggaugugauaggguacgugaaguccgcuucauauagcgcagucuacacuaaguuauauaccacaggcccgacgauuggaguuaauaccaaacacgacgagcucugcacuggccccuguccugugaacgugccacaugggacaggauggcugaccuuugccaaggagcgaacaaguucuugggguugcgaagaguucggcugucuugcuaucuccgacgggugcguauucggaagcugccaagauaucauuaaagacgaaauaacugucuacagaaaggagaccgaagagacgacagauguggagcuguguuugaccuuugccgacaaaacuuauugcaccaaucucaacgcaaucacacccauuaucacugaucaguucgaaguucaguuuaagaccguggaggcguacucgcugccuaggauuaucgccguccgcaaccacgaaauaauggugggccagaucaaugacauugguguuuauucaaagggguguggcaacgugcaaaaaguaaauaacacaaauuacggaaacggcgucccaaaguucgauuaccuaugccaucuggcuucucggaaagaggugaucgugagaaaguguuuugacaaugauuaucaggccugcaaauuccuccagacgcccgcaaguuacaggcuggaggaagaagggggauccgucaccguuauugacuauaagaagauccuuggcacuauaaaaaugaaggcuauuuugggugaugugaaauacaagacauuugccgacaacguagaccugaccguggaaggggucuguacuggaugcaucaauuguuucgagaacauccacugcgaauuaacaauucacagcaccguggaggcaucuuguccgguugugagcuccugcacggucuuucaugaucgcauccucauaacuccuaaugagcacaaauaugccauuaaggugaucugcaacgaaaagccaggccccacccugccuuucaaaauuuguucagcuaagacagacgcggccaugacccuugcagaugcuaaacccauccuggagcuagccccaguugaccagacuacauacauaaaggaaaaagaugagcgaugcaagaccuggaugugucgggugcgugacgaagguuuucaagucauuuucgagccuuucaagaaucucuuuggcaguuauaucgggaucuucuacacauuuauuaucagccugauggccauuuucauaguaaucuacauuguguugcccaucugcuuuaaacugagagauacuuuaaggcagcaugaggacgcuuauaagcgcgaaaugaaaauccgguga

SEQ ID NO: 10971 - RNA, 4323 nt, Artificial Sequence
  derived and/or modified CDS sequence (opt3) from TAHV__AF229129.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccgaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauauggggacgcagccggacuccugacccacaggaagacauacaacugccuugugcaguauaaaagcaaguggcugacuaacuuuuugauuggcuacaucauccucaugcugauuaaggauucgguauuacugguucaugcugacggcaccgauuucgaaaaauguucuggggaggcggacauaacauggaauugcaccggaccauuucuaucccucgguaacugugaaaagaaacagaagaaagagucauauaauaacaucgcaacucaacugaagggccuugaugccauuaguguguuggacaucccgaugauuagcaagauccccgaagauauagcuggggcccugcgguucaucgaggagcagcguuccuaccacguccagcucacggcagaauacgccaugcugacacgcuauugcgacuacuauacccaguuuacugacaauucuggauacagccaaaccacauggagaguguaucuuaggucacaugauuucgaggcuuguauucuguacccuaaccggcacuuuugccgaugugucaaacacggcgacaagugcaguuccagcaauugggauuucgccaacgaaaugaaaaauuauuacucugguaagcagucaaaauuuaacaaggacuugaaucucgcacugaugaguuuacaucacgcguuccgcgggaccagcuccuucuacaucgcuaagcugcuaaaagagaagaaaaacgaagaucucgugacuuaugccgagaagauuaaaggcaaguacccaggaaaugcacugcuuaaagccaucauagacuauauuaaguacaugaagggcuugacagagaugaacaauuuuaaacaugaugaaaugugggacgauuucaucuuugagguucccccuacgaagucuccaucggugagaaggcuggaaagcuccuaugacuucaaaaccaacguaaacucaaaucccagucacauuuguaagaacaucaaaacugucgugugccucucuccaaagagcgggguuuccuacgauucaauaaucgcuuguggagagccuagccagcccucuauuuaucggaagccagacucccagguguuucaaaguaaugccgaucagacacacuucugccugagcgacacccauugcuuagaaaacuacgagacagucggugaggaaaucauugacgcaaucaaaaagucuaaauguugggagacugaauuuaccgaguacacgcagcugaagcaguccgauggcgugcgcucaugcagaaugaaagacaguggggaguguaccguaacaacuaauagguggccuauaauucuuugcgauaacgacaaguucuauuacagcgaauugcaaaaggauuaugacaaagaucaggacaucggacacuuuugucucucgccccguugcaauaccauccggcauccaauuaaccgaaagcacaucuccaauuguacauggcaagugaaccauaauaacauugauaaaauagagguucacgaacuggaggaccuagaacaguacaagaaagcuaucacucaaaagcugcagaccucucucacgcuguucaaguauagcaaaacaaagaaucuuccccacauuaaaccuauguacaaguauaucaccauugagggcacugagacagccgaagguaucgagucagcguacauagaaagugagaucccagccuuggcugggaccuccauuggcuuuaaaaucacuucuaagagcggaaaacaucuguuagaugucauuggcuacgugaaguccgcaucauauagcgccguguacaccaagcucuauacaacggggccgaccaucggagucaacacuaaacacgacgaacugugcacaggucccuguccuguuaaugugccacauggcaccggguggcuuacauucgcuaaggagagaaccaguucuuggggaugcgaggaauuuggcugucuggccauauccgaugguugcguguucgggagcugccaggacauuaucaaagacgagaucacuguauacaggaaggaaacggaggaaacaaccgaugucgaguugugucucacuuucgcagacaaaaccuauugcacaaaccugaacgcgauuacucccauaaucaccgaucaauuugaggugcaguucaagacaguugaagccuacucgcuaccucgcauuaucgcugugcggaaucacgagauuauggucggccagaucaacgacauaggaguguauucaaagggcugugggaauguucagaaagugaacaauacgaacuacggaaauggcgccccaaaguuugauuaccugugccaucucgcaucuagaaaagaaguaaucgucaggaaguguuucgacaacgauuaucaggcuugcaaauuucugcagacccccgccaguuaccgccuugaggaggaagguggguccgugacugugauugacuauaagaagaucuugggaacaauuaaaaugaaggcaauccugggcgaugucaaauacaagaccuucgccgacaauguugauuuaacuguggaggguguauguacaggcugcgugaacuguuuugaaaauauacacugcgagagcaccauucacucuacggucgaagcuagcuguccggugaucuccucaugcacuguuuuccaugaccgaauccucauuaccccuaacgagcacaaauaugcgaucaaggugauaugcaaugagaagccagggcccacacugccuuuuaaaauuuguagugccaagaccgacgcagcuaugacucuugccgaugccaaacccauccuggaacuagcuccagucgaccagacaaccuacauuaaggagaaaguggaacggugcaagacauggaugugucguguuagagaugagggauuccaggugaucuuugaaccuuucaagaaccucuucggcagcuauauagggaucuuuuacacuuucauuaucucucugauggcaauuuuuaucgucauuuacauaguauugcccaucugcuucaaacugagggacaccuuacgccaacaugaggaugccuauaagcgggagaugaaaauuagauga

SEQ ID NO: 10972 - RNA, 4323 nt, Artificial Sequence
  derived and/or modified CDS sequence (opt3) from TAHV(22595-6)__HM036218.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccaaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauaugaagacgcagccgggcuccugacccacaggaagacauacaacugccuugugcaguauaaaagcaaguggcugacuaacuuuuugauuguauacaucauccucaugcugauuaaggauucgguuuuaauagugcaugcugacggaaccgauuucgagaaauguucuggcgaagcggacaucacauggaauugcaccggcccauuucugaaccuagggaauugugagaagaaacagaagaaagaauccuauaacaauauugcaacucaacucaagggacuggaugccaucucaguccuugacauuccgaugaucaguaagauacccgaggauaucgcuggugccuugcgguucauugaggaacagcguagcuaccacgugcagcugacggcagaguacgccaugcucacacgcuauugcgacuacuauacccaguuuacugacaacuccggcuacucucaaaccacacugagagucuaucuuaggagccaugauuucaaggcuuguauccuguacccuaaucagcacuuuugccggugugugaaacacggggacaaaugcucaaguuccaacugggauuucgccaaugaaaugaagaacuauuacagcggaaaacagucuaaguuugacaaggauuugaaucucgcacugaugucauuacaucacgcguuccgaggcaccaguagcuucuacauugcuaaacugcuaaaggagaaaaagaacgaagaccucguuacuuaugccgagaaaaucaaggguaaauacccagggaaugcacugcuuaaggccauaauugauuauaucaaguacauggaggacuugacagaaaugaacaauuuuaaacaugaugagaugugggacgauuucauuuuugaagugcccccuacgaaguccccaucuauccgcagacuggagucgagcuaugacuucaaaaccaacguaaacuccaaucccucacacauauguaagaacaucaaaacugucgugugccucaguccgaagucuggcguuagcuacgauuccauuaucgcuuguggagaaccuucacagcccagcauuuauaggaagccagacucucaaguguuucaguccaaugccgaccagacacacuucugccugagugauacccauugcuuagagaacuacgagacagucggcgaagagaucauagacgcaauuaaaaagagcgaauguugggagacugaguuuaccgaauacauccaguucaaacaaucugauggggugcgguccugccgcaugaaggacucaggagaguguacgguaaccacaaauagauggccuaucauucugugcgauaacgacaaauuuuauuacagugaacuucagaaggauuaugacaaggaucaggacaucggucacuucuguuugagccccaggugcaauacuauucgucauccaauaaaccggaaacacaucucgaauuguaccuggcaagugucccauaacaauauugauaagaucgagguucacgaacucgaggaccuggagcaguacaaaaaggcuauuacacagaaacuacagacuucucugacccucuuuaaguauagcaagacgaaaaaccugccccacaucaagccuauguacaaauauauaacaaucgaaggcaccgagacugccgaagggauugagucagcguacaucgaaagugagauuccagcccuugcuggaacauccaucggcuucaagauaaccucuaaaagcgguaagcauuugcuggaugucauuggguacgugaaauccgcaucauauagcgccguguacacuaaguuauauaccacaggcccgacgaucggagucaauaccaagcacgacgagcucugcacuggccccuguccuguuaacgugccacaugggacaggauggcugaccuuugcuaaagaacgaacaaguucuugggguugcgaggaguucggcugucuugccaucuccgacgggugcguguucggaagcugccaagauauuauaaaggacgaaaucacuguauacagaaaagaaaccgaggagacgacagaugucgaacuguguuugaccuuugcagacaagacuuauugcaccaaucucaacgcgauuacacccaucauuacugaucaguucgaggugcaguuuaaaaccguugaagccuacucgcugccuaggaucauagcugugcgcaaccacgagaucauggucggccagauuaaugacaucgguguguauucaaagggguguggcaacguucaaaaggugaauaacacaaauuacggaaacggcguaccaaaauucgauuaccuaugccaucuggccucucggaaggaggucauugugagaaaauguuuugacaaugauuaucaggcaugcaaguuccuccagacgcccgcuaguuacaggcuggaagaggaagggggauccgugaccgucaucgacuauaaaaagauacuuggcacuauuaagaugaaagccaucuugggugauguuaaguacaaaacauuugcagacaacguggaccugaccguagaggggguguguacuggaugcaucaauuguuucgaaaacauucacugcgaguuaacaauccacagcaccgucgaggccucuuguccggugguuagcuccugcacgguguuucaugaucgcauacucauuacuccuaaugaacacaaguaugcuaucaaagucauuugcaacgagaagccaggccccacccugccuuucaagaucuguucagcgaaaacagacgccgcaaugacccuugcugaugccaagcccauacuggaacuagccccaguggaccagacuacauacauuaaagagaaggaugaacgaugcaaaaccuggaugugucggguucgugacgaggguuuucaagugaucuucgagccuuucaagaaucucuuuggcaguuauaucgggauuuucuacacauuuaucauuagccugauggcuauauucaucgucauuuacaucguauugcccaucugcuuuaagcugagagauacuuuaaggcagcaugaagacgcauauaaacgcgagaugaagauucgguga

SEQ ID NO: 10973 - RNA, 4323 nt, Artificial Sequence
  derived and/or modified CDS sequence (opt3) from TAHV(92' Bardos)__HM036209.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggagaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccaaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacaauauguuaaguauggcaaugaaggugaacauguacuauaucaugugcaugauuaauuacgcugucaccuggucuuucauacugugugcccuccuuaucgcucuguuguuuaagaaauaucagcaccgcuuccuaaacuuuuacgccauguacugccacgagugugacauguaucaugaucgauccggacugaaguacaaugaagacuucacaaacaaaugcagacaguguacuugcggccaauaugaggaugcagccggucuccugacccacaggaagacauacaacugccuugugcaguauaaaagcaaguggcugacuaauuucuugauuguauacaucauccucaugcugauuaaggacucgguuuuaauagugcaugcugaugggaccgacuucgaaaaauguucuggagaggcggauaucacauggaacugcaccggcccauuucugaaucuaggcaacugugaaaagaaacagaagaaagaguccuauaauaacauugcaacucaacucaaggggcuggacgccaucucaguccuugauauuaguaugaucagcaagauaccggaggacaucgcuggagccuugcgguucauugaagaacagcguuccuaccacgugcagcugacggcagaauacgccaugcucacacgcuauugcgauuacuauacccaguuuacugacaauucugguuacagccaaaccacauggagagucuaucugaggucacaugacuucgaggcuuguauccuuuaccccaaccagcacuuuugccggugugugaaacacggcgauaagugcaguuccagcaauugggacuucgccaacgaaaugaaaaauuuuuauucugggaagcagucaaaauucgauaaggaccugaacuuggcacucaugagucugcaucacgcguuccgaggaaccagcuccuuuuacauugcuaaguuacugaaagagaagaaaaaugaggaucuaguuacuuacgccgaaaagaucaaaggcaaguauccugguaacgcacuccugaaagccauaauugacuacaucaaguauauggaggaucuuacagaaaugaauaacuucaaguacgacgagaugugggaugacuuuauuuucgaagugccacccacgaaaucuccuucgauccgcagauuggagagcuccuaugauuuuaagaccaacguaaauucaaacccaagucauauauguaaaaauaucaagacugucgugugccugucucccaaaagcgggguuuccuacgacucaauuaucgcuuguggcgagccgagccagccuucuauuuauaggaagcccgauucccaaguguuccagaguaacgccgaccagacacacuuuugccucagcgacacccacugccuggaaaauuacgagacagucggagaagagaucauagaugcaauuaagaaaucuaaguguugggagacugaauuuaccgaguacauccaguuuaaacaauccgacggcgugcggucaugccgcaugaaggauaguggggaauguacgguaaccacaaacagauggccaaucauuuuaugcgacaaugauaaauucuauuacagcgagcugcagaaggacuaugauaaggaccaggauaucggacauuuuugucuuucgccuaggugcaacacuauucgucaccccauaaaucggaaacauaucuccaacuguaccuggcaagugucucacaauaacauugacaagaucgaaguucaugaguuggaggaucucgaacaguacaaaaaggcuauuacacagaaacugcagacuagccuaacccuguucaaguauucaaagacgaaaaaucucccacacaucaagcccauguacaaauauauaacaaucgaggguaccgaaacugccgagggcauugaaagugcguacaucgaguccgagauuccugcccuggcugggacaucuaucggauuuaagauaaccagcaaauccggcaagcaccuuuuggacgucauugguuacgugaaaucagcaagcuauagugccguguacacuaagcuguauaccacagggccaacgaucggcgucaacaccaagcaugaugaauuaugcacuggaccgugucccguuaaugugccucacggcacaggguggcucaccuucgcuaaagagcgaacaucuuccuggggaugcgaagaguucgguugucuggccaucagcgacggcugcguguuugggucgugccaagacauuauaaaggaugaaaucacuguauacagaaaagagaccgaggaaacgacagacgucgagcuuugucugaccuucgcagauaagacuuauugcaccaacuugaacgcgauuacaccaaucauuacugaccaguuugaagugcaguucaaaaccguugaggccuacucacuccccaggaucauagcugugcgcaaucaugagaucauggucggacagauuaacgauaucggcguguauucuaaggguugugggaauguucaaaaggugaacaauacaaacuacggcaauggaguaccuaaauuugacuaccugugccaccuagccagucggaaggaagucauugugagaaaauguuucgauaacgacuaucaggcaugcaaguuucugcagacgccagcuuccuacaggcucgaggaagagggcgggagcgugaccgucaucgauuauaaaaagauacugggaacuauuaagaugaaagccauccuuggcgacguuaaguacaaaacauucgcagauaauguggacuugaccguagaagguguguguacugggugcaucaacuguuuugagaauauucauugcgagcugacaauccacucuaccgucgaagccagcugucccgugguuuccucaugcacgguguuccacgaccgcauauuaauuacuccgaacgagcauaaguaugcuaucaaagucauuugcaaugaaaagccuggaccaacccuccccuuuaagaucuguagugcgaaaacagaugccgcaaugacccuggcugacgccaagccuauacuugagcuggcccccguggaucagacuacauacauuaaagaaaaggacgagcgaugcaaaaccuggaugugucggguucgugaugagggcuuccaagugaucuucgaaccauuuaagaaccuauucgguagcuauaucggcaucuuuuacacauucauuauuucucucauggcuauauuuaucgucauuuacaucguacugccuaucugcuucaaguugagagacacucugaggcagcacgaggaugcauauaaacgcgaaaugaagauucgguga

SEQ ID NO: 10974 - RNA, 4323 nt, Artificial Sequence
  derived and/or modified CDS sequence (opt3) from TAHV(92' Bardos)__HM036212.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggagaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccaaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacgaucaaacucgaggaucugccugacgacauguuaaguaccgcaaugaaggugaauauguacuauauuaugugcaugauaaacuacgcugucacauggucuuucauccugugugcccuccuuauugcucuguuguucaagaaauaucagcaccgcuuucuaaauuucuacgccauguacugccacgagugugauauguaucaugaccgauccggacugaaguacaacgaagauuuuacuaauaaaugcagacaguguaccugcggccaauaugaggacgcagccggucuccugacacacaggaagacuuacaacugccuugugcaguauaaaagcaaguggcugaccaacuucuugaucguauacaucauucucaugcugauaaaggauucgguuuuaaucgugcaugcugacgggacagauuuugaaaaauguucuggagaggcggacauuaccuggaauugcacuggcccauuccugaaccuaggcaauugugaaaagaaacagaagaaagaguccuauaacaauaucgcaacgcaacucaaggggcuggaugccauuucaguccuugacaucaguaugauaagcaagaucccggaggauauugcuggagccuugcgguuuaucgaagaacagcguuccuaccacgugcagcugacagcagaauacgccaugcucacccgcuauugcgacuacuauacucaguucaccgacaacucugguuacagccaaacaaccuggagagucuaucugaggucacaugauuuuaaggcuuguauucuuuaccccaaucagcacuucugccggugugugaaacacggcgacaaaugcaguuccagcaacugggauucugccaaugagaugaagaacuuuuauucagggaaucagaguaaauucgacaaggaucugaacuuggcacucaugagccugcaucacgcguuucgaggaacuuccucuuucuacaucgcuaaguuacugaaagaaaagaaaaaugaggaccuaguuacauacgccgagaagauaaaaggcaaguauccugguaacgcacuccugaaagccauuaucgauuacauuaaguauauggaagaccuuacggagaugaauaacuucaaguacgaugaaaugugggacgauuuuaucuucgaggugccacccaccaaaucgccuagcauacgcagauuggaauccucauaugacuuuaagacuaacguaaauaguaacccaucucauaucuguaaaaauauuaagacagucgugugccugagccccaaauccgggguuucauacgauagcaucauugcuuguggcgagccgucucagccuuccaucuauaggaagcccgacagucaaguguuccagagcaacgccgaccagacccacuuuugccucucugauacacacugccuggagaauuacgaaacugucggagaggaaauaauugacgcaaucaagaaauccaaguguugggagaccgaguucacggaauacauccaguuuaaacaaucagauggcgugcggaguugccgcaugaaggacagcggggaguguaccguaacaacuaacagauggccaauuaucuuaugcgauaaugacaaauucuauuacucggaacugcagaaggauuaugacaaggaucaggacauuggacauuuuugucuuuccccuaggugcaacaccauacgucaccccaucaaucggaaacauauuucuaacuguacauggcaagugagccacaauaacaucgauaagauugagguucaugaauuggaggaccucgagcaguacaaaaaggcuaucacucagaaacugcagaccucacuaacgcuguucaaguauaguaagaccaaaaaucucccacacauaaagcccauguacaaauauaucacaauugaagguacugagacagccgaaggcaucgaguccgcguacauugaaucugagaucccugcccuggcugggaccagcauaggauuuaagauuacuuccaaaucaggcaagcaccuuuuggaugucaucgguuacgugaaaagcgcaaguuauucugccguguacaccaagcuguauacaacggggccaaccaucggcgucaacacuaagcaugacgaguuaugcacaggaccgugucccguuaaugugccucacggcaccggguggcucacauucgcuaaagaacgaacuuccagcuggggaugcgaggaauuugguugucuggccauuucggacggcugcguguucgggucaugccaagauauaaucaaggacgagauuaccguauacagaaaagaaacggaggagacaaccgaugucgaacuuugucugacuuucgcagacaagaccuauugcacaaacuugaacgcgaucacuccaauuaucaccgaucaguuugaggugcaguucaaaacaguugaagccuacucucuccccaggauaaucgcugugcgcaaucaugagauuauggucggacagaucaacgacauuggcguguauaguaaggguugugggaauguucaaaaggugaacaauacgaacuacggcaauggaguaccuaaauuugauuaccugugccaccuagccucccggaaggaggucaucgugagaaaauguuucgacaacgauuaucaggcaugcaaguuucugcagaccccagcuagcuacaggcucgaagaggaaggcgggucugugacugucauagacuauaaaaagauucugggaacaaucaagaugaaagccauccuuggcgauguuaaguacaaaaccuucgcagacaauguggacuugacuguagaggguguguguacagggugcauuaacuguuuugaaaauauccauugcgagcugaccauacacagcacggucgaggccuccugucccgugguuucaaguugcacuguguuccacgaucgcauuuuaaucaccccgaacgaacauaaguaugcuauuaaagucaucugcaaugagaagccuggaccaacacuccccuuuaagauauguagcgcgaaaaccgacgccgcaaugacucuggcugaugccaagccuauucuugaacuggcccccguggaccagacaaccuacaucaaagagaaggaugaacgaugcaaaacauggaugugucggguucgugacgagggcuuccaagugaucuuugagccauucaagaaccuauucgguucuuauauuggcaucuuuuacacuuucauuauaucccucauggcuaucuuuauugucaucuacaucguacugccuauuugcuucaaguugagagauacccugaggcagcacgaagacgcauauaaacgcgagaugaagauacgguga

SEQ ID NO: 10975 - RNA, 4323 nt, Artificial Sequence
  derived and/or modified CDS sequence (opt3) from TAHV(Souche D C14019-29)__HM036215.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuucaagaaugccacugggacguacgcaaacaaugucgccauccggaaauggcuggugagugauuggcacgacugccgcccaaagaagguuagcggaggucauauuaacgugaucgaggucggcgaugacuugaccuuacacacagaggcuuauguguguaaugcagauugcacuauugggguagacaaagagaccgcccagguucgacugcaaacagauaccacuaaccauuuugaaaucgcuggaacaaccgugaaguccggcugguucaaaucuacgacuuacauaacccuagaccagacaugugagcaccucaaggucucgugcgguccgaaaucaauccaguuucaugccuguuucaaucagcacaugagcugcgugcguuuucugcacagaacuauucuucccgggaguaucgcguccucuauuugucaaaacguggagaucauaauucugaccgucuugacacuccugaucuucauucugcucagcaucuuauccaagaccuauaucugcuacauucugaugccuauauuuaucccacuugcauauauuuacggaguuaucuacaauaagucauguaaaaagugcaaauugugcggccugguguaucaucccuucacggaauguggcacucacugcguauguggggccagguacgagacaagugaucggaugaagcuacaucgcgcuagcggacucugcccugguuauaaaucucugagagccgcaagggugauguguaaguccaaaggcccagcuucaauacuuagcauuaucaccgccguccugaucuugacuuuugugacacccauuaacgcgaugguugccggggacacccaggaaacguucaagcucgaggaucugccugacgacauguuaaguauggcaaugaaggugaauauguacuauaucaugugcaugauuaacuacgcugucaccuggucuuucauacugugugcccuccuuaucgcucuguuguuuaaaaaguaucagcaccgguuccuaaauuuuuacgccauguacugccacgagugugauauguaucaugaccgcuccggacugaaauacaacggcgauuucacaaauaagugccgacaguguacuugcggucaauaugaagacgcagccgggcuccugacccacagaaaaacauacaacugccuugugcaguauaagagcaaguggcugacuaacuuuuugauuguauacaucauccucaugcugauugaggauucgguuuuaauagugcaugcugacggaaccgauuucgaaaaauguucuggcgaggcggacaucacauggaauugcaccggcccauuucugaaccuagggaauugugaaaagaaacagaagaaagaguccuauaacaauauugcaacucaacucaagggacuggaugccaucucaguccuugacauuccgaugaucaguaagauacccgaggauaucgcuggugccuugagguucauugaagaacagcggagcuaccacgugcagcugacggcagaauacgccaugcucacacguuauugcgacuacuauacccaguuuacugacaacuccggcuacucucaaaccacauggcgcgucuaucugagaagccaugauuucgaggcuuguauccuuuacccuaauaggcacuuuugccggugugugaaacacggggacaagugcucaaguuccaacugggauuucgccaaugaaaugaaaaacuauuacagcggaaagcagucuaaauuuaauaaggaccugaacuuggcacucaugucacugcaucacgcguuccgaggcaccaguagcuucuacauugcuaaguuacugaaagagaagaaaaaugaggaucuaguuacuuaugccgaaaagaucaaagguaaguacccagggaacgcacuccugaaagccauaauugacuauaucaaguacaugaaggaucuuacagagaugaauaacuuuaaacaugacgaaaugugggaggauuucauuuuugaagugcccccuacgaaguccccaucuguacgcagauuggagucgagcuaugacuucaaaaccaacgucaauuccaaccccucacacaucuguaagaauauaaaaacugugguuugccugaguccgaagucuggcgugagcuacgauuccaucauugcuuguggagagccuucacagcccagcaucuauaggaagccagacucucaggucuuucaauccaacgccgaucagacacacuucugccucagugacacccauugccuggaaaauuacgagacagugggcgaagagauuaucgacgcaauuaaaaagagcaaauguugggagacugaauuuaccgaguacauacaguucaagcagucugaugggguacgguccugccgcaugaaagacucaggagaauguacgguggcuaccaacagauggccuaucaucuuaugcgauaauaacaaguuuuauuacagugagcugcaagaagacuaugauaaggaccaggauauuggucacuucugucuuagccccaggugcaauacaauccgucauccaauuaaccggaaacacauaucgaauuguacuuggcagguuucccauaacaauaucgacaagauugagguccacgaguuggaagaucucgagcaguacaaaaaggccaucacccaaaaacugcagacaucucuaacucuguuuaaguauagcaagaccaaaaaccucccccacauuaagccuauguacaaauauaucacgauagaaggcacagagaccgcggaagggaucgagucagccuacauugagagugaaaucccagcucuggcaggaacuuccauuggcuucaagaucacaucuaaaagcgguaagcaucuuuuggacgugauaggguacgugaaauccgccucauauagcgcugucuacaccaagcuguauacuaccggcccgacaauuggaguuaauacgaagcacgaugaguuaugcaccggccccuguccugugaacgugccacaugggacuggauggcucacauuugccaaagaacgaaccaguucuugggguugcgaggaguucggcugucuggcaaucuccgacgggugcguauucggaagcugccaggauaucauuaaggacgaaauaacagucuacagaaaagagacugaagagaccacggacguggaacuuugucugacauuugcggauaagaccuauugcacuaacuugaaugccaucacccccauuaucacagaccaauucgagguucaguuuaaaacuguggaggcuuacucgcucccuaggauuaucgccguccgcaaccacgaaauaauggugggccagaucaaugauauugguguuuauucaaagggguguggcaacgugcagaagguaaauaacaccaauuacggaaacggcgucccaaaauucgacuaccugugccaucuagcaucucggaaggaggugaucgugagaaaauguuuugauaaugacuaucaggcuugcaaguuccugcaaacacccgccaguuacaggcucgaagaggaagggggauccgucacgguuauugauuauaaaaagauccugggcaccauaaagaugaaagcaauucuuggugacgugaaguacaaaacuuuugccgauaacguagacuugacaguggagggggucuguaccggaugcaucaauuguuucgagaacauccacugcgaacugacuauucacagcacaguggaggcuucuuguccgguugugagcuccugcaccgucuuucaugaucgcaucuuaauaacgccuaaugaacacaaguaugcgauuaaagugaucugcaacgagaagccaggccccauucucccuuucaagaucuguucagccaaaacugacgcagcuaugacccuggccgacgccaagcccauacuugaacuggcuccaguugaucagacaaccuacauuaaagagaaggacgagcgaugcaaaacuuggaugugucgggugcgugaugaagguuuucaggucaucuucgagccuuucaagaaucuauuuggcaguuauaucgggauuuucuacacauuuaucauuagccucauggcaauauucaucguaauuuacaucgugcugcccaucugcuuuaagauuagagacaccuugaggcaacaugaagaugccuauaaacgcgagaugaagauacgguga

SEQ ID NO: 10976 - RNA, 4323 nt, Artificial Sequence
  derived and/or modified CDS sequence (opt3) from TAHV(1014)__GQ386833.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccgaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcgguaaguaugaagacgcagccgggcuccugacccacaggaaaacauacaacugccuugugcaauauaagagcaaguggcugacuaacuuuuugauuguauacaucauccucaugcugauuaaagauucgguuuuaauagugcaugcugacggaaccgauuucgagaaguguucuggcgaagcggacaucacauggaauugcaccggcccauuucugaaccuagggaauugugagaaaaagcagaaaaaggaauccuauaacaauauugcaacucagcucaagggacuggaugccaucucaguccuugacauuccgaugaucaguaaaauacccgaggauaucgcuggugccuugcgguucauugaggaacaacguagcuaccacgugcagcugacggcagaguacgccaugcucacacgcuauugcgacuacuauacccaguuuacugacaacuccggcuacucucagaccacauggagagucuaucugaggagccaugauuucgaggcuuguauccuuuacccuaaucaacacuuuugccggugugugaagcacggggacaaaugcucaaguuccaacugggauuucgccaaugaaaugaagaacuauuacagcggaaaacagucuaaguuugacaaggaucugaauuuggcacucaugucacugcaucacgcguuccgaggcaccaguagcuucuacauugcuaaauuacugcgcgaaaagaaaaacgaggaccuaguuacuuauguggagaagaucaaagguaaguacccagggaaugcccuccugaaagcaauaauugauuauaucaaguacaugaagggccuuacagaaaugaacaauuccaaacaugacgagaugugggaugacuuuauuuucgaaguacccccuacgaagucuccaucggucagaagguuggagagcuccuaugauuuuaaaaccaacgugaacucaaaucccagucacaucuguaagaacauaaaaacuguugugugccugucuccaaagagcggagucuccuacgacucaaucauugccuguggcgaaccuagccagcccucuaucuaucggaagccagauucccagguguuccaaaguaaugcugaccagacacacuuuugccucagcgacacccauugccuggagaacuucgagacaguaggggaagagauuaucgaugccauuaaaaagucuaaauguugggaaacugaguuuaccgaguacauucaguucaagcaguccgacggagugcgcucaugcagaaugaaagauaguggugaauguacgguuaccacaaauagguggccuaucaucuuaugcgacaacgauaaguuuuacuauagcgagcugcaaaaggacuacgauaaaggccaggacauugggcacuucugucuuucgccccguugcaauacuauccggcauccaauuaaccgaaagcacauauccaauuguaccuggcaggucaaccauaauaacaucgauaaaauugaagugcacgaguuggaagaccucgagcaguauaagaaagcaaucacacaaaagcugcagacuucucuaacccuguuuaaguacagcaaaacgaagaaucucccccacauuaaaccuauguauaaguacaucacaauagagggaaccgaaacugcugagggcaucgaaucagccuauauugagagugaaaucccagcgcuggccgguacauccauuggguucaaaaucaccucuaagagcggcaaacaucuuuuggaugugauaggauacgucaaguccgcuucauacagcgcaguuuauacuaagcuguacaccacaggcccgacgauuggggugaacaccaaacacgacgaguuaugcacuggacccuguccugugaauguaccacaugguacaggcuggcucaccuuugccaaggagagaacaaguucuugggggugcgaagaguucggaugucuggcuaucuccgauggcugcgucuucgguagcugccaggacaucauuaaagacgaaauaacuguguauaggaaggagaccgaagagacgacagauguugagcuuugucugaccuuugccgacaaaacuuacugcaccaacuugaacgcaaucacacccauuaucacugaucaauucgaagugcaguuuaagaccgucgaggcguauucgcucccucgcauuaucgccgugcggaaucacgaaauaaugguugggcagaucaacgacauuggcguguacucaaagggauguggcaauguacagaaagucaacaauacaaacuaugggaauggagugccaaaguucgauuaccugugccaucuagcuucuagaaaagaggugaucgucaggaaguguauugacaacgauuaccaagccugcaaauuucugcagacgcccgcaaguuaucgccucgaggaagagggcgguuccguuaccgugaucgacuacaagaagauacuggggacuauuaaaaugaaggcuauccuuggagauguaaaauauaagacauucgccgacaauguggauuugaccgucgaaggcguguguacugguugcaucaacuguuuugagaauauucacugcgaacugacaauccacagcaccguugaggcaucuuguccgguggucagcuccugcacgguguuccaugaccgaauauuaauuacuccuaacgagcacaaauacgccaucaagguuauuugcaaugaaaagccaggccccacccucccuuuuaaaaucuguucagcuaagacagacgcggccaugacccuggcagaugcuaaacccauacuugagcuggccccaguggaccagacuacauauauuaaggaaaaagaugagcggugcaagaccuggaugugucgugucagagacgaaggguuccagguaaucuuugagccuuucaagaaccuauucggaaguuacaucggcauauuuuauacauucaucauuagccucauggccauauuuaucgugauuuacaucguucugcccaucugcuucaaauugagggauacucugcgccaacaugaggacgcuuacaagcgggaaaugaaaauuagauga

SEQ ID NO: 10977 - RNA, 4323 nt, Artificial Sequence
  derived and/or modified CDS sequence (opt3) from TAHV(105)__GQ386829.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggagaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccaaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauaugaagacgcagccgggcuccugacccacaggaagacauacaacugccuugugcaguauaaaagcaaguggcugacuaacuuuuugauuguauacaucauccucaugcugauuaaggauucgguuuuaauagugcaugcugacggaaccgauuucgagaaauguucuggcgaagcggacaucacauggaauugcaccggcccauuucugaaccuagggaauugugagaagaaacagaagaaagaauccuauaacaauauugcaacucaacucaagggacuggaugccaucucaguccuugacauuccgaugaucaguaagauacccgaggauaucgcuggugccuugcgguucauugaggaacagcguagcuaccacgugcagcugacggcagaguacgccaugcucacacgcuauugcgacuacuauacccaguuuacugacaacuccggcuacucucaaaccacauggagagucuaucugaggagccaugauuucgaggcuuguauccuuuacccuaaucagcacuuuugccggugugugaaacacggggacaagugcucaaguuccaacugggauuucgccaaugaaaugaaaaacuauuacagcggaaagcagucuaaauuugacaaggaucugaauuuggcacucaugucacugcaucacgcguuccgaggcaccaguagcuucuacauugcuaaguuacugaaagaaaagaaaaacgaggaccuaguuacuuaugccgagaagaucaaagguaaguacccagggaaugcacuccugaaagccauaauugauuauaucaaguacaugaaggaccuuacagaaaugaacaauuuuaaacaugaugagaugugggacgauuucauuuuugaagugcccccuacgaaguccccaucuguacgcagauuggagucgagcuaugacuucaaaaccaacgucaacuccaaucccucacacaucuguaagaacauaaaaacugugguuugccugaguccgaagucuggcgugagcuacgauuccaucauugcuuguggagaaccuucacagcccagcaucuauaggaagccagacucucaagucuuucaguccaaugccgaccagacacacuucugccucagugauacccauugccuggagaacuacgagacagugggcgaagagauuaucgacgcaauuaaaaagagcaaauguugggaaacugaguuuaccgaguacauacaguucaagcaaucugaugggguacgguccugccgcaugaaagacucaggagaauguacggugaccacaaauagauggccuaucaucuuaugcgauaacgacaaguuuuauuacagugagcugcagaaggauuaugacaaagaucaggacauuggucacuucugucuuagccccaggugcaauacuauccgucauccaauuaaccggaagcacauaucgaauuguaccuggcagguuucccauaacaauaucgauaaaauugaaguccacgaguuggaagaccucgagcaauacaagaaagcuaucacacagaagcugcagacuucucuaacccuguuuaaguauagcaaaacgaagaaccucccccacauuaaaccuauguacaaguauaucacaauagagggcaccgaaacugccgaggggaucgaaucagcguacauugagagugaaaucccagcccuggcuggaacauccauuggcuucaaaaucaccucuaagagcgguaaacaucuuuuggaugugauaggguacgugaaguccgcaucauauagcgccgucuacacuaagcuguauaccacaggcccgacgauuggaguuaauaccaaacacgacgaguuaugcacuggccccuguccugugaacgugccacaugggacaggauggcucaccuuugcuaaggagcgaacaaguucuugggguugcgaagaguucggcugucuggccaucuccgacgggugcguauucggaagcugccaagauaucauuaaagacgaaauaacugucuacagaaaggagaccgaagagacgacagauguggagcuuugucugaccuuugcagacaaaacuuauugcaccaauuugaacgcgaucacacccauuaucacugaucaguucgaaguucaguuuaagaccguggaggccuacucgcucccuaggauuaucgcuguccgcaaccacgaaauaauggugggccagaucaaugacauugguguuuauucaaagggguguggcaacgugcaaaaaguaaauaacacaaauuacggaaacggcgucccaaaguucgauuaccugugccaucuagccucucggaaagaggugaucgugagaaaguguuuugacaaugauuaucaggcaugcaaauuccugcagacgcccgcuaguuacaggcucgaggaagaagggggauccgucaccguuauugacuauaagaagauccugggcacuauaaaaaugaaggccauucuuggugaugugaaauacaagacauuugcagacaacguagacuugaccguggaaggggucuguacuggaugcaucaauuguuucgagaacauccacugcgaacugacaauucacagcaccguggaggccucuuguccgguugugagcuccugcacggucuuucaugaucgcaucuuaauaacuccuaaugagcacaaauaugcuauuaaggugaucugcaacgaaaagccaggccccacccucccuuucaaaauuuguucagcgaagacagacgccgcaaugacccuggcugaugccaaacccauccuugagcuggccccaguugaccagacuacauacauaaaggaaaaagaugagcgaugcaagaccuggaugugucgggugcgugacgaagguuuucaagucauuuucgagccuuucaagaaucuauuuggcaguuauaucgggaucuucuacacauuuauuaucagccucauggcuauuuucauaguaaucuacauugugcugcccaucugcuuuaaauugagagauacucugaggcagcaugaggacgcauauaagcgcgaaaugaaaauccgguga

SEQ ID NO: 10978 - RNA, 4323 nt, Artificial Sequence
  derived and/or modified CDS sequence (opt3) from TAHV(106)__GQ386830.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggagaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccgaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauaugaagacgcagccgggcuccugacccacaggaagacauacaacugccuugugcaguauaaaagcaaguggcugacuaacuuuuugauuguauacaucauccucaugcugauuaaggauucgguuuuaauagugcaugcugacggaaccgauuucgagaaauguucuggcgaagcggacaucacauggaauugcaccggcccauuucugaaccuagggaauugugagaagaaacagaagaaagaauccuauaacaauauugcaacucaacucaagggacuggaugccaucucaguccuugacauuccgaugaucaguaagauacccgaggauaucgcuggugccuugcgguucauugaggaacagcguagcuaccacgugcagcugacggcagaguacgccaugcucacacgcuauugcgacuacuauacccaguuuacugacaacuccggcuacucucaaaccacauggagagucuaucugaggagccaugauuucgaggcuuguauccuuuacccuaaucagcacuuuugccggugugugaaacacggggacaagugcucaaguuccaacugggauuucgccaaugaaaugaaaaacuauuacagcggaaagcagucuaaauuugacaaggaucugaauuuggcacucaugucacugcaucacgcguuccgaggcaccaguagcuucuacauugcuaaguuacugaaagaaaagaaaaacgaggaccuaguuacuuaugccgagaagaucaaagguaaguacccagggaaugcacuccugaaagccauaauugauuauaucaaguacaugaagggccuuacagaaaugaacaauuuuaaacaugacgagaugugggaugacuucauuuccgaagugcccccuacgaagucuccaucgguacgcagauuggagagcuccuaugauuuuaaaaccaacgucaacucaaaucccagucacaucuguaagaacauaaaaacugugguuugccugucuccaaagagcggaguguccuacgacucaaucauugcuuguggcgaaccuagccagcccucuaucuauaggaagccagauucccaagucuuccagaguaaugccgaccagacacacuuuugccucagcgacacccauugccuggagaacuacgagacagugggggaagagauuaucgaugcaauuaaaaagucuaaauguugggaaacugaguucaccgaguacauacaguuuaagcaauccgacggaguacggucaugccgcaugaaagauaguggugaauguacggugaccacaaauagauggccuaucaucuuaugcgacaacgauaaguucuauuacagcgagcugcagaaggacuaugauaaagaccaggauauuggccacuuuugucuuucgcccaggugcaauacuauccgucauccaauuaaccggaagcacauauccaauuguaccuggcagguuucucauaacaauaucgacaaaauugaaguccacgaguuggaagaucucgagcaauacaagaaagcuaucacacagaagcugcagacuagccuaacccuguucaaguauucaaaaacgaagaaccucccccacauuaaaccuauguacaaguauaucacaauagaggggaccgaaacugccgagggaaucgaaagugcguacauugaguccgaaaucccagcccuggcuggcacaucuauugguuuuaaaaucaccagcaaguccgggaaacaucuuuuggacgugauaggcuacgugaagucagcaagcuauagugccgucuacacuaagcuguauaccacaggaccgacgauugauguuaauaccaaacacgacgaguuaugcacuggccccuguccugugaacgugccacaugggacaggauggcucaccuucgcuaaggagcgaacaucuuccugggguugcgaagaguuuggcugucuggccaucagcgacgggugcguauucggaucgugccaagauaucauuaaagacgaaauaacugucuacagaaaggagaccgaagagacgacagauguggagcuuugucugaccuucgcagacaaaacuuauugcaccaauuugaacgcgaucacacccauuaucacugaucaguuugaaguucaguucaagaccguggaggccuacucacucccuaggauuaucgcuguccgcaaccacgaaauaauggugggccagaucaaugacauugguguuuauucuaagggguguggcaacgugcaaaaaguaaauaacacaaauuacggaaacggcgucccaaaguuugauuaccugugccaucuagccagucggaaagaggugaucgugagaaaguguuucgacaaugauuaucaggcaugcaaauuucugcagacgcccgcuuccuacaggcucgaggaagaagggggaagcgucaccguuauugacuauaagaagauccugggcacuauaaaaaugaaggccauucuuggugaugugaaauacaagacauucgcagacaacguagacuugaccguggaaggggucuguacuggaugcaucaauuguuuugagaacauccacugcgaacugacaauucacucuaccguggaggccagcuguccgguuguguccucaugcacggucuuccaugaucgcaucuuaauaacuccuaaugagcacaaauaugcuauuaaggugaucugcaacgaaaagccaggccccacccucccuuuuaaaauuuguagugcgaagacagacgccgcaaugacccuggcugaugccaaacccauccuugagcuggccccaguugaccagacuacauacauaaaggaaaaagaugagcgaugcaagaccuggaugugucgggugcgugacgaagguuuccaagucauuuuugagccuuucaagaaucuauucggcagcuauaucgggaucuuuuacacauucauuaucucucucauggcuauuuuuauaguaaucuacauugugcugcccaucugcuucaaauugagagauacucugaggcagcaugaggacgcauauaagcgcgaaaugaaaauccgguga

SEQ ID NO: 10979 - RNA, 4323 nt, Artificial Sequence
  derived and/or modified CDS sequence (opt3) from TAHV(181)__GQ386831.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccaaagaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccgaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauauggggacgcagccggacuccugacccacaggaagacauacaacugccuugugcaguauaaaagcaaguggcugacuaacuuuuugauuggcuacaucauccucaugcugauuaaggauucgguauuaauaguucaugcugacggcaccgauuucgaaaaauguucuggggaggcggacaucacauggaauugcaccggaccauuucugaaccuagguaauugugaaaagaaacagaagaaagaguccuauaacaauauugcaacucaacucaagggccuggaugccaucucagugcuugacauuccgaugaucaguaagauacccgaagauaucgcuggggccuugcgguucauugaggagcagcguagcuaccacguccagcugacggcagaauacgccaugcucacacgcuauugcgacuacuauacccaguuuacugacaacuccggauacucucaaaccacauggagaguguaucugaggagccaugauuucgaggcuuguauccuuuacccuaaucggcacuuuugccgaugugucaaacacggcgacaagugcucaaguuccaacugggauuucgccaaugaaaugaaaaacuauuacagcgguaagcagucuaaauuugacaaggaucugaauuuggcacucaugucacugcaucacgcguuccgcgggaccaguagcuucuacauugcuaaguuacugaaagagaagaaaaacgaagaccuagugacuuaugccgagaagaucaaaggcaaguacccaggaaaugcacuccugaaagccauaauugauuauaucaaguacaugaagggccuuacagagaugaacaauuuuaaacaugacgaaaugugggaugacuucauuuuugagguucccccuacgaaguccccaucugugagaagguuggaaucgagcuaugauuucaaaaccaacguaaacuccaaucccucacacaucuguaagaacauaaaaacugucgugugccugaguccgaagucugggguuagcuacgacuccaucauugcuuguggagagccuucacagcccagcaucuaucggaagccagauucucagguguuucaauccaaugccgaccagacacacuucugccucagugacacccauugccuggaaaacuacgagacagucggugaggaaauuaucgaugcaauuaaaaagagcaaauguugggagacugaauuuaccgaguacauacaguucaagcagucugacggcgugcgcuccugcagaaugaaagauucaggggaguguacgguaaccacaaauagguggccuaucaucuuaugcgacaacgauaaguuuuauuacagugaacugcaaaaggacuaugauaaagaccaggauauuggacacuucugucuuagcccccguugcaauacuauccggcauccaauuaaccgaaagcacauaucgaauuguaccuggcaagugaaccauaauaacaucgacaaaauugagguucacgaauuggaggaucucgaacaguacaagaaagcuaucacacagaagcugcagacuucccuaacccuguuuaaguauucuaaaacgaagaaucucccccacauuaaaccuauguacaaguauaucacaauagagggcaccgagacugccgaagguaucgagagcgcguacauugaaucagagaucccagcccuggcugggacaaguauuggcuucaaaaucaccuccaagucuggaaaacaucuuuuggacgucauaggcuacgugaaaagcgcauccuauucagccguguacacuaagcuguauaccacagggccgacgauuggagucaacaccaaacacgaugaauuaugcacuggucccuguccuguuaaugugccacauggcacaggguggcucaccuuugcuaaggagagaacaagcaguuggggaugcgaggaguucggcugucuggccaucucugacgguugcguguucggguccugccaggacaucauuaaagaugaaauaacuguauacaggaaggaaaccgaggaaacgacagacgucgagcuuugucugaccuuugcagauaaaacuuauugcaccaacuugaacgcgaucacacccauuaucacugaccaauucgaggugcaguuuaagaccguugaagccuacagccucccucgcauuaucgcugugcggaaucacgagauaauggucggccagaucaacgauauuggaguguauucgaagggcugugggaauguucagaaagugaacaauacaaacuacggaaauggcguaccaaaguucgacuaccugugccaucuagccucaagaaaagaagucaucgugaggaaguguuuugauaacgacuaucaagcaugcaaauuccugcagacgcccgcuucuuaccgccucgaggaggaaggugggagugugaccgucauugauuauaagaagauccugggaacuauaaaaaugaaggccauucuuggcgacguuaaauacaagacauuugcagauaauguggacuugaccguagaggguguguguacuggcugcaucaacuguuucgaaaauauccacugcgagcugacaauucacuccaccgucgaagccagcuguccggugguuucuagcugcacgguguuucaugaccgaaucuuaauaacuccuaacgagcacaaauaugcuauuaaggucaucugcaaugagaagccagggcccacccucccuuucaaaauuuguuccgcgaagacagaugccgcaaugacccuggcugacgccaaacccauccuugaacuggccccaguggaucagacuacauacauaaaggagaaagacgaacggugcaagaccuggaugugucguguuagagaugagggauuucaggugauuuucgaaccuuucaagaaccuauuuggcucauauaucgggaucuucuacacauuuauuaucagucucauggcuauuuucauagucaucuacauuguacugcccaucugcuuuaaauugagggacacucugcgccaacaugaggaugcauauaagcgggagaugaaaaucagauga

SEQ ID NO: 10980 - RNA, 4323 nt, Artificial Sequence
  derived and/or modified CDS sequence (opt3) from TAHV(236)__GQ386832.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccaaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcuauaaccuggucuuucauccugugugcccuccuuauugcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauaugaagacgcagccgggcuccugacccacaggaagacauacaacugccuuguccaguauaaaagcaaguggcugacuaacuuuuugaucguguacaucauucucaugcugauaaaggauucgguauuaaucguucaugcugacggaaccgauuucgagaaauguucuggcgaagcggacauuacauggaauugcaccggcccauuucugaaccuagggaauugugagaagaaacagaagaaagaauccuauaacaauaucgcaacucaacucaagggacuggaugccauuucagugcuugacaugccgaugaucaguaagauacccgaggauaucgcuggugccuugcgguucauugaggaacagcguagcuaccacguccagcugacggcagaguacgccaugcucacacgcuauugcgacuacuauacccaguuuacugacaacuccggcuacucucaaaccacauggagaguguaucugaggagccaugauuucgaggcuuguauccuuuacccuaaucagcacuuuugccggugugucaaacacggggacaagugcucaaguuccaacugggauuucgccaaugaaaugaaaaacuauuacagcggaaagcagucuaaauuugacaaggaucugaauuuggcacucaugucacugcaucacgcguuccgaggcaccaguagcuucuacauugcuaaguuacugaaagaaaagaaaaacgaggaccuagugacuuaugccgagaagaucaaagguaaguacccagggaaugcacuccugaaagccauaauugauuauaucaaguacaugaaggaccuuacagaaaugaacaauuuuaaacaugaugagaugugggacgauuucauuuuugaaguucccccuacgaaguccccaucugugcgcagauuggagucgagcuaugacuucaaaaccaacguaaacuccaaucccucacacaucuguaagaacauaaaaacugucaucugccugaguccgaagucuggcgugagcuacgauuccauuaucgcuuguggagaaccuucacagcccagcauuuauaggaagccagacucucaaguuuuucaguccaaugccgaccagacacacuucugccucagugauacccauugccuggagaacuacgagacagugggcgaagagaucauagacgcaauuaaaaagagcaaauguugggaaacugaguuaaccgaguacauccaguuuaagcaaucugaugggguccgguccugccgcaugaaagacucaggagaauguacggugaccacaaauagauggccuaucauucugugcgauaacgacaaguucuauuacagugagcuucagaaggauuaugacaaagaucaggacaucggucacuuuuguuugagccccaggugcaauacuauucgucauccaauaaaccggaagcacaucucgaauuguaccuggcagguaucccauaacaauauugauaaaaucgaagugcacgagcucgaagaccuggagcaauacaagaaagcuauuacacagaagcuacagacuucucugacccucuucaaguauagcaaaacgaagaaccugccccacaucaaaccuauguacaaguauauaacaaucgagggcaccgaaacugccgaggggauugaaucagcguacaucgagagugaaauuccagcccuugcuggaacauccaucggcuuuaaaauaaccucuaagagcgguaaacauuugcuggauguuauuggguacgucaaguccgcaucauauagcgccguguacacuaaguuauauaccacaggcccgacgaucggagugaauaccaaacacgacgagcucugcacuggccccuguccugucaacguuccacaugggacaggauggcugaccuucgcuaaggagcgaacaaguucuugggguugcgaagaguuuggcugucuugccaucuccgacgggugcguguucggaagcugccaagauauuauaaaagacgaaaucacuguguacagaaaggagaccgaagagacgacagauguagagcuguguuugaccuucgcagacaaaacuuauugcaccaaucucaacgcgauuacacccaucauuacugaucaguuugaaguccaguucaagaccguggaggccuacucgcugccuaggaucauagcuguucgcaaccacgaaaucauggugggccagauuaaugacaucggugucuauucaaagggguguggcaacgugcaaaaaguuaauaacacaaauuacggaaacggcgugccaaaguuugauuaccuaugccaucuggccucucggaaagagguaauugucagaaaguguuucgacaaugauuaucaggcaugcaaauuucuccagacgcccgcuaguuacaggcuggaggaagagggguccagcgugaccgugaucgacuauaagaagauacuuggaacuauuaaaaugaaggccaucuugggcgaugucaaauacaagacauucgcagacaacguugaccugaccguggaagguguauguacugggugcaucaauuguuuugagaacauucacugcgaauuaacaauccacucuaccguggaggccagcuguccggucguguccucaugcacgguuuuccaugaucgcauacucauuacuccuaaugagcacaaauaugcuaucaaggugauuugcaacgaaaagccaggacccacccugccuuuuaaaaucuguagugcgaagacagacgccgcaaugacccuugcugaugccaaacccauacuggagcuagccccagucgaccagacuacauacauuaaggaaaaagaugagcgaugcaagaccuggaugugucgggugcgugacgaaggcuuccaaguuaucuuugagccuuucaagaaucucuucgguagcuauaucggcaucuuuuacacauucauuauuucucugauggcuauauuuaucgugauuuacaucgucuugcccaucugcuucaaacugagagaugcauuaaggcagcaugaggacgccuauaagcgcgaaaugaaaauucgguga

SEQ ID NO: 10981 - RNA, 4323 nt, Artificial Sequence
  derived and/or modified CDS sequence (opt3) from TAHV(29)__GQ386823.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggagaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccaaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauaugaagacgcagccgggcuccugacccacaggaagacauacaacugccuugugcaguauaaaagcaaguggcugacuaacuuuuugauuguauacaucauccucaugcugauuaaggauucgguuuuaauagugcaugcugacggaaccgauuucgagaaauguucuggcgaagcggacaucacauggaauugcaccggcccauuucugaaccuagggaauugugagaagaaacagaagaaagaauccuaugauaacauugcaacucaacucaagggacuggacgccaucucaguccuugauauuccgaugaucaguaagauacccgaggacaucgcuggugccuugcgguucauugaggaacagcguagcuaccacgugcagcugacggcagaguacgccaugcucacacgcuauugcgacuacuauacccaguuuacugauaauuccggcuacucucaaaccacauggagagucuaucugaggagccaugacuucgaggcuuguauccuuuacccuaaccagcacuuuugccggugugugaaacacggggauaagugcucaaguuccaauugggacuucgccaacgaaaugaaaaauuauuacagcggaaagcagucuaaauuugauaaggaccugaacuuggcacucaugucacugcaucacgcguuccgaggcaccaguagcuucuacauugcuaaguuacugaaagaaaagaaaaaugaggaucuaguuacuuaugccgagaagaucaaagguaaguacccagggaacgcacuccugaaagccauaauugacuauaucaaguacaugaaggaucuuacagaaaugaauaacuuuaaacaugacgagaugugggaugacuucauuuuugaagugcccccuacgaaguccccaucuguacgcagauuggagucgagcuaugauuucaaaaccaaugucaacuccaaccccucacacaucuguaagaauauaaaaacugugguuugccugaguccgaagucuggcgugagcuacgacuccaucauugcuuguggagaaccuucacagcccagcaucuauaggaagccagacucucaagucuuucaguccaacgccgaucagacacacuucugccucagugacacccauugccuggagaauuacgagacagugggcgaagagauuaucgaugcaauuaaaaagagcaaauguugggaaacugaguuuaccgaguacauacaguucaagcaaucugacgggguacgguccugccgcaugaaagauucaggagaauguacggugaccacaaacagauggccuaucaucuuaugcgacaaugauaaguuuuauuacagugagcugcagaaggacuaugauaaagaccaggauauuggucacuucugucuuagccccaggugcaacacuauccgucauccaauuaaucggaagcacauaucgaacuguaccuggcagguuucccauaauaacaucgacaaaauugaaguccacgaguuggaagaucucgagcaauacaagaaagcuaucacacagaagcugcagacuucucuaacccuguuuaaguauagcaaaacgaagaaucucccccacauuaaaccuauguacaaguauaucacaauagagggcaccgaaacugccgaggggaucgaaucagcguacauugagagugaaaucccagcccuggcuggaacauccauuggcuucaaaaucaccucuaagagcgguaaacaucuuuuggacgugauaggguacgugaaguccgcaucauauagcgccgucuacacuaagcuguauaccacaggcccgacgauuggaguuaacaccaaacacgacgaguuaugcacuggccccuguccugugaauaugccacaugggacaggauggcucaccuuugcuaaggagcgaacaaguucuugggguugcgaagaguucggcugucuggccaucuccgaugggugcguguucggaagcugccaagacaucauuaaagaugaaauaacuguauacagaaaggagaccgaagagacgacagacgucgagcuuugucugaccuuugcagauaaaacuuauugcaccaacuugaaugcgaucacacccauuaucacugaccaguucgaagugcaguuuaagaccguugaggccuacucgcucccuaggauuaucgcugugcgcaaccacgaaauaauggucggccagaucaacgauauugguguguauucaaagggguguggcaauguucaaaaagugaacaauacaaacuacggaaauggcguaccaaaguucgacuaccugugccaucuagccucucggaaagaggucaucgugagaaaguguuuugauaacgacuaucaggcaugcaaauuccugcagacgcccgcuaguuacaggcucgaggaagaagggggauccgugaccgucauugauuauaagaagauccugggcacuauaaaaaugaaggccauucuuggugacguuaaauacaagacauuugcagacaauguggauuugaccguagaagggguguguacuggaugcaucaacuguuucgagaauauccacugcgaacugacaauucacagcaccgucgaggccucuuguccggugguuagcuccugcacgguguuucaugaccgcaucuuaauaacuccuaacgagcacaaauaugcuauuaaggucaucugcaaugaaaagccaggccccacccucccuuucaaaauuuguucagcgaagacagauguggccaugacccuggcagacgcuaaacccauccuugagcuggccccaguugaucagacuacauacauaaaggaaaaagacgagcgaugcaagaccuggaugugucgggugaaggaugaagguuuucaagucauuuucgagccuuucaaaaaccuauuuggcaguuauaucgggaucuucuacacauuuauuaucagccucauggccauuuucauaguaaucuacauugugcugcccaucugcuuuaaguugcgugacacucugagacagcaugaggaugcuuauaaaagggaaaugaagauccgcuga

SEQ ID NO: 10982 - RNA, 4323 nt, Artificial Sequence
  derived and/or modified CDS sequence (opt3) from TAHV(4019)__GQ386834.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccgaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauaugaagacgcagccgggcuccugacccacaggaagacauacaacugccuugugcaguauaaaagcaaguggcugacuaacuuuuugauuguauacaucauccucaugcugauuaaggauucgguuuuaauagugcaugcugacggaaccgauuucgagaaauguucuggcgaagcggacaucacauggaauugcaccggcccauuucugaaccuagggaauugugagaagaaacagaagaaagaauccuauaacaauauugcaacucaacucaagggacuggaugccaucucaguccuugacauuccgaugaucaguaagauacccgaggauaucgcuggugccuugcgguucauugaggaacagcguagcuaccacgugcagcugacggcagaguacgccaugcucacacgcuauugcgacuacuauacccaguuuacugacaacuccggcuacucucaaaccacauggagagucuaucugaggagccaugauuucgaggcuuguauccuuuacccuaaucggcacuuuugccgaugugugaaacacggggacaagugcucaaguuccaacugggauuucgccaaugaaaugaaaaacuauuacagcggaaagcagucuaaauuugacaaggaucugaauuuggcacucaugucacugcaucacgcguuccgcggcaccaguagcuucuacauugcuaaguuacugaaagaaaagaaaaacgaggaccuaguuacuuaugccgagaagaucaaagguaaguacccagggaaugcacuccugaaagccauaauugauuauaucaaguacaugaaggaccuuacagaaaugaacaauuuuaaacaugaugagaugugggacgauuccauuuucgaagugcccccuacgaagucuccaucgguaagaagguuggagagcuccuaugacuuuaaaaccaacgucaacucaaaucccagucacaucuguaagaacauaaaaacugugguuugccugucuccaaagagcggcguguccuacgauucaaucauugcuuguggagaaccuagccagcccucuaucuaucggaagccagacucccaggucuuccaaaguaaugccgaccagacacacuuuugccucagcgauacccauugccuggagaacuacgaggcagugggcgaagagauuaucgacgcuauuaaaaagucuaaauguugggaaacagaguucacugaguacauucaguuuaagcaguccgaugggguacgcucaugcagaaugaaagacaguggagaauguaccgugacgaccaauagguggccuaucaucuuaugcgauaacgacaaguucuauuacagcgagcugcaaaaggauuaugacaaagaucaggacauuggucacuuuugucuuucgccccguugcaauacaauccggcauccaauuaaccgaaagcacauauccaauuguacuuggcagguuucucauaacaauaucgauaaaauugaaguccacgaguuggaagaccucgagcaguacaagaaagccaucacccaaaagcugcagacaagccuaacucuguucaaguauucaaaaaccaagaaccucccccacauuaaaccuauguacaaguauaucacgauagagggcacagaaaccgcggaggggaucgaaagugccuacauugaguccgaaaucccagcucuggcaggaacuucuauuggcuuuaaaaucacaagcaaguccgguaaacaucuuuuggaugugauaucauacgucaagagcgccaguuauucugcuguguacaccaagcuguauacuaccgggccgacaauuggcguuaauacgaaacacgacgaguuaugcaccggacccuguccugugaacgugccacauggcacuggguggaucacauucgccaaggagagaaccuccagcuggggaugcgaagaguuugguugucucgcaaucucggacggcugcguauucgggucaugccaggauauuauaaaagacgaaaucacagucuacaggaaggagacugaagagaccacggauguggagcugugucuuacauucgcggacaaaaccuauugcacuaaucugaacgccauuacccccaucauuacagaucaauuugaaguucaguucaagacuguggaggcuuacucuuugccucgcaucauagccguccggaaccacgaaaucauggugggacagauuaaugacaucggcguuuauaguaaggguugugggaacgugcagaaaguaaauaacaccaauuacggcaacggagucccaaaguuugauuaccucugccaucuggcauccagaaaagaggugauugugaggaaguguuucgacaaugauuaucaggcuugcaaauuucuacaaacacccgccagcuaccgccuggaggaagagggcgggucugucacgguuaucgacuauaagaagauacucggaaccauuaaaaugaaggcaauccugggcgaugugaaauacaagacuuucgccgacaacguagaccuuacaguggaaggugucuguaccgggugcaucaauuguuuugagaacauucacugcgaauugacuauccacagcacaguggaggcuuccuguccgguugugucaaguugcaccgucuuccaugaucgaauacugauuacgccuaaugagcacaaauaugcgaucaaggugauuugcaacgaaaagccaggacccacuuuaccuuuuaaaaucuguagcgccaagaccgacgcagcuaugacacucgccgaugccaaacccauacuggagcuugcuccaguugaccagaccacuuacauuaaggaaaaagaugagcggugcaagacauggaugugucgugugagagacgaaggcuuccaggucaucuuugagccuuucaagaaucuguucgguucuuauaucggcauauuuuacaccuucaucauuucccuaauggcaauauuuaucguaauuuacaucgugcuccccaucugcuucaaacugagggauacauugcgccaacaugaggacgccuauaagcgggaaaugaaaauuagauga

SEQ ID NO: 10983 - RNA, 4323 nt, Artificial Sequence
  derived and/or modified CDS sequence (opt3) from TAHV(4020)__GQ386835.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccgaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauaugaagacgcagccgggcuccugacccacaggaagacauacaacugccuugugcaguauaaaagcaaguggcugacuaacuuuuugauuguauacaucauccucaugcugauuaaggauucgguuuuaauagugcaugcugacggaaccgauuucgagaaauguucuggcgaagcggacaucacauggaauugcaccggcccauuucugaaccuagggaauugugagaagaaacagaagaaagaauccuauaacaauauugcaacucaacucaagggacuggaugccaucucaguccuugacauuccgaugaucaguaagauacccgaggauaucgcuggugccuugcgguucauugaggaacagcguagcuaccacgugcagcugacggcagaguacgccaugcucacacgcuauugcgacuacuauacccaguuuacugacaacuccggcuacucucaaaccacauggagagucuaucugaggagccaugauuucgaggcuuguauccuuuacccuaaucagcacuuuugccggugugugaaacacggggacaagugcucaaguuccaacugggauuucgccaaugaaaugaaaaacuauuacagcggaaagcagucuaaauuugacaaggaucugaauuuggcacucaugucacugcaucacgcguuccgaggcaccaguagcuucuacauugcuaaguuacugaaagaaaagaaaaacgaggaccuaguuacuuaugccgagaagaucaaagguaaguacuccgggaaugcacuccugaaagccauaauugauuauaucaaguacaugaagggccuuacagaaaugaacaauuuuaaacaugacgagaugugggaugacuucauuuuugaagugccacccccuaagucuccaucgguacgcagauuggagagcuccuaugauuucaaaacgaacgucaacucaaaucccagucacaucuguaagaacauaaaaaccgugguuugccugucuccaaagagcggaguguccuacgacucaaucauugcuuguggcgaaccuagccagcccucuaucuauaggaagccagauucccaagucuuucagaguaaugccgaccagacucacuucugccucagcgacacacauugccuggagaacuacgagaccgugggggaagagauuaucgaugcaauuaaaaagucuaaauguugggaaacagaguuuacugaguacauacaguucaagcaauccgacggaguacggucaugccgcaugaaagauaguggugaauguaccgugacgaccaauagauggccuaucaucuuaugcgacaacgauaaguuuuauuacagcgagcugcagaaggacuaugauaaagaccaggauauuggccacuucugucuuucgcccaggugcaauacaauccgucauccaauuaaccggaagcacauauccaauuguacuuggcagguuucucauaacaauaucgacaaaauugaaguccacgaguuggaagaucucgagcaauacaagaaagcuaucacccagaagcugcagacaagccuaacucuguuuaaguauucaaaaaccaagaaccucccccacauuaaaccuauguacaaguauaucacgauagaggggacagaaaccgccgagggaaucgaaagugcguacauugaguccgaaaucccagcccuggcuggcacuucuauugguuucaaaaucacaagcaaguccgggaaacaucuuuuggacgugauaggcuacgugaagucagcaagcuauagugccgucuacaccaagcuguauacuaccggaccgacaauuggcguuaauacgaaacacgaugaguuaugcaccgggcccuguccugugaacgugccacauggaacugguuggcucacauuugcuaaggagcgaaccucuuccuggggcugcgaagaguucgggugucuggccaucagcgacggaugcguauucggcucgugccaagacaucauuaaagaugaaauaacagucuacagaaaggagacugaagagaccacggacguggagcuuugucugacauuugcagauaaaaccuauugcacuaauuugaacgcgaucacccccauuaucacagaccaguucgaaguucaguuuaagacuguggaggccuacucacucccuaggauuaucgcuguccgcaaccacgaaauaauggugggucagaucaaugauauugggguuuauucuaagggcuguggaaacgugcaaaaaguaaauaacaccaauuacggcaacggggucccaaaguucgacuaccugugccaucuagccagucggaaagaggugaucgugagaaaguguuuugauaaugacuaucaggcaugcaaauuccugcagacacccgcuuccuacaggcucgaggaagagggaggcagcgucacgguuauugauuauaagaagauccuggguaccauaaaaaugaaggccauucuuggggacgugaaauacaagacuuuugcagauaacguagacuugacaguggaaggagucuguaccggcugcaucaauuguuucgagaacauccacugcgaacugacuauucacucuacaguggaggccagcuguccgguuguguccucaugcaccgucuuucaugaccgcaucuuaauaacgccuaaugagcacaaauaugcuauuaaggugaucugcaacgaaaagccaggucccacucucccuuucaaaauuuguagugcgaagaccgaugccgcaaugacacuggcugacgccaaacccauccuugagcuggccccaguugaucagaccacuuacauaaaggaaaaagacgagcgaugcaagacauggaugugucgggugcgugaugaaggcuuucaagucauuuucgagccuuucaagaaucuauuugggagcuauaucggaaucuucuacaccuuuauuaucucucucauggcuauuuucauaguaaucuacauugugcugcccaucugcuuuaaauugagagacacacugaggcagcaugaggaugcauauaagcgcgaaaugaaaauccgguga

SEQ ID NO: 10984 - RNA, 4323 nt, Artificial Sequence
  derived and/or modified CDS sequence (opt3) from TAHV(4030)__GQ386836.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggagaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccaaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugcaacgagugugauauguaucacgaccgauccggacugaaguacaauggcgauuucacaaacaaaugcagacaguguacuugcggucaauaugaagacgcagccgggcuccugacccauaggaagacauacaacugccuugugcaguauaaaagcaaguggcugacuaacuuuuugauuguauacaucauccucaugcugauuaaggauucgguuuuaauagugcacgcugacggaaccgauuucgagaaauguucuggcgaagcggacaucacauggaauugcaccggcccauuucugaaucuagggaacugugagaagaaacagaagaaagaauccuauaauaacauugcaacucaacucaagggacuggaugccaucucaguccuugacauuccgaugaucaguaagauacccgaggauaucgcuggugccuugcgguucauugaggaacagcguagcuaccaugugcagcugacggcagaguacgccaugcucacacgcuauugcgacuacuauacccaguuuacugacaauuccggcuacucucaaaccacauggagagucuaucugaggagccacgauuucgaggcuuguauccuuuacccuaaccagcauuuuugccggugugugaaacacggggacaagugcucaaguuccaauugggauuucgccaacgaaaugaaaaauuauuacagcggaaagcagucuaaauuugacaaggaucugaacuuggcacucaugucacugcaccaugcguuccgaggcaccaguagcuucuacauugcuaaguuacugaaagaaaagaaaaaugaggaccuaaucacuuaugccgagaagauaaaagguaaguacccagggaacgcacuccugaaagccauuaucgauuauauuaaguacaugaaggaccuuacagaaaugaauaacuuuaaacacgaugagaugugggacgauuucaucuuugaaguucccccuacgaaguccccaucugugcgcagauuggagucgagcuaugacuucaaaaccaacguaaauuccaaccccucacauauauguaagaauaucaaaacugucgugugccugaguccgaagucuggcguuagcuacgauuccauuaucgcuuguggagaaccuucacagcccagcauuuauaggaagccagacucucaaguguuucaguccaacgccgaccagacacacuucugccucagugauacccacugccuggagaauuacgagacagucggcgaagagaucauagacgcaauuaaaaagagcaaauguugggaaacugaguuuaccgaguacauccaguucaagcaaucugauggggugcgguccugccgcaugaaagacucaggagaauguacgguaaccacaaacagauggccuaucauuuuaugcgauaaugacaaguuuuauuacagugagcugcagaaggauuaugacaaagaucaggacaucggucauuucugucuuagccccaggugcaacacuauucgucacccaauaaaucggaagcauaucucgaacuguaccuggcaagugucccacaauaacauugauaaaaucgaaguucaugaguuggaagaccucgagcaguacaagaaagcuauuacacagaagcugcagacuucucuaacccuguuuaaguauagcaaaacgaagaaucucccccacaucaaaccuauguacaaguauauaacaaucgagggcaccgaaacugccgaggggauugaaucagcguacaucgagagugaaauuccagcccuggcuggaacauccaucggcuucaaaauaaccucuaagagcgguaaacaccuuuuggaugucauuggguacgugaaguccgcaucauauagcgccguguacacuaagcuguauaccacaggcccgacgaucggagucaacaccaaacaugacgaguuaugcacuggccccuguccuguuaaugugccacacgggacaggauggcucaccuuugcuaaggagcgaacaaguucuugggguugcgaagaguucggcugucuggccaucuccgacgggugcguguucggaagcugccaagauauuauaaaagacgaaaucauuguauacagaaaggagacugaagagaccacggaugucgagcuuugucugacauuugcagacaaaaccuauugcacuaacuugaacgcgaucacccccauuaucacagaucaguucgaagugcaguuuaagacuguugaggccuacucgcucccuaggauaaucgcugugcgcaaucaugaaauuauggucggccagaucaacgacauugguguguauucaaagggguguggcaauguucaaaaagugaacaauaccaacuacggaaauggcguaccaaaguucgauuaccugugccaccuagccucucggaaagaggucaucgugagaaaguguuuugacaacgauuaucaggcaugcaaauuccugcagacacccgcuaguuacaggcucgaggaagaagggggauccgugacggucauagacuauaagaagauucugggcaccaucaaaaugaaggccauccuuggugauguuaaauacaagacuuuugcagacaauguggacuugacaguagaagggguguguaccggaugcgucaacuguuucgagaauauucauugcgaacugacuauccacagcacaguggaggccucuuguagcguuguguccucaugcaccgucuuucacgaucgcauauuaauuacgccgaacgagcauaaauaugcuaucaaggugauuugcaaugaaaagccuggcccaacucuccccuucaaaaucuguagugcgaagaccgacgccgcaaugacacuggcugaugccaaaccuauacuugagcuggcccccguugaccagaccacuuacauuaaggaaaaagaugagcgaugcaagacauggaugugucgggugcgugacgaagguuuucaagucaucuucgagccauucaagaaccuauuuggcagcuauaucgggauuuucuacaccuuuaucauuucucucauggcuauauucaucguaauuuacaucgugcugccuaucugcuuuaaauugagagauacacugaggcagcacgaggacgcauauaagcgcgaaaugaaaauucgguga

SEQ ID NO: 10985 - RNA, 4323 nt, Artificial Sequence
  derived and/or modified CDS sequence (opt3) from TAHV(4033)__GQ386837.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccgaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcacggauuccuaaauuuuuacgccauguacugccacgagugugauauguaucaugaccgcuccggccugaaguacaacggugauuucacaaauaaaugccgacaguguacuugcgggcaauaugaagacgcagccggacuccugacccacagaaagacauacaacugccuugugcaguauaaaagcaaguggcugacuaacuuuuugauuguauacaucauccucaugcugauuaaggauucgguuuuaauagugcaugcugacggcaccgauuucgagaaauguucuggcgaagcggacaucacauggaauugcaccgggccauuucugucccuaggaaacugugagaagaaacagaagaaagaaucauauaauaacauugcaacucaacucaagggucuggaugccaucaguguccuugacauuccgaugaucagcaagauacccgaggauaucgcuggcgccuugagguucauugaggaacagcgguccuaccacgugcagcugacggcagaguacgccaugcucacacguuauugcgacuacuauacccaguuuacugacaauucuggguacagccaaaccacauggcgcgucuaucugagaucacaugauuucgaggcuuguauccuuuacccuaaccagcacuuuuguaggugcgugaaacacggagacaagugcaguuccagcaauugggauuucgccaacgaaaugaaaaauuauuacucuggcaagcagucaaaauuugacaaggaucugaacuuggcacucaugagucugcaucacgcguuccgggguaccagcuccuucuacauugcuaaguuacugaaagaaaagaaaaaugaggaccuaguuacuuaugccgagaagaucaaagggaaguacccaggcaacgcacuccugaaagccauaauugauuauaucaaguacaugaaggaccuuacagaaaugaauaacuuuaaacaugaugagaugugggacgauuucauuuuugaagugcccccuacgaagucuccaucgguacgacgcuuggagagcuccuaugacuucaaaaccaaugucaacucaaaccccagucacaucuguaagaauauaaaaacugugguuugccugucuccaaagagcggaguguccuacgauucaaucauugcuuguggcgaaccuagccagcccucuaucuauagaaagccagacucccaagucuuucagaguaacgccgaccagacacacuucugccucagcgauacccauugccuggagaauuacgagacagugggggaagagauuaucgacgcaauuaaaaagucuaaauguugggaaacugaguuuaccgaguacauacaguucaagcaauccgauggaguaaggucaugccggaugaaagacaguggugaauguacggugaccacaaaccgcuggccuaucaucuuaugcgauaaugacaaguuuuauuacagcgagcugcagaaggauuaugacaaagaucaggacauuggccacuucugucuuucgcccagaugcaacacuaucaggcauccaauuaaucguaagcacauauccaacuguaccuggcagguuucucauaauaacaucgauaaaauugaaguccacgaguuggaagaccucgagcaauacaagaaagcuaucacacagaagcugcagacuagccuaacccuguuuaaguauucaaaaacgaagaaucucccccacauuaaaccuauguacaaguauaucacaauagaggggaccgaaacugccgagggaaucgaaagugcguacauugaguccgaaaucccagcccuggcuggcacaucuauugguuucaaaaucaccagcaaguccgggaaacaucuuuuggaugugauaggcuacgugaagucagcaagcuauagugccgucuacacuaagcuguauaccacaggaccgacgauuggcguuaacaccaaacacgacgaguuaugcacugggcccuguccugugaaugugccacauggaacagguuggcucaccuuugcuaaggagcggacaucuuccuggggcugcgaagaguucgggugucuggccaucagcgacggaugcguauucggcucgugccaagauaucauuaaagacgaaauaacugucuaccgaaaggagaccgaagagacgacagauguggagcuuugucugaccuuugcagacaaaacuuauugcaccaacuugaaugcgaucacacccauuaucacugaucaguucgaaguucaguuuaagaccguggaggccuacucacucccuagaauuaucgcugucaggaaccacgaaauaauggugggucagaucaacgacauugggguuuauucuaagggcuguggaaaugugcaaaaaguaaacaauacaaacuacggcaauggggucccaaaguucgauuaccugugccaucuagccagucgcaaagaggugaucgugcggaaguguuuugacaacgauuaucaggcaugcaaauuccugcagacgcccgcuuccuacagacucgaggaagagggaggcagcgucaccguuauugacuauaagaagauccuggguacuauaaaaaugaaggccauucuuggggaugugaaauacaagacauuugcagacaauguagacuugaccguggaaggagucuguacuggcugcaucaacuguuucgagaauauccacugcgaacugacaauucacucuaccguggaggccagcuguccgguuguguccucaugcacggucuuucaugauaggaucuuaauaacuccuaacgagcacaaauaugcuauuaaggugaucugcaaugaaaagccaggucccacccucccuuucaaaauuuguagugcgaagacagacgccgcaaugacccuggcugaugccaaacccauccuugagcuggccccaguugaccagacuacauacauaaaggaaaaagaugagcgcugcaagaccuggaugugucgagugcgggacgaaggcuuucaagucauuuucgagccuuucaagaaccuauuugggagcuauaucggaaucuucuacacauuuauuaucucucucauggcuauuuucauaguaaucuacauugugcugcccaucugcuuuaaauugcgugauacucugagacagcaugaggacgcauauaagagggaaaugaaaauccgcuga

SEQ ID NO: 10986 - RNA, 4323 nt, Artificial Sequence
  derived and/or modified CDS sequence (opt3) from TAHV(4034)__GQ386838.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccaaagaagguuagcggaggucauauuaacgugaucgaggucggcgaugacuugaccuuacacacagaggcuuauguguguaaugcagauugcacuauugggguagacaaggagaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccgaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacacgcugaugccuauuuuuauaccacuugcauauaucuacggaguuauuuacaauaagucauguaagaaaugcaaguugugcggccugguguaucaucccuucacugaauguggcacacacugcguauguggggcccgguacgagaccagugaucgcaugaaacuacauagagcuagcggacucugcccugguuauaagucucugagggccgcacgggugauguguaaauccaagggcccagcuucaauccuuagcauaauuacugccguccugaucuugacauuugugacccccaucaacgcgaugguugccggggacacgcaggaaaccuucaaacucgaggaucugccugacgacauguuaaguauggcaaugaaggugaauauguacuauauuaugugcaugaucaacuacgcugucacauggucuuucauucugugugcccuccuuauagcucuguuguuuaagaaauaucagcaccgcuuccuaaauuuuuacgccauguacugccacgagugugauauguaucaugaccgauccggacugaaguacaacggcgauuucacuaauaaaugcagacaguguaccugcggucaauaugaagacgcagccgggcuccugacacacaggaagacuuacaacugccuugugcaguauaaaagcaaguggcugaccaacuuuuugaucguauacauuauccucaugcugaucaaggauucgauuuuaauaguucaugcugacggaacagauuucgagaaauguucuggcgaagcggacaucaccuggaauugcacuggcccauuucugaaccuagggaauugugagaagaaacagaagaaagaauccuauaacaauauugcaacgcaacucaagggacuggaugccaucucagugcuugacauuccgaugaucaguaagauacccgaggauaucgcuggugccuugcgguucauugaggaacagcguagcuaccacguccagcugacagcagaguacgccaugcucacccgcugcugugacuauuacacucaguuuaccgacaacuccggcuauucucaaacaaccuggagaguguaccugaggagccaugauuucgaggcuugcauccuuuauccuaaucagcacuuuugucggugcgucaaacacgggaacaaguguucaaguuccaauugggacuucgccaacgaaaugaaaaauuacuauagcggaaagcagucuaaauuugauaaggaccugaacuuggcacucaugucacugcaucacgcguuccgaggcacaaguagcuucuacauugcuaaguuacugaaagaaaagaaaaaugaggaucuagugacuuacgccgagaagaucaaagguaaguauccagggaacgcacuccugaaagccauaauugacuacaucaaguauaugaaggaucuuacggaaaugaauaacuuuaaacaugacgagaugugggaugacuucauuuuugaaguucccccuaccaaguccccaucugugcgcagauuggagucgagcuacgauuucaaaacuaacguaaauuccaaccccucacacaucugcaagaauauaaaaacagucgugugucugaguccgaagucuggcguuagcuaugacuccaucauugcuugcggagaaccuucacagcccagcaucuacaggaagccagauucucaaguguuucaguccaacaccgaccagacacacuucugccucagugacacucauugucuggagaauuaugaggccgucggcgaagagauuaucgaugcaauuaaaaagagcaaaugcugggaaaccgaguuuacggaguacauacaguucaagcaaucugacggggugcgguccugucgcaugaaagauucaggagaaugcaccguaacaacuaacagauggccuaucaucuuaugugacaaugauaaguuuuacuauagugagcugcagaaggacuacgauaaagaccaggauauuggucacuucugccuuagccccagguguaacaccauccgucauccaauuaaucggaagcacauaucgaacugcacauggcaagugaaucauaacaauaucgacaaaauugaaguucacgaguuggaagaucucgagcaguauaagaaagcuaucacucagaagcugcagaccucccuaacgcuguuuaaguacucuaaaacaaagaaccucccccacauuaaaccuauguauaaguacaucaccauagagggcacugaaacagccgaggggaucgaaagcgcguauauugagucagaaaucccagcccuggcuggaaccaguauuggcuucaaaaucacuuccaagucugguaaacaucuuuuggacgucauaggguacgugaaaagcgcauccuacucagccguguauaccaagcuguacacaacgggcccgaccauuggagucaauacuaaacacgaugaguuauguacaggccccugcccuguuaacgugccacaugggaccggauggcucacauuugcuaaggagcgaacuagcaguugggguugugaagaguucggcugccuggccaucucugacgggugcguguucggauccugucaagacaucauuaaagaugaaauaaccguauauagaaaggagacggaagagacaaccgacgucgagcuuugccugacuuuugcagauaaaaccuacuguacaaacuugaaugcgaucacucccauuaucaccgaccaguucgaagugcaguuuaagacaguugaggccuauagccucccuaggauuaucgcugugcgcaaccacgaaauaauggucggccagaucaaugauauugguguguacucgaaggggugcggcaacguucaaaaagugaauaacacgaauuauggaaacggcguaccaaaguucgacuaccugugucaucuagccucacggaaagaggucaucgugagaaagugcuuugauaaugacuaccaggcauguaaauuccugcagauucccgcuucuuauaggcucgaggaagaagggggaagugugaccgucaucgauuacaagaagauacugggcacuauuaaaaugaaggccauccuuggugacguuaaauauaagacauuugcagauaacguggacuugaccguagaaggggugugcacuggauguaucaauugcuucgagaacauucacugugaacugacaauccacuccaccgucgaggccagcugcccggugguuucuagcugcacgguguuucaugaccgcauauuaauuacuccuaaugagcacaaauacgcuaucaaggucauuuguaacgaaaagccaggccccacccucccuuucaaaaucugcuccgcgaagacagaugccgcaaugacccuggcugacgccaaacccauacuugagcuggccccaguggaucagacuacauauauuaaggaaaaagacgagcgauguaagaccuggaugugccggguucgugaugaagguuuucaagugaucuucgagccuuucaagaaucuauuuggcucauacaucgggauuuucuauacauuuaucauuagucucauggcuauauucaucgucauuuacaucguacugcccaucuguuuuaaauugagagacacucugaggcagcaugaggaugcauacaagcgcgaaaugaaaauucgguga

SEQ ID NO: 10987 - RNA, 4323 nt, Artificial Sequence
  derived and/or modified CDS sequence (opt3) from TAHV(4057)__GQ386839.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagguucgugcgggccaaagucaauccaguuucaugccuguuucaaucagcacaugagcugcgucagauuucugcacaggacuauucuucccggaaguaucgcguccucuauuugucaaaacguggagaucauaauucugaccguguugacacuccugaucuucauucugcucagcaucuuauccaaaaccuauaucugcuacauucugaugccuauauuuaucccacuugcauauauuuacggcgucaucuacaauaagucauguaagaaaugcaaguugugcggccugguuuaucaucccuucacggaaugugggacucacugcguguguggagcccgguacgagacaagugaucgcaugaaacuacauagagcuagcggucucugcccuggcuauaagucucugagggccgcacggguaauguguaaauccaaggggccagcuucaauacuuagcauuaucaccgccgugcugaucuugacuuuugucacacccauuaacgcgaugguggccggagacacccaggaaacguucaaacucgaggaucugccugacgacauguuaaguauggcaaugaagguuaauauguacuauaucaugugcauuauaaacuacgcugugaccuggucuuucauccugugugcccuccuuauugcucuguuguuuaagaaauaucagcaccgcuuccuaaauuuuuacgccauguacugccacgagugugauauguaucaugaccgauccggccugaaguacaacggugauuucacaaauaaaugcagacaguguacuugcgggcaauaugaagacgcagccggacuccugacccacaggaagacauacaacugccuuguccaguauaaaagcaaguggcugacuaacuuuuugaucguguacaucauucucaugcugauaaaggauucgguauuaaucguucaugcugacggcaccgauuucgagaaauguucuggcgaagcggacauuacauggaauugcaccgggccauuucugaaccuaggaaauugugagaagaaacagaagaaagaauccuauaacaauaucgcaacucaacucaagggucuggaugccauuucagugcuugacaucccgaugauaaguaagauccccgaggauauugcuggcgccuugcgguucaucgaggaacagcguagcuaccacguccagcugacggcagaguacgccaugcucacacgcuauugcgacuacuauacccaguuuacugacaacuccggguacucucaaaccacauggagaguguaucugaggagccaugauuucgaggcuuguauucuuuacccuaaucagcacuuuugccggugugucaaacacggagacaagugcucaaguuccaacugggauuucgccaaugaaaugaaaaacuauuacagcggcaagcagucuaaauuugacaaggaucugaauuuggcacucaugucacugcaucacgcguuccgagguaccaguagcuucuacaucgcuaaguuacugaaagaaaagaaaaacggggaccuagugacuuaugccgagaagauaaaaggcaaguacccaggaaaugcacuccugaaagccauuaucgauuauauuaaguacaugaaggaccuuacagagaugaacaauuuuaaacaugaugaaaugugggacgauuucaucuuugagguucccccuacgaaguccccaucugugcgcagauuggaaucgagcuaugacuucaaaaccaacguaaacuccaaucccucacacauauguaagaacaucaaaacugucgugugccugaguccgaagucuggcguuagcuacgauuccauuaucgcuuguggggagccuucacagcccagcauuuauaggaagccagacucucaaguguuucaguccaaugccgaccagacacacuucugccucagugauacccauugccuggaaaacuacgagacagucggagaggaaaucauagacgcaauuaaaaagagcaaauguugggagacugaauuuaccgaguacauccaguucaagcaaucugauggugugcgguccugccgcaugaaagacucaggcgaguguacgguaaccacaaauaaguggccuaucauuuuaugcgauaacgacaaguuuuauuacagugaacugcagaaagauuaugacaaggaucaggacaucgggcacuucugucuuagccccagaugcaauacuauuaggcauccaauaaaccguaaacacaucucgaauuguaccuggcaagugucccauaacaauauugauaagaucgagguucacgaauuggaggaccucgaacaguacaaaaaggcuauuacacagaagcugcagacuucucuaacccuguuuaaauauagcaagacgaaaaaccucccccacaucaagccuauguacaaauauauaacaaucgagggaaccgagacugccgaaggcauugagucagcguacaucgaaagugagauuccagcccuggcugguacauccaucggguucaagauaaccucuaaaagcggccggcaucuuuuggaugucauuggauacgugaaguccgcaucauauagcgccguguacacuaagcuguauaccacaggcccgacgaucggggucaauaccaaacacgacgaauuaugcacuggacccuguccuguuaacgugccacaugguacaggcuggcucaccuuugcuaaggagcgaacaaguucuugggggugcgaggaguucggaugucuggccaucuccgacggcugcguguucgguagcugccaagauauuauaaaagacgaaaucacuguauacagaaaggaaaccgaggaaacgacagaugucgagcuuugucugaccuuugcagacaaaacuuauugcaccaauuugaacgcgauuacacccaucauuacugaucaguucgaggugcaguuuaagaccguugaagccuacucgcucccuaggaucauagcugugcgcaaccacgagaucauggucgggcagauuaaugacaucggcguguauucaaagggauguggcaacguucaaaaagugaauaacacaaauuacgggaacggaguaccaaaguucgauuaccugugccaucuagccucucggaaagaagucauugugagaaaguguuuugacaaugauuaucaggcaugcaaauuccugcagacgcccgcuaguuacaggcucgaggaggaaggcgguuccgugaccgucaucgacuauaagaagauacuggggacuauuaaaaugaaggccauccuuggagauguuaaauacaagacauuugcagacaacguggacuugaccguagagggcguguguacugguugcgucaauuguuucgaaaacauccacugcgagagcacaauucacucuaccguggaagccagcuguccgguuguguccucaugcacggucuuucaugaucgcauccugauaacuccuaaugagcacaaauaugcuauuaaggugaucugcaacgagaagccaggccccaccuuaccuuucaaaauuuguagugcgaagacagacgccgcaaugacccucgcugaugccaaacccauccuggaacuugccccaguugaccagacuacauacauaaaggagaaagaugaacgaugcaagaccuggaugugucgggugcgugacgagggguuucaagucauuuucgaaccuuucaagaaucuguuuggaagcuauaucggcaucuucuacacauuuauuaucucucuaauggcuauuuucauaguaaucuacauugugcuccccaucugcuuuaaacugagagauacuuugaggcagcaugaggacgcauauaagcgcgagaugaaaauccgguga

SEQ ID NO: 10988 - RNA, 4323 nt, Artificial Sequence
  derived and/or modified CDS sequence (opt3) from TAHV(4060)__GQ386840.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggagaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccaaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccauccugauuuugacuuuugucacacccaucaacgcgaugguggccggggacacccaggaaacguucaaacucgaggaucugccugacgacauguuaaguauggcaaugaagguuaauauguacuauauuaugugcaugauaaacuacgcugugaccuggucuuucauccugugugcccuccuuauugcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauaugaagacgcagccgggcuccagacccacaggaagacauacaacugccugguccaguauaaaagcaaguggcuuacuaacuuucugaucguguacaucauuuugaugcucauaaaggauucgguacugaucguucaugcugacggaaccgauuucgagaaauguucuggcgaagcggacauuacauggaauugcaccggcccauuuuuaaaccuggggaauugugagaagaaacaaaagaaagaauccuauaacaauaucgcaacucagcuaaagggacucgaugccauuucagugcuggacaucccgaugauaaguaagauccccgaggauauugcuggugcccuucgguucaucgaggaacagcguagcuaccacguccaguugacggcagaguacgccaugcugacacgcuauugcgacuacuauacccaauuuacugacaacuccggcuacucucagaccacauggagaguguaucucaggagccaugauuucgaggcuuguauucuguacccuaaucagcacuuuugccggugugucaaacacggggacaagugcucaaguuccaacugggauuucgccaaugaaaugaaaaacuauuacagcggaaagcagucuaaauuugacaaggaucuuaaucuggcauugaugucacuccaucacgcguuccgaggcaccaguagcuucuacaucgcuaagcuguuaaaagaaaagaaaaacgaggaccuggugacuuaugccgagaagauaaaagguaaguacccagggaaugcacuacucaaagccauuaucgauuauauuaaguacaugaaggaccugacagaaaugaacaauuuuaaacaugaugagaugugggacgauuucaucuuugaaguucccccuacgaaguccccaucugugcgcagacuugagucgagcuaugacuucaaaaccaacguaaacuccaaucccucacacauauguaagaacaucaaaacugucgugugcuugaguccgaagucuggcguuagcuacgauuccauuaucgcuuguggagaaccuucacaacccagcauuuauaggaagccagacucucagguguuucaguccaaugccgaccagacacacuucugccugagugauacccauugccucgagaacuacgagacagucggcgaagagaucauagacgcaauuaaaaagagcaaauguugggaaacugaguuuaccgaguacacgcaauucaagcagucugauggggugcgguccugccgcaugaaagacucaggagaauguaccguaacaacuaauagauggccuaucauccugugcgauaacgacaaguuuuauuacagugaguuacagaaggauuaugacaaagaucaggacauuggucacuucugucugagccccaggugcaauaccauccgucauccaauuaaccggaagcacauaucgaauuguacauggcaagugucccauaacaauaucgauaaaauugaaguucacgagcuugaagacuuggagcaguacaagaaagcuaucacucagaagcuccaaaccucucugacgcuauuuaaguauagcaaaacaaagaaccugccccacauuaaaccuauguacaaguauaucaccauagagggcacugaaacagccgaggggaucgaaucagcguacauugagagugaaaucccagcccucgcuggaaccuccauuggcuucaaaaucacuucuaagagcgguaaacaucugcuugaugucauaggguacgugaaguccgcaucauauagcgccguguacaccaaguuguauacaacgggcccgaccauuggagucaauacuaaacacgacgagcugugcacaggccccuguccuguuaacgugccacaugggaccggaugguuaacauuugcuaaggagcgaaccaguucuugggguugcgaagaguucggcugucucgccaucuccgacgggugcguguucggaagcugccaggauaucauuaaagacgaaauaacuguauacagaaaggagacggaagagacaaccgaugucgagcugugucuuacuuuugcagacaaaaccuauugcacaaaucugaacgcgaucacucccauuaucaccgaucaguucgaagugcaguuuaagacaguugaggccuacucguugccuaggauuaucgcugugcgcaaccacgaaauaauggucggccaaaucaaugacauugguguguauucaaagggguguggcaacguucagaaagugaauaacacgaauuacggaaacggcguaccaaaguucgauuaccucugccaucuggccucucggaaagaggucaucgugagaaaguguuuugacaaugauuaucaggcaugcaaauuccuacagacccccgcuaguuacaggcuggaggaagaagggggauccgugacugucauugacuauaagaagauccucggcacaauaaaaaugaaggccauucugggugauguuaaauacaagaccuuugcagacaacguggaccuuacuguagaagggguguguacaggaugcaucaauuguuucgagaacauccacugcgaauugaccauucacagcacggucgaggccucuuguccggugguuagcuccugcacuguguuucaugaucgcauccugauaaccccuaaugagcacaaauaugcuauuaaggucaucugcaacgaaaagccaggccccacauuaccuuucaaaauuuguucagcgaagaccgacgccgcaaugacucucgcugaugccaaacccauccuggagcuugccccaguggaccaaacaaccuacauaaaggaaaaagaugagcgaugcaagacauggaugugucggguucgugacgaagguuuucaggugauuuucgagccuuucaagaaucuguuuggcaguuauaucgggaucuucuacacuuuuauuaucagccuaauugcuauauucaucgucauuuacaucguacuccccaucugcuuuaaacugagagauaccuugaggcagcaugaggacgcauauaagcgcgaaaugaaaauucgguga

SEQ ID NO: 10989 - RNA, 4323 nt, Artificial Sequence
  derived and/or modified CDS sequence (opt3) from TAHV(5060)__GQ386841.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccaaagaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccgaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcauuauaaacuacgcugucaccuggucuuucauccugugugcccuccuuauugcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauaugaagacgcagccgggcuccugacccacaggaagacauacaacugccuugugcaguauaaaagcaaguggcugacuaacuuuuugaucguauacaucauucucaugcugauaaaggauucgguuuuaaucgugcaugcugacggaaccgauuucgagaaauguucuggcgaagcggacauuacauggaauugcaccggcccauuucugaaccuagggaauugugagaagaaacagaagaaagaauccuauaacaauaucgcaacucaacucaagggacuggaugccauuucaguccuugacaucccgaugauaaguaagauccccgaggauauugcuggugccuugcgguucaucgaggaacagcguagcuaccacgugcagcugacggcagaguacgccaugcucacacgcuauugcgacuacuauacccaguuuacugacaacuccggcuacucucaaaccacauggagagucuaucugaggagccaugauuucgaggcuuguauucuuuacccuaaucagcacuuuugccggugugugaaacacggggacaagugcucaaguuccaacugggauuucgccaaugaaaugaaaaacuauuacagcggaaagcagucuaaauuugacaaggaucugaauuuggcacucaugucacugcaucacgcguuccgaggcaccaguagcuucuacaucgcuaaguuacugaaagaaaagaaaaacggugaccuaguuacuuaugccgagaagauaaaagggaaguacccaggcaaugcacuccugaaagccauuaucgauuauauuaaguacaugaaggaccuuacagagaugaacaauuuuaaacaugaugaaaugugggacgauuucaucuuugaggugucccccacgaagucuccuucgguacgcagauuggaaagcuccuaugacuucaaaaccaacgucaacucaaauccaagucacauauguaagaacaucaaaacugugguuugccugucucccaagagcggaguguccuacgauucaauuaucgcuuguggcgagccgagccagccuucuauuuauaggaagcccgacucccaagucuuucagaguaaugccgaccagacacacuucugccucagcgauacccauugccuggaaaacuacgagacagugggggaggaaaucauagacgcaauuaaaaagucuaaauguugggagacugaauuuaccgaguacauccaguucaagcaauccgauggaguacggucaugccgcaugaaagacaguggugaguguacggugaccacaaauaaguggccaaucauuuuaugcgauaacgacaaguuuuauuacagcgaacugcagaaagauuaugacaaggaucaggacaucggccacuucugucuuucgccuagaugcaauacuauuaggcaucccauaaaccguaaacacaucuccaauuguaccuggcagguuucucauagcaacauugauaagaucgagguccacgaauuggaggaccucgaacaauacaaaaaggcuauuacacagaagcugcagacuucacuaacccuguuuaaauauaguaagacgaaaaaucucccacacaucaagcccauauacaaauauaucacaauugaggggaccgagacugccgaaggaaucgaguccgcguacauugaaucugagaucccugcccuggcuggcacaagcauagguuucaagauuaccuccaaaucagggaagcaucuuuuggaugugaucggcuacgugaaaagcgcaaguuauucugccgucuacacuaaacuguauaccacaggaccaacgaucggcguuaacaccaagcacgacgaauuaugcacugggccgugucccgugaaugugccucauggaacagguuggcucaccuuugcuaaagagcggacauccagcuggggcugcgaggaguucgggugucuggccauuucggacggaugcguauucggcucaugccaagauauaaucaaggacgaaauuacugucuaccgaaaagaaaccgaggaaacgacagauguggagcuuugucugaccuuugcagacaagacuuauugcaccaacuugaaugcgaucacaccaauuaucacugaucaguucgagguucaguuuaagaccguggaagccuacucucuccccagaauaaucgcugucaggaaccacgagauuauggugggucagaucaacgacauugggguuuauaguaaaggcuguggaaaugugcaaaagguaaacaauacaaacuacggcaauggggucccuaaauucgauuaccugugccaucuagccucccgcaaggaagugaucgugcggaaauguuuugacaacgauuaucaggcaugcaaguuccugcagacgccagcuagcuacagacucgaggaggaaggaggcucugucaccguuauagacuauaagaaaauucuggguacuaucaagaugaaagccauccuuggggaugugaaguacaaaacauuugcagacaauguagacuugaccguggagggagucuguacuggcugcauuaacuguuucgaaaauauccacugcgagcugacaauacacagcaccguggaagccuccugucccguugugucaaguugcacggucuuucaugauaggauuuuaaucacuccgaacgagcacaaguaugcuauuaaggugaucugcaaugagaaaccugguccaacccuccccuucaagauauguagcgcgaaaacagacgccgcaaugacccuggcugaugccaagccuauucuugaacuggcccccguugaccagacuacauacaucaaagagaaggaugaacgcugcaagaccuggaugugucgagugcgggacgagggcuuucaagucaucuucgaaccauucaaaaaccuauuugggucuuauauuggaaucuucuacacauuuauuauaucccucauggcuaucuucauuguaaucuacaucgugcugccuauuugcuuuaaguugcgugauacucugagacagcaugaggacgcauauaaaagggagaugaagauacgcuga

SEQ ID NO: 10990 - RNA, 4323 nt, Artificial Sequence
  derived and/or modified CDS sequence (opt3) from TAHV(76)__GQ386824.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccgaaaaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccaaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauauggggacgcagccggacuccugacccacaggaagacauacaacugccuugugcaguauaaaagcaaguggcugacuaacuuuuugauuguauacaucauccucaugcugauuaaggauucgguuuuaauagugcaugcugacggcaccgauuucgaaaaauguucuggcgaggcggacaucacauggaauugcaccgggccauuucugaaccuaggaaauugugaaaagaaacagaagaaagaguccuauaacaauauugcaacucaacucaagggucuggaugccaucucaguccuugacauuccgaugaucaguaagauacccgaagauaucgcuggcgccuugcgguucauugaggagcagcguagcuaccacgugcagcugacggcagaauacgccaugcucacacgcuauugcgacuacuauacccaguuuacugacaacuccggguacucucaaaccacauggagagucuaucugaggagccaugauuucgaggcuuguauccuuuacccuaaucagcacuuuugccggugugugaaacacggagacaagugcucaaguuccaacugggauuucgccaaugaaaugaaaaacuauuacagcggcaagcagucuaaauuugacaaggaucugaauuuggcacucaugucacugcaucacgcguuccgagguaccaguagcuucuacauugcuaaguuacugaaagagaagaaaaacgaagaccuaguuacuuaugccgagaagaucaaagggaaguacccaggcaaugcacuccugaaagccauaauugauuauaucaaguacaugaaggaccuuacagagaugaacaauuuuaaacaugaugaaaugugggacgauuucauuuuugaggugcccccuacgaaguccccaucuguacgcagauuggaaucgagcuaugacuucaaaaccaacgucaacuccaaucccucacacaucuguaagaacauaaaaacugugguuugccugaguccgaagucuggagugagcuacgauuccaucauugcuuguggcgagccuucacagcccagcaucuauaggaagccagacucucaagucuuucaguccaaugccgaccagacacacuucugccucagugauacccauugccuggaaaacuacgaggcagugggggaggaaauuaucgacgcuauuaaaaagagcaaauguugggagacagaauuuacugaguacauacaguucaagcaaucugauggaguacgguccugccgcaugaaagacucaggugaguguaccgugacgaccaauagauggccuaucaucuuaugcgauaacgacaaguuuuauuacagugaacugcagaaggauuaugacaaagaucaggacauuggccacuucugucuuagccccaggugcaauacaauccgucauccaauuaaccggaagcacauaucgaauuguacuuggcagguuucccauaacaauaucgauaaaauugagguccacgaauuggaggaccucgaacaauacaagaaagccaucacccagaagcugcagacaucucuaacucuguuuaaguauagcaaaaccaagaaccucccccacauuaaaccuauguacaaguauaucacgauagaggggacagagaccgcggaaggaaucgagucagccuacauugaaagugagaucccagcucuggcaggcacuuccauugguuucaaaaucacaucuaagagcgggaaacaucuuuuggaugugauauccuacgugaagucagccagcuauagugcugucuacaccaagcuguauacuaccggcccgacaauuggaguuaauacgaaacacgacgaauuaugcaccggccccuguccugugaacgugccacaugggacuggauggaucacauuugccaaggagcgaaccucuuccugggguugcgaggaguucggcugucucgcaaucagcgacgggugcguauucggaucgugccaagauauuauaaaagacgaaaucacagucuacagaaaggaaacugaggaaaccacggauguggagcugugucuuacauuugcggacaaaaccuauugcacuaaucugaacgccauuacccccaucauuacagaucaguucgagguucaguuuaagacuguggaggcuuacucauugccuaggaucauagccguccgcaaccacgaaaucauggugggccagauuaaugacaucgguguuuauucuaagggguguggcaacgugcaaaaaguaaauaacaccaauuacggaaacggcgucccaaaguucgauuaccucugccaucuggcaagucggaaagaagugauugugagaaaguguuuugacaaugauuaucaggcuugcaaauuccuacagacacccgccuccuacaggcuggaggaggaagggggaagcgucacgguuaucgacuauaagaagauacucggcaccauuaaaaugaaggcaauccugggugaugugaaauacaagacuuuugccgacaacguagaccuuacaguggagggggucuguaccggaugcaucaauuguuucgaaaacauucacugcgaguugacuauccacucuacaguggaagcuagcuguccgguuguguccucaugcaccgucuuucaugaucgcauacugauuacgccuaaugagcacaaauaugcgaucaaggugauuugcaacgagaagccaggccccacuuuaccuuucaaaaucuguagugccaagaccgacgcagcuaugacacucgccgaugccaaacccauacuggaacuugcuccaguugaccagaccacuuacauuaaggagaaagaugaacgaugcaagacauggaugugucgggugcgugacgaggguuuucaagucaucuucgaaccuuucaagaaucuguuuggcagcuauaucgggauuuucuacaccuuuaucauuucucuaauggcaauauucaucguaauuuacaucgugcuccccaucugcuuuaaacugagagauacauugaggcagcaugaggacgccuauaagcgcgagaugaaaauucgguga

SEQ ID NO: 10991 - RNA, 4323 nt, Artificial Sequence
  derived and/or modified CDS sequence (opt3) from TAHV(83)__GQ386825.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgacccaaaaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccgaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauaugaagacgcagccgggcuccugacccacaggaagacauacaacugccuugugcaguauaaaagcaaguggcugacuaacuuuuugauuguauacaucauccucaugcugauuaaggauucgguuuuaauagugcaugcugacggaaccgauuucgagaaauguucuggcgaagcggacaucacauggaauugcaccggcccauuucugaaccuagggaauugugagaagaaacagaagaaagaauccuauaacaauauugcaacucaacucaagggacuggaugccaucucaguccuugacauuccgaugaucaguaagauacccgaggauaucgcuggugccuugcgguucauugaggaacagcguagcuaccacgugcagcugacggcagaguacgccaugcucacacgcuauugcgacuacuauacccaguuuacugacaacuccggcuacucucaaaccacauggagagucuaucugaggagccaugauuucgaaguguguauccuuuacccuaaucagcacuuuugccgguguguuaaacacggggacaagugcucaaguuccaacugggauuucgcuaaugagaugaaaaacuauuacagcggaaagcagucuaaauuugacaaggaucugaauuuggcccucaugucacugcaucacgcauuccgaggcaccaguagcuucuacauugcgaaguuacugaaagaaaagaaaaacgaggaccuagugacuuaugcugagaagaucaaagguaaguacccagggaaugcccuccugaaagcaauaauugauuauaucaaguacaugaagggccuuacagaaaugaacaauuuuaaacaugacgagguaugggaugacuucauuuuugaagucccaccuacgaaguccccaucugugcgcagauuggagucgagcuaugauuucaaaaccaacguuaacuccaaucccucacacaucuguaagaacauaaaaacuguggucugccugaguccgaagucuggagugagcuacgacuccaucauugccuguggcgaaccuucacagcccagcaucuauaggaagccagauucucaaguauuucaguccaaugcugaccagacacacuucugccucagugacacccauugccuggagaacuacgagacagugggggaagagauuaucgaugccauuaaaaagagcaaauguugggaaacugaguuuaccgaguacauacaguucaagcaaucugacggaguucgguccugccgcaugaaagauucaggugaauguacggucaccacaaauagauggccuaucaucuuaugcgacaacgauaaguuuuauuacagugagcugcagaaggacuaugauaaagaccaggauauuggccacuucugucuuagccccaggugcaauacuauccgucauccaauuaaccggaagcacauaucgaauuguaccuggcaagugucccauaacaauaucgacaaaauugaagugcacgaguuggaagaucucgagcaguacaagaaagcaaucacacagaagcugcagacuucucuaacccuguuuaaguauagcaaaacgaagaaccucccccacauuaaaccuauguacaaguauaucacaauagaggggaccgaaacugcugagggaaucgaaucagccuacauugagagugaaaucccagcgcuggccggcacauccauugguuucaaaaucaccucuaagagcgggaaacaucuuuuggacgucauaggcuacguuaaguccgcuucauauagcgcaguguacacuaagcuguauaccacaggaccgacgauuggcgugaauaccaaacacgaugaguuaugcacugggcccuguccuguaaacgucccacauggaacagguuggcucaccuuugccaaggagcgaacaaguucuuggggcugcgaagaguucgggugucuggcuaucuccgacggaugcguguucggcagcugccaagacaucauuaaagaugaaauaacuguuuacagaaaggagaccgaagagacgacagacguggagcuuugucugaccuuugccgauaaaacuuauugcaccaauuugaacgcaaucacacccauuaucacugaccaguucgaaguccaguuuaagaccguggaggcguacucgcucccuaggauuaucgccguucgcaaccacgaaauaauggugggucagaucaaugauauugggguauauucaaagggcuguggaaacguccaaaaagugaauaacacaaauuacggcaacggggugccaaaguucgacuaccugugccaucuagcuucucggaaagaggucaucguuagaaaguguuuugauaaugacuaucaggccugcaaauuccugcagacgcccgcaaguuacaggcucgaggaagagggaggcuccgugaccguaauugauuauaagaagauccuggguacuauaaaaaugaaggcuauucuuggggacgugaaauacaagacauuugccgauaacgucgacuugaccguggaaggaguuuguacuggcugcaucaauuguuucgagaacauccacugcgaacugacaauucacagcaccguggaggcaucuuguccggucgugagcuccugcacgguuuuucaugaccgcaucuuaauaacuccuaaugagcacaaauaugccauuaaggugaucugcaacgaaaagccaggucccacccucccuuucaaaauuuguucagcuaagacagaugcggccaugacccuggcagacgcuaaacccauccuugagcuggccccagucgaucagacuacauacauaaaggaaaaagacgagcgaugcaagaccuggaugugucggguacgugaugaaggcuuucaagugauuuucgagccuuucaagaaucuauuugggaguuauaucggaaucuucuacacauuuauuaucagccucauggccauuuucauaguuaucuacauugugcugcccaucugcuuuaaauugagagacacucugaggcagcaugaggaugcuuauaagcgcgaaaugaaaauccgguga

SEQ ID NO: 10992 - RNA, 4323 nt, Artificial Sequence
  derived and/or modified CDS sequence (opt3) from TAHV(89)__GQ386826.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccaaagaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccgaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauaugaagacgcagccgggcuccugacccacaggaagacauacaacugccuugugcaguauaaaagcaaguggcugacuaacuuuuugauuggauacaucauccucaugcugauuaaggauucgguauuaauaguucaugcugacggcaccgauuucgagaaauguucuggcgaagcggacaucacauggaauugcaccgggccauuucugaaccuaggaaauugugagaagaaacagaagaaagaauccuauaacaauauugcaacucaacucaagggucuggaugccaucucagugcuugacauuccgaugaucaguaagauacccgaggauaucgcuggcgccuugcgguucauugaggaacagcguagcuaccacguccagcugacggcagaguacgccaugcucacacgcuauugcgacuacuauacccaguuuacugacaacuccggguacucucaaaccacauggagaguguaucugaggagccaugauuucgaggcuuguauccuuuacccuaaucagcacuuuugccggugugucaaacacggagacaagugcucaaguuccaacugggauuucgccaaugaaaugaaaaacuauuacagcggcaagcagucuaaauuugacaaggaucugaauuuggcacucaugucacugcaucacgcguuccgagguaccaguagcuucuacauugcuaaguuacugaaagaaaagaaaaacgaggaccuagugacuuaugccgagaagaucaaagggaaguacccaggcaaugcacuccugaaagccauaauugauuauaucaaguacaugaagggacuuacagaaaugaacaauuuuaaacaugacgagaugugggaugacuucauuuuuggcguucccccuacgaaguccccaucugugcgcagauuggaaucgagcuaugauuucaaaaccaacguaaacuccaaucccucacacaucuguaagaacauaaaaacugucgugugccugaguccgaagucugggguuagcuacgacuccaucauugcuuguggagagccuucacagcccagcaucuauaggaagccagauucucaaguguuucaguccaaugccgaccagacacacuucugccucagugacacccauugccuggaaaacuacgagacagucggugaggaaauuaucgaugcaauuaaaaagagcaaauguugggagacugaauuuaccgaguacauacaguucaagcaaucugacggcgugcgguccugccgcaugaaagauucaggggaguguacgguaaccacaaauagauggccuaucaucuuaugcgacaacgauaaguuuuauuacagugaacugcagaaggacuaugauaaagaccaggauauuggacacuucugucuuagccccaggugcaauacuauccgucauccaauuaaccggaagcacauaucgaauuguaccuggcaagugaaccauaauaacaucgacaaaauugagguucacgaauuggaggaucucgaacaguacaagaaagcuaucacacagaagcugcagacuucccuaacccuguuuaaguauucuaaaacgaagaaucucccccacauuaaaccuauguacaaguauaucacaauagagggcaccgagacugccgaagguaucgagagcgcguacauugaaucagagaucccagcccuggcugggacaaguauuggcuucaaaaucaccuccaagucuggaaaacaucuuuuggacgucauaggcuacgugaaaagcgcauccuauucagccguguacacuaagcuguauaccacagggccgacgauuggagucaacaccaaacacgaugaauuaugcacuggucccuguccuguuaaugugccacauagcacaggcuggcucaccuuugcuaaggagcgaacaaguucuugggggugcgaggaguucggaugucuggccaucuccgacggcugcguguucgguagcugccaagacaucauuaaagaugaaauaacuguauacagaaaggaaaccgaggaaacgacagacgucgagcuuugucugaccuuugcagauaaaacuuauugcaccaacuugaacgcggugacacccaucauuacugaccaguucgagguucaguuuaagaccguggaagccuacucgcucccuaggaucauugcuguccgcaaucacgagaucaugguggggcagauaaacgauaucggcguuuauucaaagggauguggcaaugugcaaaaaguaaacaauacaaacuacgggaauggagucccaaaguucgacuaccugugccaucuagccucucggaaagaagugauugugagaaaguguuuugauaacgacuaucaggcaugcaaauuccugcagacgcccgcuaguuacaggcucgaggaggaaggcgguuccgucaccguuaucgauuauaagaagauucuggggacuaucaaaaugaaggccauacuuggagacgugaaauacaagacauuugcagauaaugccgacuugaccguagagggcguguguacugguugcauuaacuguuucgaaaauauccacugcgagcugacaauccacagcaccgucgaggcuucuuguccggugguuagcuccugcacgguguuucaugaccgcauuuuaaucacuccuaacgaacacaaauaugcgauaaaggucauuugcaaugagaagccaggccccacccucccuuucaaaaucuguucagccaagacagaugcagcuaugacccuggccgacgccaaacccauucuugaacuggcuccaguggaucagacuacauacaucaaggagaaaggggaacgaugcaagaccuggaugugucggguucgugacgagggauuucaagugauauucgaaccuuucaagaaccuauuuggcaguuauauugggaucuucuacacauuuaucauuagccucauggcaaucuucauugucauauacaucguacugcccauuugcuuuaaauugagagauacucugaggcagcaugaggacgccuauaagcgcgagaugaaaauccgguga

SEQ ID NO: 10993 - RNA, 4323 nt, Artificial Sequence
  derived and/or modified CDS sequence (opt3) from TAHV(90)__GQ386827.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgaccaaagaagguugcuggaggucauauuaacgugaucgaggucggcgaugacuugaccuuacacacagaagcauauguguguaaugccgauugcacuauugggguagacaaggagaccgcucagguucgucugcaaacagauaccacuaaccauuuugaaaucgccggaacaaccgugaaaagcggcugguucaaguccacgacuuacauaacccuagaccagacaugugagcaccucaaagucucuugcgguccgaagucgauccaguuucaugcguguuucaaucagcacaugucaugcgugagauuucugcacaggacuauucuucccgggagcaucgcaaguuccauuugucaaaacguggagaucauaauucugaccgucuugacacuccugaucuucauucugcucucuaucuuaagcaaaaccuauaucugcuacauucugaugccuauauuuaucccacuugccuauauuuacggaguuaucuacaauaaguccuguaagaaaugcaaguugugcggccugguguaucaucccuucacggaauguggcacucacugcguauguggggcucgguacgagacaucagaucgcaugaaacuacauagagccaguggacucugcccugguuauaagagccugagggcagcucgggugauguguaaaucuaagggcccagccuccauacuuucaauuaucaccgcgguccugaucuugacuuuugugacacccauuaacgccaugguugcaggggacacccaggaaacguucaaacucgaggaucugccugacgacauguuaagcauggcuaugaaggugaauauguacuauaucaugugcaugauuaacuacgccgucaccuggaguuucauacugugugcucuccuuaucgcccuguuguuuaagaaauaucagcaccgcuuccuaaauuuuuacgcaauguacugccacgagugugauauguaucaugaccgaucuggacugaaguacaacggcgauuucacaaauaaaugcagacaguguacuugcggucaauaugaagacgccgcugggcuccugacccacaggaagacauacaacugccuugugcaguauaaauccaaguggcugacuaacuuuuugauuggauacaucauccucaugcugauuaaggauagcguauuaauaguucaugcggacggcaccgauuucgagaaauguucgggcgaagcagacaucacauggaauugcaccgggccauuucugaaccuaggaaauugugagaagaaacagaagaaagaaucuuauaacaauauugccacucaacucaagggucuggaugcuaucuccgugcuugacauuccgaugaucucaaagauacccgaggauaucgccggcgcauugcgguucauugaggaacagcguaguuaccacguccagcugacggccgaguacgcuaugcucacacgcuauugcgacuacuauacccaguuuacugacaacagcggguacucccaaaccacauggagaguguaucugaggucucaugauuucgaagccuguauccuuuacccuaaucagcacuuuugccggugugucaaacacggagacaagugcagcucaaguaacugggauuucgcaaaugagaugaaaaacuauuacuccggcaagcagagcaaauuugacaaggaucugaauuuggcgcucaugucucugcaucacgcuuuccgagguaccucaaguuucuacauugccaaguuacugaaagaaaagaaaaacgaggaccuagugacuuaugcagagaagaucaaagggaaguacccaggcaaugcccuccugaaagcuauaauugauuauaucaaguacaugaagggacuuacagaaaugaacaauuuuaaacaugacgagaugugggaugacuucauuuuugaaguucccccuacgaaaagcccauccgugcgcagauuggagucuucguaugauuucaaaaccgacguaaacagcaaccccucccacaucuguaagaauauaaaaacugucgugugccugucaccgaagaguggcguuucuuacgauagcaucauugccuguggggaaccuucccagcccucaaucuauaggaagccagacagccaaguguuucagucuaacgcagaccagacacacuucugccucuccgauacccauugccuggagaauuacgagacagucggagaagagauuaucgacgcuauuaaaaagaguaaauguugggaaacugaguuuaccgaguacauacaguucaagcaaagcgauggugugcggucuugccgcaugaaagacuccggcgaauguacgguaaccacaaacagauggccuaucaucuuaugcgauaauaacaaguuuuauuacucagagcugcagaaggacuaugauaaagaccaggauauugggcacuucugucuuagucccaggugcaauacuauccgucauccaauuaaccggaagcacauaagcaauuguaccuggcaagugaaccauaauaacaucgacaaaauugaaguucacgaguuggaagaucucgagcaguacaagaaagccaucacacagaagcugcagacuucgcuaacccuguuuaaguauuccaaaacgaagaaucucccccacauuaaaccuauguacaaguauaucacaauagagggaaccgaaacugcggagggcaucgaaucugccuacauugagagcgaaaucccagcucuggcagguacaucaauuggguucaaaaucaccaguaaguccggcaaacaucuuuuggacgucauaggauacgugaagucugccagcuauuccgcuguguacacuaagcuguauaccacaggcccgacgauuggggucaacaccaaacacgaugaguuaugcacuggacccuguccuguuaaugugccacaugguacaggcuggcucaccuuugccaaggagcgaacaucaagcugggggugcgaagaguucggaugucuggcaaucagugacggcugcguguucgguucuugccaagacaucauuaaagaugaaauaacuguauacagaaaggagaccgaagagacgacagacgucgagcuuugucugaccuuugcggauaaaacuuauugcaccaacuugaacgccgugacacccaucauuacugaccaguucgaaguucaguuuaagaccguggaggcuuacucccucccuaggaucauugccguccgcaaucacgaaaucaugguggggcagauaaacgauaucggcguuuauagcaagggauguggcaaugugcaaaaaguaaacaauacaaacuacgggaauggagucccaaaguucgacuaccugugccaucuagcaucgcggaaagaggugauugugagaaaguguuuugauaacgacuaucaggcuugcaaauuccugcagacgcccgccucauacaggcucgaggaagagggcgguucugucaccguuaucgauuauaagaagauucuggggacuaucaaaaugaaggcaauacuuggagacgugaaauacaagacauuugccgauaauguagacuugaccguggaaggcgucuguacugguugcauuaacuguuucgagaauauccacugcgaacugacaauccacaguaccguggaggcuuccuguccgguugugagcucuugcacggcguuucaugaccgcauuuuaaucacuccuaacgagcacaaauaugccauaaaggucauuugcaaugaaaagccaggccccacccucccuuucaaaaucuguagcgcaaagacagaugcugccaugacccuggccgacgcuaaacccauucuugagcuggcaccaguggaucagacuacauacaucaaggaaaaagacgagcgaugcaagaccuggaugugucggguucgugaugaaggguuucaagugauauucgagccuuucaagaaccuauuuggauccuauauuggcaucuucuacacauuuaucauuucacucauggccaucuucauugucauauacaucguacugcccauuugcuuuaaauugagagacacucugaggcagcaugaggaugcguauaagcgcgaaaugaaaauccgguga

SEQ ID NO: 10994 - RNA, 4323 nt, Artificial Sequence
  derived and/or modified CDS sequence (opt3) from TAHV(94)__GQ386828.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuuccggaaugccacugggacguacgcaaacaaugucgccauccgcaaguggcuggugagugauuggcacgacugccgacccaaaaagguuagcggaggucauauuaacgugaucgaggucggcgaugacuugaccuuacacacagaggcuuauguguguaaugcagauugcacuauugggguagacaaggaaaccgcccagguucgucugcaaacagauaccacuaaccauuuugaaaucgcuggaacaaccgugaaauccggcugguucaagucuacgacuuacauaacccuagaccagacaugugagcaccucaaagucucgugcgguccgaagucaauccaguuucaugccuguuucaaucagcacaugagcugcgugagauuucugcacaggacuauucuucccgggaguaucgcguccucuauuugucaaaacguggagaucauaauucugaccgucuugacacuccugaucuucauucugcucagcaucuuauccaaaaccuauaucugcuacauucugaugccuauauuuaucccacuugcauauauuuacggaguuaucuacaauaagucauguaagaaaugcaaguugugcggccugguguaucaucccuucacggaauguggcacucacugcguauguggggcccgguacgagacaagugaucgcaugaaacuacauagagcuagcggacucugcccugguuauaagucucugagggccgcacgggugauguguaaauccaagggcccagcuucaauacuuagcauuaucaccgccguccugaucuugacuuuugugacacccauuaacgcgaugguugccggggacacccaggaaacguucaaacucgaggaucugccugacgacauguuaaguauggcaaugaaggugaauauguacuauaucaugugcaugauuaacuacgcugucaccuggucuuucauacugugugcccuccuuaucgcucuguuguuuaagaaauaucagcaccgcuuccuaaauuuuuacgccauguacugccacgagugugauauguaucaugaccgauccggacugaaguacaacggcgauuucacaaauaaaugcagacaguguacuugcggucaauaugaagacgcagccgcucuccugacccacaggaagacauacaacugccuugugcaguauaaaagcaaguggcugacuaacuuuuugauuguauacaucauccucaugcugauuaaggauucgguuuuaauagugcaugcggacgggaccgauuucgagaaauguucuggagaagcagacaucacauggaauugcaccggcccauuucugaaccuaggcaauugugagaagaaacagaagaaagaauccuauaacaauauugccacucaacucaaggggcuggaugcuaucucaguccuugacauuccgaugaucaguaagauacccgaggauaucgccggagcauugcgguucauugaggaacagcguagcuaccacgugcagcugacggccgaguacgcuaugcucacacgcuauugcgacuacuauacccaguuuacugacaacuccgguuacucucaaaccacauggagagucuaucugaggagccaugauuucgaaguguguauccuuuacccuaaucagcacuuuugccgguguguuaaacacggcgacaagugcucaaguuccaacugggauuucgccaaugagaugaaaaacuauuacagcgggaagcagucuaaauuugacaaggaucugaauuuggcacucaugucacugcaucacgcguuccgaggaaccaguagcuucuacauugcuaaguuacugaaagaaaagaaaaacgaggaccuagugacuuaugccgagaagaucaaaggcaaguacccagguaaugcacuccugaaagccauaauugauuauguaaaguacaugaaggaccuuacagaaaugaacaauuuuaaacaugaugagaugugggacgauuucaucuuugaagucccaccuacgaaguccccaucugugcgcagauuggagucgagcuaugacuucaaaaccaacguuaacuccaaucccucacacauuuguaagaacaucaaaacuguggucugccugaguccgaagucuggggugagcuacgauuccauaaucgcuuguggcgaaccuucacagcccagcauuuauaggaagccagacucucaaguauuucaguccaaugccgaccagacacacuucugccucagugauacccauugccuggagaacuacgagacagugggagaagagaucauugacgcaaucaaaaagagcaaauguugggaaacugaguuuaccgaguacauacaguucaagcaaucugauggcguucgguccugccgcaugaaagacucaggggaauguacggucaccacaaauagauggccuauuaucuuaugcgauaacgacaaguuuuauuacagugagcugcagaaggauuaugacaaagaucaggacaucggacacuucugucuuagccccaggugcaauacuauucgucauccaaucaaccggaagcacauuucgaauuguaccuggcaagugucccauaacaauauagauaaaaucgaagugcacgaguuggaagaccucgagcaguacaagaaagcuauuacacagaagcugcagacuucucuaacccuguuuaaguauagcaaaacgaagaaccucccccacaucaaaccuauguacaaguauauuacaaucgaggguaccgaaacugccgagggcauagaaucagcguacaucgagagugaaauuccagcccuggcugggacauccaucggauucaaaauuaccucuaagagcggcaaacaucuuuuggaugucaucgguuacguuaaguccgcaucauauagcgccguguacacuaagcuguauaccacagggccgacgauaggcgugaauaccaaacacgacgaguuaugcacuggacccuguccuguaaacgucccacauggcacaggguggcucaccuuugcuaaggagcgaacaaguucuuggggaugcgaagaguucgguugucuggccauuuccgacggcugcguguucgggagcugccaagauaucaucaaagacgaaauuacuguuuacagaaaggagaccgaagagacgacagauguggagcuuugucugaccuuugcagacaaaacuuauugcaccaauuugaacgcgauaacacccaucauuacugaucaguucgaaguccaguuuaagaccguggaggccuacucgcucccuaggaucauugcuguucgcaaccacgaaaucauggugggacagauaaaugacaucggcguauauucaaaggguugugggaacguccaaaaagugaauaacacaaauuacggcaacggagugccaaaguucgauuaccugugccaucuagccucucggaaagaggucauuguuagaaaguguuuugacaaugauuaucaggcaugcaaauuccugcagacgcccgcuaguuacaggcucgaggaagagggcggguccgugaccguaaucgacuauaagaagauucugggaacuaucaaaaugaaggccauacuuggcgaugugaaauacaagacauuugcagacaacgucgacuugaccguggaagguguuuguacugggugcgugaauuguuucgagaacauucacugcgaaagcacaauccacucuaccgucgaggccagcuguccggugaucuccucaugcacgguuuuucaugaucgcauucugaucacuccuaaugagcacaaauaugcuauaaaggugauuugcaacgaaaagccaggacccaccuuaccuuucaaaaucuguagugcgaagacagacgccgcaaugacccucgcugaugccaaacccauucuggagcuugccccagucgaccagacuacauacaucaaggaaaaagaugagcgaugcaagaccuggaugugucggguacgugacgaaggcuuucaagugauauucgagccuuucaagaaucuguuugguagcuauauuggcaucuucuacacauuuaucauuucucuaauggcuaucuucauuguuauauacaucgugcuccccauuugcuuuaaacugagagauacuuugaggcagcaugaggacgcauauaagcgcgaaaugaaaauccgguga

SEQ ID NO: 10995 - RNA, 4323 nt, Artificial Sequence
  derived and/or modified CDS sequence (opt3) from TAHV(XJ0625)__EU622819.2__GP
augauguucgugcuguuuuucaucgcccucagcaccgcuucccccgucuaccagagaugcuuucaagacggcgcaauuguuaagcagaacccuucuaaacaggccgugacagagguaugucuuaaggaugacgugucaaugauaaaaacugaagcgagguauuucaagaaugcuacggggaccuacgccaacaaugucgcaauccggaaauggcuggugagugauuggcacgacugccgcccaaagaagguugccggaggucauauuaacgugaucgaggucggcgaugacuugacauuacacacugaagcauauguguguaaugcagauugcaccauugggguagacaaagagacagcccagguucgacugcaaaccgauacuacaaaccauuuugaaaucgcuggaaccacggugaaaagcggcugguucaaauccacuaccuacauaacacuagaccagacuugugagcaccucaaggucucuugcgguccgaaaucggugcaguuucaugccuguuucaaucagcacaugucaugcgugcguuuucugcacagaaccauccuucccgggagcauugcgaguuccaucugucaaaacgucgagauuaucauacugacaguuuugacccuccugauuuucauccugcucucuauuuuaagcaagacguauaucugcuaccugcuuaugccuaucuuuauuccauuggcauauguguacggaguaauauacaauaaguccuguaaaaagugcaaacugugcggccuaguguaucaucccuucacugaauguggcacacacugcgucuguggggccagguacgagaccucagaucggaugaagcuccaucgcgcuaguggacugugcccugguuauaaaagccuuagagccgcaagggugauguguaagucuaaaggcccagcuuccauccugucaguuauuacugccguguugauccucacauuugucacccccauaaacgcgaugguggccggggacacgcaggaaaccuucaagcuggaggauuuaccugacgacaugcugagcauggcaaugaagauucagauguacuauaucaugugcaucguaaauuacauuguuacauggaguuucaucgugugugcucucauuauagcccuuaucuuuaaaaaguaucagcaccgguuccugaacuuuuacgcuauguacugccacgagugugauauguaucaugaccgcucuggauugaaauacaauggcgauuucacuaacaagugccgacaauguaccugcggucaguaugaagacgccgcagggcuacugacacacagaaaaacuuacaauugccucguccaguauaaguccaaguggcuggugaacuuucuuauuaucuacauccuguugaugcucgucaaagauagcgugcugauuguucaagccgagggaaccgacuucgaaaaguguucgggcgagauaaacaucacauggaauugcaccggcccauuuuuaaaccuggggaauugugaaaagaagcagaaaaaggagccguauucuaacauugcuacucagcuaaagggacucgaugcgaucuccauucuggacauccccaugauaucaaggaucccugaggauauugcuggugcccuucgguucaucgaagaacagaauaguuaccaugugcaauugacggcugaauacgccaugcugacacguuauugcgacuacuauacccaguuuagcgauaacuccggcuacucucagaaaacuuggcgcguauaucucagaagccacgacuucgaggcauguauucuguacccaaaucagcauuuuuguaggugcgucaagcacggggacaaaugcucaaguuccaacugggauuucgccagcgaaaugaagaauuauuacaccggaaaacaacuuaaguuuaacaaggaccugaauuuggcucucaugucuuuccaccaugccuuccggggcacaucaaguuuuuacguggcaaaacuguuacgagagaagaacaaugaggaacugguuaacuauaccgagaaaaucaaggauaaauaccccgguaaugcgcuacucaaggcuauaauugacuauaucaaauacaugaagaaccugagcgaaaugacuaacuucaagcacgaugagaugugggacgauuuuguguucaauuccccuccaacaaaaucucccucgguccgcagaagcgacuccgccuaugauuuuaagaacaauauuaacucaaauccgagucauaucugucagaacauaaaaacggugaucugccuuucuccuaagagcgggguauccuacgacucaauuaucgcauguggcgaacccagccagccaaccauuuauaaaaagccugagucuaggguguuccaguccaaugccgaucaaacucacuuuugcuuggcugacacacacugccuggagaacuacgaaaccguuggagaggaaauccucgaugccauaaagaaaaguaaguguugggagacagacuucacugaguacauucaguuuaaacagagcgacggcguccggucuugccgcaugaaggauuccggggaauguaccgugacgacccauagauggcccaucauccugugcgacaauaacaaauucuauuacucagaguuacagaaggauuaugacaaggaucaagacauuggacacuuuugucugaguccaaggugcaauacaauccgucaucccauuaaccagaaacacauaagcaauuguacuuggcaagugucgcauaacaauaucgaaaagauugagguccacgaacuugagaacuuggagcaguacaaaaaggcaaucacccagaaacuccagacaucccugacucuauucaaguauucuaagaccaaaaaccugccucacauuaagccaauguacaaauauaucacgauagaagguacagagaccgcugaaggcaucgagagcgccuacauugaaucagagaucccggcgcucgccgggacaaguauuggauuuaagaucacuuccaaaucuggcaagcaucugcuugauguuauagguuacgugaaaagcgcuuccuauucagcaguguacaccaaguuguauacuaccgggcccacaauuggcguaaauacgaagcacgacgagcugugcaccggaccuuguccagucaacgugccccauggcacugggugguuaacauucgccaaagaacggaccagcaguuggggaugcgaggaguucgguugucucgcuaucucugauggcugcguuuuuggguccugccaggacaucauuaaggaggaacuggccguguaccgaaaagagacagaggaaacuaccgaugucgagcuuugucugacguucgcagacaagacauauugcaccaauuugaacgcgauaacuccuaucauuaccgaucaauuugaagugcaguucaaaacaguugagagcuacucgcucccaagaaucauugccgugaggaaucacgagaucaugguaggacagauaaacgacaucggcgucuauucaaaggguugugggaaugugcagaaggugaacaauacuaacuacggcaauggaguccccaaauuugacuaccugugccaucuagcuucucgcaaggaaguuauugugcggaaauguuucgauaacgacuaucaagccugcaaguuucugcagaccccggcaaguuacagacucgaggaagagggcggguccguaacagugaucgauuauaaaaagauucugggaacgaucaagaugaaagcuauacuuggcgacgucaaguacaaaaccuucgccgauaauguggacuugacuguugaagguguguguacagggugcauuaacuguuuugagaauauccacugcgagcugaccauccacagcacugucgaagcaucuuguccugugacaagcuccugcaccguuuuccaugauaggauuuuaaucacgccaaacgagcacaaguaugccauaaaagugauuugcgcugaaaagcccggaccuucacuccaguuuaagaucuguaacgcgaaaacugacgccgcaaugacccuggcugaugccaagcccauucuugagcuggccccagucgaccagacaaccuacaucaaagaaaaggauguacgcugcaaaacuuggaugugucgagugcgggacgagggccuacaaguuauauucgagccuuucaagaaucucuuugguaguuauauuggcaucuucuacacauuucugaucaccuugauugcuguguucgucgugaucuacauuguacugcccauaugcuuuaaguuacgugacacacucagacagcaugaagaugcauauaaaagggagaugaagauccgcuga

SEQ ID NO: 10996 - RNA, 4323 nt, Artificial Sequence
  derived and/or modified CDS sequence (opt3) from TAHV(XJ0708)__HM243138.1__GP
augauccuggugcucgucuucguugcccuuagcgcugcaucccccguguaccagagaugcuuucaagacggcgccauuguaaagcagucuccuucaaaacaggcggugaccgaggucugucugaaggaugacgugaguaugauaaaaacagaagcuagguauuucaagaacgccacugggacguacgcaaauaacguugccauccggaaaugguuggugagcgauuggcacgacugccgcccaaagaagauuuccggaggucauaucaaugucauugaggugggcgaugacuuaacccugcacacagaagcauauguauguaacgcagauugcaucauagggguugacaaagagacugcccaggugcgacuacaaaccgauacaaccaaucauuuugaaaucgcuggaacuacagucaagucuggcugguucaaaucgaccacguacauuacucucgaccagaccugugagcaccugaaggugucaugcgguccgaaaagcauccaguuucaugccuguuucaaccagcacaugaguugcgugcguuuucuucacagaacaauucugcccggguccaucgcgucuagcauaugucaaaaugucgagauuaucauuuugacuguucucacccugcugaucuucauccucuuauccauucugucaaagacauauauaugcuacauccuuaugccuauuuuuaucccauuggcauauguguacggaguaauauacaacaagaguuguaaaaagugcaaacugugcggccuaguguaucaucccuucaccgaauguggcacgcacugcgucuguggggccagguacgagacuagcgaucggaugaagcuccaucgcgcuucuggacugugcccugguuauaaaucccuuagagccgcaagggugauguguaagucaaaaggcccagcuagcauucugaguaucaucacagccguuuugauucucaccuuugugacucccaucaaugcgaugauugccggggaaacacaggagaccuucaagcuggaggacuuaccugaugacaugcugucuauggcaaugaagcucaacauguacuaucuuaugugcauagucaauuacaucgugacgugguccuuuauuaucugugcucugaucauugccuugauauucaaaaaguaucagcaccgguuccuaaacuuuuacgcuauguacugccacgaaugugacauguaucaugaucgcagcggacugaaauacaauggcgacuucaccaacaagugccgacaguguacaugcggucaauaugaggaugccgcagggcuccugacucacagaaaaaccuacaauugccuuguacaguauaagucgaaguggcugguuaacuuuuugaucguguacauucuccugauguuagucaaagacucuauccugauugugcaggccgaaggaacagauuucgacaaguguuccggcgaggcuggcaucauauggaacugcacugggccauuucuaaaucucggaaacugugaaaagaaacagaaaaaggagucauauaauaacaucgcgacccaacugaagggucuuaaugcaauuagugucuuggauaucccgaugauuagcaggauccccgaggacauagccggcgcucugcgguucauugaagaucagaacuccuaccaugugcagcucacagccgaguacgcaaugcugacccguuauugcgacuacuauacucaauuuucugauaauagcggguacucacagacgacauggcgcguuuaucuuagaagucacaacuucgaagccuguauccuguacuccaaucagcauuuuuguaggugcgugaaacacggagacaagugcucuagcucaaacugggacuucgcuaaugagaugaaaaacuauuacaguggcaagcagagcaaauuuaauaaggauuugaaccucgcccugauguccuuacaccaugcauuccgggguaccucuucguuuuacauugcgaagcugcuacgagagaaaaagaaugaggagcucaucaacuauguagaagagaucaaaaagaaauacccugggaacgcucugcuuaaggccgucauagacuauauuaaauacaugaagaauuugacugaaauggcuagcuucaagcacgaugagaugugggacgaguucguguaugaauccccacccacccgcucaccuagugccagaaggucugagagcgaauacgauuuuaaaacaaacguuaauuccaagccaacccauguguguaaaaacaucaagacugucgugugccugucacccaaaagcggcguaucuuaugacuccauuaucgcuuguggagagccgggccaaccuaguguguaccggaagcccgaacagcagguuuuccagagcaaugccgaucaaacacacuuuugccuccuggacacgcacugcuuagagaacuacaccacugucaaugaugagauacuggacgcaauuaagaaaucucgcuguugggaaacagaguucaccgaauauauccaguuuaagcagggggauggagugagauccugcaggaugaaagacucaggugagugugcuguggccgcgaaccguuggccaaucauucuuugcgauaauaacaaguucuacuauagugaauugcagaaagacuacgacaaggaucaagacaucggccauuuuugucucagcccucggugcaauacaauucgacaccccauaaaccagaagcauaucucgaauuguacuuggcaggucucccacaacaauauugagaaaaucgagguucaugaacuggagaaccuagaacaauauaagaaagccauuacccagaagcugcagacgucucucacccuguucaaauacagcaagacaaagaaccuuccacacaucaaacccauguauaaguacauaacuaucgaggggaccgaaacagcugagggaauugagucagcauacaucgaaagugagauuccugccuuggcuggcacuuccaucgguuuuaaaauaaccucuaagagcgggaaacaccuguuagaugugauuggcuaugugaaguccgccucauacagcaguguauauacgagacucuacacaaccggaccaacuaucggcaucaauacaaggcaugacgaacugugcaccgggccgugucccgucaacgugccucacaauacuggauggcuuaccuucgcaaaagagcgcacaucuuccugggguugcgaagaguuuggcugucuggcgauuagcgaugggugcguuuucggaucgugccaggacauaaucaaggaggaauugacgguguaucggaaggagaccgaagagacuacagaugucgagcucugucugaccuuugccgacaaaacauacugcacuaaccuaaaugcuauuaccccaaucauuacggaucaauucgaagugcaguucaagacaguugaggccuauucacugcccagaaucauagcagugaggaaccaugaaauccucguaggccagauuaaugaccugggugucuacucuaaaggguguggcaacgugcagaaggugaauaaaaccaacuacggaaauggcgucccuaaguuugauuaucuuugccacuuggcuagucgcaaggagguuaucgugcgaaaauguuucgacaacgauuaccaagccugcaaguuucugcagacuccagcauccuaucgguuagaagaggaagggggaaccguaacagugauugacuacaaaaagauccucggcacuauaaaaaugaaggccauucugggugacgucaaguauaaaaccuucgcugauaauguggaccuuacaaucgaagggguuuguacgggaugcaucaacuguuuugagaauauucauugcgaacugaccauccacagcacuguggaggcgucuugucccauaauuagcuccugcacagucuuccacgaucguauccuaauuaccccgaacgaacauaaguacgccaucaaagugauaugcaacgagaagccuggcucaagucucagcuuuagaguuuguaauacuaaaacagacgcagcuaugacccugacggaugccaagccaauuuuggagcuggcccccguggaccagacugcuuauaucaaggaaaaagaugagaggugcaagaccuggaugugucgcguccgggacgaagguuuacagguaaucuucgagccuuuuaaaaaccucuucggcucuuacauugggaucuuuuacacauucauucugucccuuauagcaaucuucauuaucaucuauauugugcugcccauaugcuuuaaguugagagauacccucaggcaacacgaagacgccuacaaacgagagaugaagauccgcuga

SEQ ID NO: 10997 - RNA, 4323 nt, Artificial Sequence
  derived and/or modified CDS sequence (opt3) from TAHV(XJ0710)__HM243141.1__GP
augauguucgugcuguuuuucaucgcccucagcgcugcaucccccgucuaccagagaugcuuucaagacggcgccauuguuaagcagaacccuucuaaacaggcggugaccgagguaugucuuaaggaugacgugucaaugauaaaaacagaagcuagguauuucaagaaugccacugggacguacgcaaacaaugucgccauccggaaauggcuggugagugauuggcacgacugccgcccaaagaagguugcuggaggucauauuaacgugaucgaggucggcgaugacuugaccuuacacacagaagcauauguguguaaugccgauugcacuauugggguagacaaagagaccgcucagguucgacugcaaacagauaccacuaaccauuuugaaaucgccggaacaaccgugaaaagcggcugguucaaauccacgacuuacauaacccuagaccagacaugugagcaccucaaggucucuugcgguccgaaaucggugcaguuucaugcguguuucaaucagcacaugucaugcgugcguuuucugcacagaacuauccuucccgggagcauugcaaguuccaucugucaaaacgucgagauuaucauacugaccguuuugacacuccugauuuucauccugcucucuauuuuaagcaagaccuauaucugcuaccugcuuaugccuaucuuuauuccauuggccuauguguacggaguaauauacaauaaguccuguaaaaagugcaaacugugcggccuaguguaucaucccuucacggaauguggcacucacugcgucuguggggcuagguacgagacaucagaucggaugaagcuccaucgcgccaguggacugugcccugguuauaaaagccuuagagcagcuagggugauguguaagucuaaaggcccagccuccauccugucaauuaucaccgcgguuuugauacucacuuuugugacacccauuaacgccauggucgcaggggacacccaggaaacguucaagcuggaggauuuaccugacgacaugcugagcauggcuaugaagauccagauguacuauaucaugugcauugugaauuacaucguaaccuggaguuucauuguuugugcccucauaaucgcucuuauuuuuaaaaaguaucagcaccgguuccugaacuuuuacgccauguacugccacgagugugauauguaucaugaccgcucuggauugaaauacaauggcgauuucacaaacaagugccgacaauguacuugcggucaguaugaagacgcagccgggcuacugacccacagaaaaacauacaauugccucgugcaguauaaguccaaguggcuggucaacuuucuuaucaucuacauucuguugaugcucgugaaagauagcguccugauagugcaagcugagggaaucgacuucgaaaaguguucgggcgagauuaacaucacuuggaauugcaccggcccauuuuuaaaccuggggaauugugaaaagaagcagaaaaaggagccguauucuaacauugcgacacagcuaaagggacucgaugcaaucuccauacuggacauccccaugauuucaaggaucccugaggauauugccggugcccuucgguucaucgaagaacagaauaguuaccauguucaauugaccgcugaauacgcaaugcugacucguuauugcgacuacuauacgcaguuuagcgauaacuccggcuacucucagacaaccuggcgcguguaucucagaagccacgacuucgaggccuguauacuguacccaaaucagcauuuuuguaggugcguaaaacacggggacaagugcucaaguuccaacugggauuucgcuagcaaaaugaagaauuauuacacuggaaaacaacuuaaguuuaacaaggaccugaauuuggcccucaugucuuuccaccaugcauuccggggcaccucaaguuuuuacgucgcgaaacuguuacgagaaaagaacaaugaugagcuggugaacuauacagagaaaauuaagaauaaauaccccgguaacgcucuacucaaggccaucauugacuauaucaaauacaugaaaagccuguccgaaaugaccaacuucaagcacgaugagaugugggacgauuuuguuuucaauucuccuccaacuaaaucgcccagcgugcgcagauccgacucagcauaugauuuuaagaacaauauaaacaguaauccgucucauaucuguaaaaacauuaagacagucgugugccuuagcccuaaauccgggguaucauacgacagcaucauugccuguggcgaacccucucagccaacgaucuauaagaagccugaguccaggguguuccagaguaaugcugaucagacccacuuuugcuuggccgacacucacugccuggaaaacuacgagacaguuggagaggaaauacucgaugcaauuaaaaagagcaaauguugggagaccgacuucacagaauacauccaauuuaagcagucugacggcguccgguccugccgcaugaaagauucaggggaguguacugugaccacgaauagauggcccaucauucugugcgacaacaauaaguucuauuacagugaguuacagaaggauuaugacaaagaucaggacaucggacauuuuugucugagcccaaggugcaacaccauucgucaccccauaaaucaaaagcauaucucgaacuguacauggcaagugucccacaauaacauugaaaagaucgagguccaugaacuugagaacuuggaacaguacaagaaagcuauuacucagaagcuccagaccucucugacacuauucaaguauagcaaaacuaagaaucugccucacaucaaaccaauguacaaguauauaaccaucgaggguacggagacagccgaaggcauugagucagcguacaucgaaagugagauuccggcccucgcugggaccuccaucggauuuaaaauaacuucuaagagcggcaaacaucugcuugauguuauugguuacgugaaguccgcaucauauagcgccguguacacaaaguuguauaccacugggcccaccaucggcguaaacacaaaacacgacgaacugugcacgggaccuuguccagucaaugugccccacggcaccgggugguuaacuuucgcuaaggagcggacaaguucuuggggaugcgaggaguucgguugucucgccaucuccgauggcugcguuuuugggagcugccaggacauuauaaaagaggaacuggcaguguaccgaaaggagaccgaagaggcgacagaugucgagcuuugucugacuuucgccgacaaaaccuauugcacgaacuugaaugcuaucacaccuauuaucaccgaucaguuugaagugcaauucaagacuguugagucguacucacucccaagaauuaucgccgugaggaaccaugaaauaaugguaggacagaucaaugacauuggcgucuauucuaaggguugugggaacgugcagaaagugaauaacaccaauuacggcaacggaguccccaaguuugacuaccugugccaccuagcaagucgcaaagagguuaucgugcggaaguguuucgauaaugacuaucaggcuugcaaauuucugcaaacaccggccuccuacagacucgaggaagagggcgggagcguaacugugauugauuauaagaagauccugggaaccauaaaaaugaaggcaauucuuggcgacgucaaauacaagacauucgccgauaacguggacuugacgguugaagguguguguaccgggugcaucaauuguuuugagaacauccauugcgaacugacuauucacucuacagucgaggcuagcuguccugugaccuccucaugcacuguuuuccacgauaggaucuuaauaacaccaaacgagcauaaauaugcgauuaaggugaucugcgccgaaaagcccggaccuagucuccaguuuaaaauuuguaaugcaaagaccgacgcugccaugacgcuggccgaugcuaaacccauccuugagcuggcaccagucgaccagacuaccuacauaaaggaaaaagaugagcgcugcaagacauggaugugucgaguacgggacgaaggccuacaggugauuuucgagccuuucaagaaccucuuugguagcuauaucggcaucuucuacaccuuucugauuacuuugaucgccguuuucauugugauauacaucguccugcccauuugcuuuaaauuacgugacacacucagacaacacgaggaugcguauaagagggaaaugaaaauccgcuga

SEQ ID NO: 10998 - RNA, 4326 nt, Artificial Sequence
  derived and/or modified CDS sequence (opt3) from TVTV__AF123491.1__GP
augaucguguucgcccugcucaccauugucgcugcaagccccguuuacaagagaugcuuucaggacggcgccauagugaggcaagaguauuccaaaaacgcgguaacagaagugugucuuaaggaugacgucucuaugaucaaaacugaggcugaauacuucaaaaauucaacggggguguuuaguaaaaacauugccuaucggaaguggcugguuagcgauuggaaugagugccgcccucagaaguccgcaaacggacacaucaaugugauugaaguccagccagacuugucuuuacagaccaacucguacgugugugccgcuacaugcguaaucucaauagauaaagagacugcacaaguucgacugcagaccgacacaaccaaucauuucgagaucagcgguacuacagugaagaguggcugguuuaaauccaccacguaucuaacucucgaucagaccugugaacaccugaagauuucuugcgggagcaaauccguccagcuucaugccuguuucaaccaacacaugucaugcgugcguuuucugcauagaacaaucuugccgggaaagcacaggaagaguauuugucagaauaucgagauaauuauccucacuagccugucucuguucauuuuucucuucuuaaccaucaucuccaaaacauacauuugcuaugugcugauacccaucuuuauuccuaucgcuuacgucuacggcuucauauauaacaagucauguaaaaagugcaaacuuugcgguuugguuuaccacccauuuaccgaaugugggagccauugcguguguggagccaaguaugacacgagugaucggaugaaaaugcacagaucuuccggccugugccccggcuacaagagccuacgcgcggcaaggucgauguguaagucuaaagggccugccccaauucucucccugcuuucagcuguacugaucuugacuuucgugacacccaucaccgccauuagucucaaggacgaggagaaagaaacuuauaagcugccugaguuaccagaugacaaagucaaucuggaaacaaagaucgaucucuacuuccagaugugccuuauuaacuaugcaaccacgugggcucugauauuuuguguguugaucaccgccugccuauucaagaaacugcagcauaaguuucucgacuacuacgcgguuuauugucacgagugcgacauguaccacgagaaaacaagccugaaguauaauggagauuucuccaacaaaugucggcaaugcacuugcgaacaguacgaggacgccaccggucuucugacacaucgcaagucuuauaaucgauuggugcaguacaaggcaaaauggacucucaacuuucugauuaccuaugcuaucuuagucaucauuaaggauagcgugaugauaguaggcgccucaaacacagacguuaaagauugucuggaccaagaagagaucaccuggaauugcacugggccguuccuaaacaugggaagauguacgaggccccagaagaaagaaaauuacggcaacauugcuacacagcucaagggucuggaugugcuuagugccuuggacaugccugcagucgggaagaucccagaggauauugccggagcucuguccuacaucgaaagcaaaaagaccuaucacgagcagcucacucuggaguuugcgaugcuuacccgguacugcgacuucuauaaacaauacgcagauaauucuggcuauucacagacaaccuggcgugccuacauacgcagucaugacuuuggcguguguaucauguaucccaaccagcacuucugcagaugugucaagaugggggaaaaaugcacuagcuccaauugggacuuugcuaaccagauggccaauuacuacaacggaaagcaaaauagguucaacaaagaucugaauuuggcacucuauacaaugcaucacgccuuucgggguucuacgucguaccugauuagcaagguguuacacgagaagaaauaugaccagcugaccaaccuacucacucagcugaagacaaaauacccuggcaaugcucuuuugaaggcccugaucggguaucagauuuaccucaaaucccugucagaaaugaguucuuucaccccagaugaguuaugggacgaucugcaauauguucccgcaccgacauucaagccuaaccuuggacgaagcggcgacaacgaauacaaguuugauaaaucccgcaucguggacccccagacuaccuguacgucauugaaggguguaaauugccucagcccaagaucuagggcguccgucagugauauaauugcuugugggcaggccacccagccugcacuguucuacgugcccaacgacaaaauccaucaaagcaauacagaucagaaccaguauugcauuggcgacucucacugccuaacuaaguuuaccccaaucacagaggagcugcucgccgcuguuaaaaaguccaagugucaagccuucgaucuggacaauauagugaaaacuucaaccaguacgggaguccggagcugccuugugaagaaauuuggcaacuguaauacaaccaaccagguauggcccaucacuauuugcucggacgaucaguacuauuacacagacaccaagcaguccuaugauucuuaccaagacaucgggcauuucuguuugagcccucgcugcucaacuauuagauauccagugaauccgaaacaccugagugcauguaccuggacagaagaguacacgcccguugauaagaucuccgucaccaacauagaagagauugagcaguacaagaaggcuuuacuccagaagcugcagacuggacuuaauaucuuuaaauauaggaagacaucuaaccugccucacaucaaaagcauguacaaguauauuaccgugcaagguacaggcacugccgaagggguggagaaugcguacaucgaauccgagaugccagccuuggcuggaucaagcaguggcuucaaaguccucucuaaggaagguaaccaucuguuugacguuguggcauauauuaaguccgccagcuacucgucaguguauaauaaacuauacucuaccgggcccacgcugggcauaaacguaaagcacgaugagaaaugcacaggaccuuguccagcuaacaucccccauaagaccggcuggcucacuuucgcccgugagcggaccaguacaugggggcgagaagaguacggaugccuggcaauuuccgacgguugugucuuuggcagcugccaggauaucauuaaaccggaaaugacuguguauagaaagcagaccgacgagaucguuacaguggaacuuugcuugacguucgucgauaagaccuacuguacugagcugaaugcggugacaccuauaaucucugacuuauuugagguucaguucaaaaccguggaaagcuauucccucccaaagauuguagccaucaaaaaccaccaaauuuucgucgggcagaucaaugugauaggaacuaacucaaagggcugcgguaaugugcaggucuuuaacgggacaaauuacggcaguggaacccccagguucgauuaucugugucaucuugcuagccgccgggagguuauuaugagaaaaugcuuugacaacgacuaccaagccuguaaguuccugcagcagccuucuuccuuuaggcuagaagaggaaggcgagacggugacuaucaucgauuauaagaaaauucucgggaccauaaagaugaaagcaaucuucggagacguaaaguaccgcacauuuucagagaaaguggauauuaaugcugaaggcgucugcgccgguuguaucaacugcuucgagcgaauuaauugugaauuuaccauccacaguacuguggagacaagcugcccccugguugcagacugucaguuguuccacgaucggcuguuaauaaccccaaacgagcauaaguacgccaucaaggcuauuugcaaagacaagccuuccaauacacuccguuuuucuaucugcaacacuaaaguggaagcgaccgucacgauuaucgaugccaagcccauacuggagcuugcaccaguggaccaaacagcuuauauuaaagaaaaggaugagagauguaagaccuggcugugcaggguuaaagacgaagggguggccgucuugcucgagccguucaagaaucuguucggaucguacaucggcaucuuuuaugguauuauccuaguagugcuggccauacuuguuuguauuuacaucgugcucccugucugcuucaaaauuaaggauacucugaaaaagcacgaggacgcuuauaaacgcgaaaugaagauccgguga

SEQ ID NO: 10999 - RNA, 4335 nt, Artificial Sequence
  derived and/or modified CDS sequence (opt3) from TVTV(AR42)__KX891322.1__GP
augagaaacaugaucguguucgcccugcucaccauugucgcugcaagccccguuuacaagaggugcuuucaggacggcgccauagugcggcaagaguauuccaaaaaugcgguaacagaagugugucuuaaggaugacgucucuaugaucaaaacugaggcugaauacuucaagaacucaacggggguguuuaguaaaaauauugccuaucgcaaguggcugguuagcgauuggaacgagugccgaccucagaaguccgcaaauggacacaucaacgugauugaaguccagccagacuugucuuuacagaccaauucguacgugugugccgcuacaugcguaaucucaauagauaaagagacugcacaaguucgucugcagaccgacacaaccaaccauuucgagaucagcgguacuacagugaagaguggcugguuuaaauccaccacguaucuaacucucgaucagaccugugaacaccugaagauuucuugcgggagcaaauccguccagcuucaugccuguuucaaucaacacaugucaugcgugagauuucugcauaggacaaucuugccgggaaacauugcuaauaguaucugucagaacauagagauuaucauucucacuagccugucucuguucaucuuucucuucuuaaccaucauuuccaagacauacauaugcuaugugcugauccccauuuuuaucccuauagccuacgucuacggcuucauuuauaauaagucauguaaaaagugcaaacuuugcgguuugguuuaccacccauuuaccgaaugugggagccacugcguguguggagcgaaguaugacacgagugaucggaugaaaaugcauagaucuuccggccugugccccggcuacaagagccuacgcgcagccaggucgauguguaaaucuaaggggccugcuuccauccucucacugcuuagugccguacugaucuugacuuucgugacaccaauuaccgcaaucagccucaaggacgaggagaaagaaacuuauaagcuguccgaguuacccgaugacauggucaaccuggaaaauaaaauugaucucuacuuccagaugugccuuauaaacuaugcuacaaccugggcccugaucuuuugugcguugauuacggccugccuauucaagaaacugcagcacaaguuucucgacuacuacgcaguguauugucaugagugcgacauguaccacgaacggcgcggacugaaguauaacggugauuucucuaauaaaugucgacaauguaccugcggccaguacgaggacgcuacagggcuucugacucacagaaagagcuauaacugcuugguucaguacaaagccaaguggaugcucaauuuucugaucaccuaugcuaucuuagugauuauaaaagauucagucaugaucgugggagccagugacacagauguaaaggacugccuggaucaagaggaaauuacuuggaacuguaccggcccuuuccuaaauauggguuccugcacaaggccacagaagaaagagaacuacgggaauaucgcaacccagcucaagggacuggacguucuuagcgccuuggauaugccggcugugggcaaaauucccgaagacaucgcgggcgcacugucuuacauagagucaaagaaaacuuaucaugaacagcucacgcuggaguuugccaugcuuacacgguacugugauuucuauaagcaauacgcugacaacaguggguauagccagaccacuuggcgugccuacauccgcucccacgacuuuggagucugcauuauguauccuaaucagcauuucuguagaugcgugaagaugggugagaaauguaccucuucgaacugggauuuugcaaaucagauggccaacuacuacaauggcaagcaaaacagguucaauaaagaccugaacuuggcucucuauacaaugcaccaugccuuucgggggagcaccuccuaccugaucucaaaggucuuacacgagaaaaaguaugaucagcugacuaaccuacucacacagcugaaaacgaaguacccaggaaaugcacuuuugaaggcgcugauugacuaucagaucuaccucaaaagucugucugaaaugagcuccuucacccccgaugaauuaugggacgaucugcaauaugugccugcuccaacuuucaagcccaaccuuggccgaucagaggacaaugaauacaaauuugauaagagccgcauaguugacccgcagacaaccugcacaucuuugaaaggugugaacugucucuccccuagaaguagggccagcguaucugauauuaucgcaugcgggcaggccacucagcccgcucuguucuacgucccaaaugacaagauucaccaauccaacaccgaucagaaucaguauugcaucggcgacucacauugucuaacgaaguuuaccccuauaacagaggagcugcucgccgcagugaaaaagaguaaaugccaggcuuucgaccuggaugacaucguuaagacuagccccucgaccggagugcgguccugucuugucaaaaaguuuggcaacugcaauacaacuaaccaaguguggccaauuaccaucuguucugaugaccaguacuauuacacggauacaaagcagagcuaugacucaaaucaagauauugggcacuucugcuugaguccccgcuguuccaccaucagauacccuguaaacccaaaacaucugucugccugcacuuggacagaagaguauaccccgguggacaagauaagcguuacuaauauugaagagaucgagcaguacaaaaaggcguuacuccagaaacugcagaccggacuuaacaucuuuaaguacaagaaaacauccaaucugccccacauuaagccuauguauaaauacaucacgguccaagguaccgaaacugccgagggcguggaaaacgcuuauauugagucagaaaugccagcauuggccgggagcaguucuggauucaaggugcucuccaaagagggcaaccaccuguuugaugucguugcuuacauaaagagcgccucguauucaucuguguacaauaaacuauauaguacaggucccacccuggggaucaacgugaagcaugacgagaaguguacaggcccuugcccagcaaauauuccccacaaaacuggauggcucaccuucgcgagggaacguacguccacauggggcugugaggaauacgggugccuggccaucagcgauggaugcguauuugguucuugucaggacauuaucaagccggagaugaccgucuaccggaaacagacugaugaaauagugaccguugagcuuugcuugacauucguggacaagacuuauuguaccgagcugaacgcugucacaccuaucauuagcgacuuauuugaagugcaguucaaaacgguugaguccuacucacucccaaagaucguggccauuaagaaucaucaaaucuucguaggccagauaaacgauauugggaccuauaguaaaggaugcggcaauguccagguguuuaacgguacuaauuacgggagcggcacaccccgauucgacuaucugugucaccuugcaucuagaaaggaagugaucaugaggaaaugcuuugauaacgacuaccaggcuuguaaguuccugcaacagccuuccucauuucgccuagaggaagagggagagaccgucacuaucauugauuauaaaaagauacucggcacaaucaagaugaaagccauuuucggggacguuaaguacaaaaccuuuagugaaaagguggauaucaaugcagagggaguaugcgccggcuguauuaacugcuucgaaagcaucaauugugaguuuacgauacauuccacuguggagaccucuugcccccuggucgcugacugccaguuguuccacgaucggcuguuaaucacaccaaacgaacacaaauacgcgauuaaggccaucuguaaggacaaaccuucgaauacccucagauuuagcauuugcaacacuaagguggaggcaacaguuaccaucauagaugcuaaacccauucuggaacuugccccaguggaccaaacagccuauaucaaggagaaagacgaaagguguaagacuuggcugugccgcgucaaggaugaggguguggcuguuuugcucgagccguucaaaaaccuguucgggucauacaucggaauauuuuauggcaucauucuagugguccuggcaauucuuguauguaucuacauugugcucccuguuugcuucaagauccgagacacccugaaaaagcaugaagaugccuauaaacgggagaugaagauacguuga

SEQ ID NO: 11000 - RNA, 4335 nt, Artificial Sequence
  derived and/or modified CDS sequence (opt3) from TVTV(Eklund)__KR149248.1__GP
augagaaacaugaucguguucgcccugcucaccauugucgcugcaagccccguuuacaagaggugcuuucaggacggcgccauagugcggcaagaguauuccaaaaaugcgguaacagaagugugucuuaaggaugacgucucuaugaucaaaacugaggcugaauacuucaagaacucaacggggguguuuaguaaaaauauugccuaucgcaaguggcugguuagcgauuggaacgagugccgaccucagaaguccgcaaauggacacaucaacgugauugaaguccagccagacuugucuuuacagaccaauucguacgugugugccgcuacaugcguaaucucaauagauaaagagacugcacaaguucgucugcagaccgacacaaccaaccauuucgagaucagcgguacuacagugaagaguggcugguuuaaauccaccacguaucuaacucucgaucagaccugugaacaccugaagauuucuugcgggagcaaauccguccagcuucaugccuguuucaaucaacacaugucaugcgugagauuucugcauaggacaaucuugccgggaaacauugcuaauaguaucugucagaacauagagauuaucauucucacuagccugucucuguucaucuuucucuucuuaaccaucauuuccaagacauacauaugcuaugugcugauccccauuuuuaucccuauagccuacgucuacggcuucauuuauaauaagucauguaaaaagugcaaacuuugcgguuugguuuaccacccauuuaccgaaugugggagccacugcguguguggagcgaaguaugacacgagugaucggaugaaaaugcauagaucuuccggccugugccccggcuacaagagccuacgcgcagccaggucgauguguaaaucuaaggggccugcuuccauccucucacugcuuagugccguacugaucuugacuuucgugacaccaauuaccgcaaucagccucaaggacgaggagaaagaaacuuauaagcuguccgaguuacccgaugacauggucaaccuggaaacaaaaauugaucucuacuuccagaugugccuuauaaauuaugcuaccacgugggcccugaucuuuugugcguugauuaccgccugccuauucaagaaacugcagcacaaguuucucgacuacuacgcaguguauugucaugagugcgacauguaccacgaacggcgcggacugaaguauaacggugauuucucuaacaaaugucgacaaugcacaugcggccaguacgaggacgcuacugggcuucugacccacagaaagagcuauaauuguuugguucaguacaaagccaaguggaugcucaacuuucugaucacauaugcuaucuuagugauuauaaaagauucagucaugaucgugggagccaguaauacugacguaaaggauugccuggaccaagaggaaauuaccuggaacuguacaggcccuuuccuaaauauggguaggugcacccggccacagaagaaagagaacuacgggaauaucgcaacucagcucaagggacuggauguucuuuccgccuuggacaugccggcugugggcaaaauucccgaagauaucgcgggcgcacugagcuacauagagucuaagaaaacguaucaugaacagcucacacuggaguuugccaugcuuacccguuacugugacuucuauaagcaauacgcugauaacucaggguauagucagacuaccuggcgcgccuacaucagaagccacgacuuuggagucugcauuauguauccuaaucagcauuucuguaggugcgugaagaugggugagaaauguacauccucuaacugggacuuugcaaaucagauggccaacuacuacaauggcaagcaaaaccgguucaauaaagaucugaacuuggcucucuauaccaugcaccaugccuuucgagggucgacuagcuaccugaucuccaaggucuuacacgagaaaaaguaugaccagcugacaaaccuacucacgcagcugaaaaccaaguacccaggaaaugcacuuuugaaggcgcugauugauuaucagaucuaccucaaaucacugagugaaaugucuagcuucacucccgacgaauuaugggaugaccugcaauaugugccugcuccaacauucaagcccaaccuuggccgcuccgaggauaaugaauacaaauuugacaagucaagaauaguugauccgcagaccacaugcacuagcuugaaaggugugaacugucucucuccuaggucccgggccaguguaagcgacauuaucgcaugcgggcaggccacccagcccgcucuguucuacgucccaaaugauaagauucaccaaucuaacacggaccagaaucaguauugcaucggcgauucccauugucuaaccaaguuuacaccuauaacugaggagcugcucgccgcagugaaaaagucaaaaugccaggcuuucgaccuggacaacaucguuaagaccagucccagcacaggagugcgcucgugucuugucaaaaaguuuggcaauugcaacacuaccaaucaaguguggccaauuacgaucuguuccgaugaccaguacuauuacacagauaccaagcagucuuaugacagcuaccaagauauugggcacuucugcuugucacccagauguaguacuaucagguauccuguaaacccaaaacaucuguccgccugcacauggaccgaagaguacacuccgguggacaagauaucuguuaccaauauugaagagaucgagcaguacaaaaaggcguuacuccagaaacugcagacaggacuuaacaucuuuaaguaucguaagacgagcaaucugccccacauuaaaccuauguacaaguauaucaccguccaagguacugaaacagccgagggcguggaaaacgcuuacauugaguccgaaaugccagcauuggccgggucaagcaguggauucaaagugcucucuaaggagggcaaccaccuguuugaugucguugcuuauauaaaauccgccagcuacucgucaguguauaauaagcuauacucuaccggucccacacuggggaucaacgugaaacaugacgagaaguguacuggcccuugcccagcaaauauuccccacaagaccggauggcucacguucgcgcgggaacgaacaaguaccuggggcugugaggaauacgggugccuggccaucuccgauggaugcguauuugguagcugucaggacauuaucaaaccggagaugacugucuauagaaagcagaccgaugaaauagugacaguugagcuuugcuugacuuucguggacaaaaccuacuguacagagcugaacgcugucacgccuaucauuucugauuuauuugaagugcaguucaagaccguugagagcuauucccucccaaaaaucguggccauuaagaaucaucaaaucuucguaggccagauaaacgacauugggacuuacucaaagggaugcggcaauguccagguguuuaacgguacaaauuaugggaguggcacccccagguucgacuaccugugucaccuugcaagccgcaaagaagugaucaugcggaagugcuuugauaacgacuaucaggcuuguaaauuccugcaacagccuucuuccuuuagacuagaggaagagggagagacugucacaaucauugauuacaagaaaauacucggcaccaucaagaugaaggccauuuucggggacguuaaauacaagacguuuucagaaaaaguggauaucaaugcagagggaguaugcgccggcuguauuaacugcuucgaaaguaucaauugugaguuuacuauacauagcaccguggagacauccugcccccuggucgcugacugccaguuguuccacgauaggcuguuaaucaccccaaacgaacacaaguaugcgauuaaagccaucuguaaggacaagccuucuaauacucuccgcuuuucgauuugcaacacaaaaguggaggcaaccguuacaaucauagaugcuaagcccauucuggaacuugccccaguggaccaaacugccuacaucaaagagaaggaugaacgauguaaaaccuggcugugccgggucaaggacgaggguguggcuguuuugcucgagccguucaagaaccuguucgggagcuauaucggaauauuuuacggcaucauucuagugguccuggcaauucuuguauguaucuauauugugcucccuguuugcuucaaaaucaaggacacgcugaaaaagcaugaagaugccuacaaacgugagaugaagauaagauga

SEQ ID NO: 11001 - RNA, 4335 nt, Artificial Sequence
  derived and/or modified CDS sequence (opt3) from JCV(3324-04)__HM007357.1__GP
auggaggugcugaaccucaucuggcuucugaccuugugcuuagccagccccgucuuccagagauguuuucaagacggcgcuauuguuaagcagaauccuuccaaagaagcagugacagagguaugccugaaggaugacgugucuaugauaaaaacugaagccaaguacgucaaaaacacgaccgggacauucgcgaauaacaucgcuaugaggaaguggcuaguggccgauuggcacgacugucggccacagaagucaaguggaggucauauuaauguuaucgaggugggcgaugaccucagccugcacacugaauccuauauuugcucugcagauugugucaucaccguggacaaagagacagcccagauacgccuucaaaccgauaacacuaaucauuuugagguagcugggacaaccguuaagucgggaugguucaaaucaacgacuuacaucacccuggaccagacaugcgaacacuugaaggugagcuguggcccgaaaaguauucaguuucaugcaugcuucaaccagcacauguccuguguccgauuucuccaccguacuauccugcccgguucuauugccaauagcaucugccaaaacauagagauuaucauucuggugacccucuccuuagugaucuucaucuuucugacaauugucucaaagaccuauauauguuaccuuuugaugccuaucuucauuccaaucgcuuuuauauauggguggauuuacaauaagaguugcaaaaagugcaaacuguguggccuaguuuaucaucccuucacggaaugcggaacucacugugugugcggcgccagauacgagacaagcgauaggaugaagcuccaucgggcgucugggcuguguccuggauacaaaucccuucgcgcagccagaguaaugugcaagucaaaagguccagcuagcgugcugaguaucaugaccgccgucuugauccucacuuuugugacacccauuucugcaaugguuaucggcgaguccagcgaaauuuauacccuggaggacuuaccugaugacauggugcagauggcugaaaggauaaacaucuacuaucagauuaucaucauuaauuacgggauaacgugggccuuccugcuccuuggacuguugcuagcguauuucuuucggaaguaccagcaccgcuuccuggacuuuuaugccauguacugugaggaaugcgauauguaccacgagaaggcaggccucacccauuggggugacuucacaaacaaaugucgacaaugcacuugugggcaguaugaggauaucaccggacugaugguccacaagaaaucguacaauugccuugugaaguauaaagcuaaguggauuagagacauccugauuacauacuugguaaucauacucguuaaggauucucuguuauuugugggcgccacuggcaccgacuucgcuacaugcaucgaugagaaaaccgucacuuggaacuguacggggccauuucugaaccuaggaaggugcgacaagucccagaaaaagacaaauuaugccgauauugcaaaccaacucaaaggucugggcgugaucucaguccuugacauuccgaugaucaagaagaugcccgaugagauaagugggagcuugaaauacauugacaaucuggaaaccuaucaugagcagcucacugccgaauacgcuuuccugacccgguacugugacuauuacacacaguauaccgauaacuccggauacucucagacuguguggcguacauaucuucgcagccacgacuuuggcgcgugcguuguguacccuaaucaacauuucuguagaugcguaaaguauggugauaaauguaacucagcaaagugggacuuugccaaugagaugaaaacguucuacaccgggcagaaggcuaaguuuaacaaagaucugaauuuggcccuccuggucuuacacaaggcauucaggggcacuggaacagccuacaucgcugaggccauggcacggaaagacaacggcaguauggcgcacuucgcucuggaagugcgaaagaaauuuccaaccaaugcccuacucgcagcccugauugauuauaucguuuaccuucaguccuuggcugagauaagcacauucgaacuggacgaggauugggaagacuuuaaguauaaacccgagccuacugagucuaccauccaggcccgcucacauagagaugaccaauacaacuucaagaaugcagcuagugggagcaacgugaaggucugcaaaaauauucagaaggugcucuguaucuccccaaggucucgggccaaauuugaaaacauuaucgcgugcggagagcacgccaaccccucgguauauaugaugccgaaugugagcauauaccaguccucaagugaacgcucucauuauuguauugcugauagccacugccuggaggaguacgaaguugucgagacggaauuacugaacgcacuuaagaaauccaagugcugggugaaggagauggacgacgugaucuugcacaaacagucagauggucucagaagcuguaggaugaaggacaccggcaauugcaacguccaagaaaaugauuggaacaucguucugugugagaaugggaacuacuauuacucugagauucauaaagacuaugauaaggaccaggaugugggacacuucugccuauccccucguuguaauacaauccgguaccccauuaguaaacgacauauaagaagcugcaacuggcagaucucucacuccacuauugacaagaucgccgugcaggaacuggcugauauugagcaauauaagaaagccaucucacagaagcuccagaccagucugagcauauuuaaauacaucaagacuaaaaaucuuccacauauuaagccugcauauaaguacaucacaguagaaggcgucgagaccguggaagguauugagaacgcguucaucgagucggaaauacccgccuuggcugggacggccauuggcuuuaaaaucaauuccagggagggaaacuaccugauggacguuaucggcuaugugaagucugcaagcuacucagcuacauauaccaaauuauacacuacagggccaaccauuggaauaaauacucgccacgaugaaaaguguaccggucccugcccugccgucaucgaccacaaagauggcuggcucacauucaguaaggagcggacguccaccugggggugugaagaguuuggaugccuggcagugucugacggcuguguuuucgguagcugccaagacauuaucaaagaugagcuugccguguauagaaagacuacagaagaacugaccacaguagaauugugccucacuuuuuccgacaagaccuacuguacgaaccugaacgcuauuacaccaaucauaaccgauaaauucgagguccaguucaagacuguggaggcguauacccuaccgaggaucauugccgugaaaaaucaugaaaucaaggucgggcagauuaacgaccugggcguuuacucaaaaggaugcggcaaugugcagaagguaaacgggacaaauuacggaaacggcgcaccccgcuuugauuaucucugucaccuggcuagccgaaaggaggugauccuucggaaaugcuucgacaaugauuaccaagccuguaaguuuuugcagaguccuucuuccuaucgucuggaagaacaucaggguacugucaccgugauagacuacaaaaagauuuuagggacaaucaaaaugaaggccauccucggagauguuaaguauaaaaacuuccagagcaauauugaaaucaacgcugagggcacgugcgcagguuguauaaauugcuuugagaacauucacugugaguucaccauccauacuacaguggagaccucgugcccaauugucacugacugugugucauuucacgauagaauccugauaacacccgacgaacacaaguacgcccuuaaaguugugugccaagacaagccuaaagucucucugaaguucaagauuugcaauaccaacaucgaugcgaguaugacgaucguagacuccaaaccaauucuagagcucgcucccguggaucagacugccuauaucagggaaaaggacgagcgcuguaaaaccuggaugugccggguuagagaugagggcuuucaggugauucuggaaccguucaagaauuuguuugggagcuacauaggaaucuucuacacaggcauucugucuaucaucuguuuacucauugucauauauaucauucugccuaucugcuucaaacuuagggacacccugcgacagcaugaggaugcauacaagaaggaaaugaaaauucgcuga

SEQ ID NO: 11002 - RNA, 4335 nt, Artificial Sequence
  derived and/or modified CDS sequence (opt3) from JCV(61V2235)__U88058.1__GP
auggaggugcugaaccucaucuggcuucuggccuugugcagcgcuucccccgucuuccagagauguuuucaagacggagcaauuguuaagcagaauccuucuaaagaagccgugaccgagguaugcuuaaaggaugacgugucaaugauaaaaacagaagcgaaguacgucaaaaacacuacggggaccuucgcuaauaacaucgccaugaggaaguggcugguggcagauuggcacgacugucggccacagaagaguagcggaggucauauuaauguuaucgaggugggcgaugaccuaucccuccacacagaaucuuauauuugcucggccgauugugucaucacuguggacaaagagaccgcucagauacgccugcaaacagauaacaccaaucauuuugagguagcagggacuacaguuaagucaggaugguucaaaagcaccacguacaucacucuugaccagaccugcgaacaccugaaggugaguuguggcccgaaauccauucaguuucaugccugcuucaaccagcacaugucuuguguccgauuuuugcaccguacaauccuccccgguagcauugcuaauuccaucugccaaaacauagagauuaucauucuggugacucugucacucgugaucuucaucuuuuuaaguauugucagcaagaccuauguuuguuaccugcuuaugccuauauucacaccaaucgccuuuauuuauggguggguguacaauaagucuugcaaaaagugcaaauuguguggacugguauaucaucccuucaccgaaugcggcacgcacugugugugcggcgcgagauacgagaacuccgauaggaugaagcuacaucgggcaucagggcucuguccuggauacaaaagccugcgcgccgcuagagucaugugcaagaguaaagguccagccucuauccuuuccauaaugacugcaauucugaucuugacauuugugacccccaucagcgcuaugguuauuggcgagucgucugaacucuauacucuggacgauuuaccuaaugacauggugcagauggccgagagggucaacaucuacuaucagauuacaauaaucaauuacggggugaccugggcguucuucugucugggacucauucuugccuacuuuuucaagaaguaucagcacaaauuucuggacuucuaugcaauguacugcgaagagugugauauguaccacgaaaaguccggcuugacgcauuggggugacuuuaccaacaaaugccggcaauguacaugcgggcaguucgaggauguagcuggacuaaugauccacaagaaaucauauaacugccugguuaaguacaaggccaaauggauccgcgacauucucauaaucuaucuggcuaugauucuuaucaaggauagucuguuguuugugggcgccagcggcacugacuucgcagccuguauugaugagaaagucgugaccuggaauugcacagggccauuucucaaccugggacgaugugacaagucccagaaaaaggcuucuuacgcggguaucgcagaucaauuaaagggccugggggucauaagcgugcuagacaucccgaugauuaaaaauaugcccgaugaaaucucaggaagucucaaguauauugacucccuggagacuuaccaugaacagcuuaccgccgaguaugcuuucuugacaagauacugcgacuacuauacccaguacacugauaaaagcggcuauucucagacgguuuggaggacauaccugcggucacacgacuuuggugccugugugguauauccuaaccaacauuucugccguugugucaaguacggggauaaaugcaauagugcaaagugggacuuugccaacgaaaugaagaccuucuauacuggccagaaagugaaguucaauaaagaucucaaccuggcccuucugguuuugcacaaggcuuuucgcggaaccggcacagcauacguggcggaggcuauggccagagaggacaaugggagcauggcacacuucgcccucgaaaucaggaaaaaguuuccaaccaacgcucuguuagccgcacugauagauuacauugucuaucuacagucccucggagagaucgcuacuuucgaacuggacgaggauugggaagacuuuaaauacaagcccgagccuacagagucuacgccacaggugcggucgcaucgaaaugaucaauauaacuucaagaaugccgaaagcaacuccgacaccaaaguauguaagaaugugcagaaaguucuuugcauuucaccccgcaguaaggcgaaauuugagaacaucauagccuguggugaacacgcuaacccgucugucuacaugaugccuaaugugagcaucuaucaguccaacucagagagaagccauuacugcauugcaggcucucacugcuuggagaaguaugaaguggucgagacugaacugcucaaugcccugaagaaauccaaguguugggcuaaagagauggaugacaucauuuuacacaagcagagugacgggcugaggagcugccggaucaaagauacaggaaacuguaauguucaagaaaacgacuggaccauagugcuuugcgagaauggcaacuacuacuauucugaggugcauaaggauuacgacaaggaucaggacguaggucacuucuguuugucaccccgcugcacaacuauuagauauccaaucuccaaaaggcauaucaagaaaugugaauggcagauuagucacagcaccaucgauaagauuucgguccaggagcucgccgacauagaacaauacaaaaaggcaaucucccagaagcugcagacgucucuaagcauuuuuaaauaugugcguaccaagaaucugccucauaucaaacccgcguacaaguauauuacaguugaggggguggaaacuaucgagggcauagagaacgccuucaucgaaucagagauuccagcucucgccggaaccgcaaucggcuuuaaaauuaauagucgggaagggaacuaccugauggaugucaucggauacgugaaguccgcuucuuauagcgccguuuacacaaaacuuuauacuaccggucccacgauaggcauuaauacaaagcacgacgagaagugcaccgggccuuguccagcaaucaucgaucacaaagacggaugguugacuuucuccaaggaacgaacaucaaccuggggcugcgaggaguuugguugucuggccgugagcgaugggugcguauucggcaguugccaagacauuauaaaagacgaauuagcugucuacagaaagacuaccgaggaacucacaacgguggagcugugucuuaccuucucugauaaaacuuauugcacaaaccugaaugcgaucaccccgauuaucacagacaaguuugaggugcaguucaagacugucgaauccuacaccuugcccaggguuauugccaucaaaaaccaugagauaaaggugggacagaucaacgaucucggcguauauagcaaaggguguggaaaugugcagaaggucaacggcacgaauuacgguaacgggucgccucgcuuugacuaccugugccaccuagcaucacggaaagaagugauucugagaaaguguuucgauaaugacuaucaggcuugcaaguuucuccaaucuccaaguuccuacaggcuggaggaacaucagggaacaguuaccgugaucgauuauaaaaagauucuuggcacuaucaaaaugaaggccauauugggugacgucaaauacaagaacuaucagaauaacauugagaucagcgccgagggcaccugugcugggugcaucgauuguuucgaaaauauucacugcgaguuuacaauccauacuaccguggaagcaucuugucccauaacaacggagugcguuagcuuccacgaccgcauucugaucaccccugaugaacacaaguacgccuuaaaaauugugugccaugacaagccaaaagucucccucaaguuuaaaaucuguaacacucacguagacgcggcuaugacaauaguggauucaaagcccauucuggagcuugccccgguugaccaaaccacuuauauccgagagaaggaugaacggugcaaaacauggaugugucgugugagagacgagggauuccaggucauccuggaaccuuuuaagaaucuauucggcaguuacauugggaucuucuacaccggcauucucagcauaaucugccuguugauugugguauauaucauccugccaauuuguuuuaaauuaagggauacgcuccgccagcaugaggacgcauacaagaaagaaaugaagauacgguga

SEQ ID NO: 11003 - RNA, 4335 nt, Artificial Sequence
  derived and/or modified CDS sequence (opt3) from JCV(61V2235)__HM007351.1__GP
auggaggugcugaaccucaucuggcuucuggccuugugcagcgcuucccccgucuuccagagauguuuucaagacggcgcaauuguuaagcagaauccuucuaaagaagccgugaccgagguaugcuuaaaggaugacgugucaaugauaaaaacagaagcgaaguacgucaaaaacacuacggggaccuucgcuaauaacaucgccaugaggaaguggcugguggcagauuggcacgacugucggccacagaagaguagcggaggucauauuaauguuaucgaggugggcgaugaccuaucccuccacacagaaucuuauauuugcucggccgauugugucaucacuguggacaaagagaccgcucagauacgccugcaaacagauaacaccaaucauuuugagguagcagggacuacaguuaagucaggaugguucaaaagcaccacguacaucacucuugaccagaccugcgaacaccugaaggugaguuguggcccgaaauccauucaguuucaugccugcuucaaccagcacaugucuuguguccgauuuuugcaccguacaauccuccccgguagcauugcuaauuccaucugccaaaacauagagauuaucauucuggugacucugucacucgugaucuucaucuuuuuaaguauugucagcaagaccuauguuuguuaccugcuuaugccuauauucaucccaauugccuuuaucuauggguggguguacaauaagucuugcaaaaagugcaaauuguguggacugguauaucaucccuucacagaaugcggcacccacugugugugcggcgcgagauacgagacguccgauaggaugaagcuacaucgggcaucagggcucuguccuggauacaaaagccugcgcgccgcuagagucaugugcaagaguaaagguccagccucuauacuuuccauuaugacugcaauccugaucuugacauuugugacccccauuagcgcuaugguuaucggcgagucgucugaaguguauacucucgacgaucugccuaacgacaugguccagauggccgagagggugaauauuuacuaucagauaaucauuaucaacuacgggguaacaugggcguucuuacugcucggacuuauccuggccuauuucuuuaagaaguaccagcacaaauucuuggacuuuuaugcaauguacugugaagagugcgauauguaccacgaaaaguccggccuaacccauuggggugacuucacgaauaaaugucggcaaugcaccugugggcaguuugaggauguugcuggacugaugauucacaagaaaucauauaacugccucgugaaguacaaggccaaauggauacgcgacauccugauuaucuaucuugcuaugauucugaucaaggauagucucuuguucgucggcgccagcggcacagacuuugcagccugcauagaugagaaaguggucacuuggaacuguaccgggccauuccugaauuuaggacgaugcgacaagucccagaaaaaggcuucuuacgcggguaucgcagaucaacugaagggccuaggggugauuagcguucucgacaucccgaugauuaaaaacaugcccgaugaaaucucaggaagucugaaguauauagacucccuugagacauaccaugaacaguugacugccgaguaugcuuuucugaccagauacugugacuacuauacacaguacaccgauaauagcggcuauucucagacuguguggaggacguaccuccggucacacgacuucggugccugcguagucuauccuaaccaacauuuuugucguugcgugaaauacggggauaaguguaauagugcaaaaugggacuucgccaacgaaaugaagacauuuuauaccggccagaagguuaaauucaauaaggaucugaaccuugcucuguuggugcuccacaaagccuuccgcggaacuggcaccgcauacgucgcggaggcuauggccagaaaggacaaugggagcauggcacacuuugcccuggagauuaggaaaaaguucccaacaaacgcuuuacuggccgcacuaaucgauuacauuguguaucuccagucccugggagaaaucgcuaccuuugagcuugacgaagauugggaggacuucaaauacaagcccgaaccuacugagucuacaccacagguacggucgcaucgaaaugaucaauauaacuuuaagaaugccgagagcaacuccgacacgaaagugugcaagaauguucagaaagucuuguguauaucaccccgcaguaaggcgaaauucgaaaacaucauugccugcggugagcacgcuaacccgucuguguacaugaugccuaaugugagcaucuaucaguccaacucagaaagaagccauuacuguauugcagauucucacugccuggagaaguaugaggucguugaaaccgagcuccugaaugccuuaaagaaauccaagugcugggcuaaagaaauggacgacaucauacugcacaagcagagugauggccuuaggagcugucggauuaaagacacugggaacugcaaugugcaagagaacgauuggacaaucguguugugugaaaauggaaacuacuacuauucugagguacauaaggacuacgauaaggaccaggaugucggccacuuuugccucucaccccgcuguaccacaaucagauauccaauuuccaaaaggcauaucaagaaaugcgaguggcagauuagucacagcacuauagacaagaucucggugcaggaacuggccgauauugagcaauacaaaaaggcaaucucccagaagcuacagaccucucugagcauuuucaaauauguucguacgaagaaucucccucauaucaaacccgcguacaaguauauaaccguggaaggugucgagacaaucgaagggauugagaacgccuuuaucgagucagaaauuccagcucuggccggcacugcaaucggauucaaaauaaauagucgggagggcaacuaccuuauggacgugauuggguacguuaaguccgcuucuuauagcgccguguacaccaaauuguauacaacuggacccaccaucgguaucaauacgaagcacgaugaaaaguguacaggcccuugcccagcaauuauagaccacaaagauggguggcugaccuuuuccaaggagcgaacuucaacauggggaugugaagaguucggcugcuuagccguaagcgacgguugugucuuugggaguugccaagacaucauuaaagaugagcucgcuguguacagaaagaccacugaagaacugaccacaguggaacuuugccugacguucucugacaaaaccuauuguacuaacuugaaugcgaucacaccgauuaucaccgauaaguucgagguccaguuuaagacaguugaguccuacacucuccccagggugauagccaucaaaaaccaugaaauuaagguaggccagaucaacgaccugggaguguauagcaaaggcugcgggaauguccagaaggugaacggaaccaauuacggcaacgguucgccucgcuucgauuaccuaugucaccuggcaucacggaaagagguuauucucagaaagugcuuugacaaugauuaucaggcuuguaaguuccugcaaucuccaaguuccuacaggcuugaggagcaucaggggacggugacagucaucgacuauaaaaagauauugggaaccauuaaaaugaaggccauccugggcgaugugaaauacaagaacuaucagaauaacaucgaaauuaaugccgaggguacuugcgcuggcuguaucgacugcuuugagaacauacacugugaguucaccauucauacaacuguugaagcaagcugccccaucaccacagaaugugugucuuuucacgaucgcauuuuaaucacgccugacgagcacaaguacgcccucaaaauagucugccaugacaagccaaaaguaagccugaaguucaaaauuugcaauaccaacguggaugcggcuaugacuaucguugacuccaagcccauccuugaacuggccccgguggaucaaacaaccuauauucgagagaaggacgagcgguguaaaacuuggaugugccgugucagagaugaaggguuucaggugauccuagagccuuucaagaaucucuuuggaucauacauuggcauauucuacacagggauccugaguauuaucuguuugcugaucguaguguauauuauauuaccaaucugcuucaaacucagggacacccugcgccagcacgaagaugcauacaagaaagagaugaagauucgguga

SEQ ID NO: 11004 - RNA, 4335 nt, Artificial Sequence
  derived and/or modified CDS sequence (opt3) from JCV(61V2235)__KX817316.1__GP
auggaggugcugaaccucaucuggcuucuggccuugugcagcgcuucccccgucuuccagagauguuuucaagacggcgcaauuguuaagcagaauccuucuaaagaagccgugaccgagguaugcuuaaaggaugacgugucaaugauaaaaacagaagcgaaguacgucaaaaacacuacggggaccuucgcuaauaacaucgccaugaggaaguggcugguggcagauuggcacgacugucggccacagaagaguagcggaggucauauuaauguuaucgaggugggcgaugaccuaucccuccacacagaaucuuauauuugcucggccgauugugucaucacuguggacaaagagaccgcucagauacgccugcaaacagauaacaccaaucauuuugagguagcagggacuacaguuaagucaggaugguucaaaagcaccacguacaucacucuugaccagaccugcgaacaccugaaggugaguuguggcccgaaauccauucaguuucaugccugcuucaaccagcacaugucuuguguccgauuuuugcaccguacaauccuccccgguagcauugcuaauuccaucugccaaaacauagagauuaucauucuggugacucugucacucgugaucuucaucuuuuuaaguauugucagcaagaccuauguuuguuaccugcuuaugccuauauucaucccaauugccuuuaucuauggguggguguacaauaagucuugcaaaaagugcaaauuguguggacugguauaucaucccuucacagaaugcggcacccacugugugugcggcgcgagauacgagacguccgauaggaugaagcuacaucgggcaucagggcucuguccuggauacaaaagccugcgcgccgcuagagucaugugcaagaguaaagguccagccucuauacuuuccauuaugacugcaauccugaucuugacauuugugacccccauuagcgcuaugguuaucggcgagucgucugaaguguauacucucgacgaucugccuaacgacaugguccagauggccgagagggugaauauuuacuaucagauaaucauuaucaacuacgggguaacaugggcguucuuacugcucggacuuauccuggccuauuucuuuaagaaguaccagcacaaauucuuggacuuuuaugcaauguacugugaagagugcgauauguaccacgaaaaguccggccuaacccauuggggugacuucacgaauaaaugucggcaaugcaccugugggcaguuugaggauguugcuggacugaugauucacaagaaaucauauaacugccucgugaaguacaaggccaaauggauacgcgacauccugauuaucuaucuugcuaugauucugaucaaggauaguuuacucuucgucggcgccagcggcacagacuuugcagccugcauagaugagaaaguggucacuuggaacuguaccgggccauuccugaauuuaggacgaugcgacaagucccauaaaaaggcuucuuacgcggguaucgcagaucagcugaagggccuaggggugauuagcguucucgacaucccgaugauuaaaaacaugcccgaugaaaucucaggaagucugaaguauauagacucccuugagacauaccacgaacaauugacugccgaguaugcuuuucugaccagauacugugacuacuauacacaguacaccgauaauagcggcuauucucagacuguguggaggacguaccuccggucacaugacuucggugccugcguagucuauccuaaccagcacuuuugucguugcgugaaauacggggauaaguguaauagugcaaaaugggacuucgccaacgaaaugaagacauuuuauaccggccaaaagguuaaauucaauaaggaucugaaccuugcucuguuggugcuccacaaagccuuccgcggaacuggcaccgcauacgucgcggaggcuauggccagaaaggacaaugggagcauggcacauuuugcccuggagauuaggaaaaaguucccaacaaacgcuuuacuggccgcacuaaucgauuacauuguguaucuccagucccugggagaaaucgcuaccuuugagcuugacgaagauugggaggguuucaaauacaagcccgaaccuacugagucuacaccacagguacggucgcaccgaaaugaccaguauaacuuuaagaaugccgagagcaacuccgauacgaaagugugcaagaauguucaaaaagucuuguguauaucaccccgcaguaaggcgaaauucaagaacaucauugccugcggcgaacaugcuaacccgucuguguacaugaugccuaaugugagcaucuaucaguccaacucagagagaagccacuacuguauugcagacucucacugccuggaaaaguaugaggucguugagaccgaacuccugaaugccuugaaaaaguccaaaugcugggcuaaggagauggaugacaucauacugcauaaacagagugacgggcuuaggagcugucggauuaaggauacuggaaacugcaaugugcaggaaaacgacuggacaaucguguugugugagaauggcaacuacuacuauucugaaguacacaaggauuacgacaaagaucaagacgucggucauuuuugccucucaccccgcuguaccacaaucagauauccaauuuccaagaggcacaucaaaaagugcgaguggcagauuagucauagcacuauagauaaaaucucggugcaggagcuggccgacauugaacaguacaagaaggcaaucucccaaaaacuacagaccucucugagcauuuucaaguauguucguacgaaaaaucucccucacaucaagcccgcguacaaauauauaaccguggagggggucgaaacaaucgagggcauugaaaacgccuuuaucgagucagagauuccagcucuggccggaacugcaaucggcuucaagauaaauagucgggaagggaacuaccuuauggaugugauuggauacguuaaauccgcuucuuauagcgccguguacaccaaguuguauacaacuggucccaccaucggcaucaauacgaagcacgacgagaaauguacagggccuugcccagcaauuauagaucauaaggacggauggcugaccuuuuccaaagaacgaacuucaacauggggcugugaggaguucgguugcuuagccguaagcgaugggugugucuuuggcaguugccaggacaucauuaaggacgaacucgcuguguacagaaaaaccacugaggaacugaccacaguggagcuuugccugacguucucugauaagaccuauuguacuaacuugaaugcgaucacaccgauuaucaccgacaaguucgaaguccaauuuaaaacaguugaguccuacacucuccccagggugauagccaucaagaaccacgagauuaaaguaggacagaucaacgaucugggcguguauagcaaggggugcggaaauguccagaaagugaacggcaccaauuacgguaacgggucgccucgcuucgacuaccuaugucaucuggcaucacggaaggaaguuauucucagaaagugcuuugauaaugacuaucaggcuuguaaauuccugcaaucuccaaguuccuacaggcuugaggaacaccagggaacggugacagucaucgauuauaagaaaauauugggcaccauuaagaugaaagccauccugggugacgugaaguacaagaacuaucagaauaacaucgagauuaaugccgaaggcacuugcgcuggguguaucgauugcuuugagaacauacauugugaguucaccauucacacaacuguugaagcaagcugccccaucaccacagagugugugucuuuucacgaccgcauuuuaaucacgccugaugaacauaaauacgcccucaagauagucugccacgacaaaccaaagguaagccugaaauucaagauuugcaauaccaacguggacgcggcuaugacuaucguugauuccaagcccauccuugagcuggccccgguggaccagacaaccuauauucgagaaaaagaugagcgguguaagacuuggaugugccgugucagagacgagggauuucaagugauccuagaaccuuucaaaaaucucuuuggcucauacauugggauauucuacacaggaauccugaguauuaucuguuugcugaucguaguguauauuauauuaccaaucugcuucaagcucagggauacccugcgccagcaugaggacgcauacaaaaaggaaaugaaaauucgguga

SEQ ID NO: 11005 - RNA, 4335 nt, Artificial Sequence
  derived and/or modified CDS sequence (opt3) from JCV(3573-03)__HM007354.1__GP
auggaggugcugagccucaucuggcuucugaccuugugcuccgccucucccgucuuccagagauguuuucaagacggcgcuauuguuaagcagaacccuucaaaagaagcagugacagagguaugcuuaaaggaugacgugaguaugauaaaaacugaagccaaguacgucaaaaauacgaccgggacauucgcgaacaauaucgcuaugaggaaguggcugguggccgauuggcacgacugucggccacaaaagagcuccggaggucauauuaacguuaucgaggugggcgaugaccuaucucuccacacugaaucguauauuugcucagcagauugugucaucaccguggacaaagagacagcccagauacgccugcagaccgauaauacuaaccauuuugagguagcugggacaaccguuaagagcggaugguucaaaaguacgacuuacaucacccuugaccagacaugcgaacaccugaagguguccuguggcccgaaaucuauucaguuucaugcaugcuucaaucagcacaugagcuguguccgauuuuugcaccguacuauccuccccuccucaauugccaacaguaucugccaaaauauagagauuaucauucuggugacccugagccucacaaucuucaucuuuuuaaccauugugucuaagacguauauauguuaccugcuuaugccugucuucaucccaauugcuuuuguuuaugguuggaucuacaacaaguccugcaaaaagugcaaauugugugggcugguguaucaucccuucacugaaugcggaacacacuguguaugcggcgccagauacgagaccucagauaggaugaagcuacaucgggcgagcggccucuguccuggguacaaaagucugcgcgcagccagagugaugugcaagucuaaaggaccagcuuccauacuuagcauuaugacugccguccugaucuugacauuugugacccccaucucggcaaugaugauuggugagucuuccgaaguuuauacgcucgacgaucugccugacgacauggugcagauggcugagagggucaauaucuacuaucagauuauaaucauuaacuacggcgugaccugggccuucuuacugcucgggcuuguacuggcguauuucuuuaagaaguaccagcacaaauucuuggauuuuuaugccauguacuguaaugaaugcgacauguaccacgagaaggcaggacuaacacauuggggcgauuucacuaaccggugucgccaaugcaccuguggucaguaugaagacguuacagggcugaucgugcacaaaaagucauacaauugccucgucaaauauaaggcuaaguggauccgagauauucugauaacuuaccuuaucauuauccuggugaaagacaguuugcucuuugucggagccaccggcacagauuucgcugccugcauugacgagaagaccgugacuuggaacuguacgggcccauuucugaacuuagggagaugcgauaaaagccagaagaaaacauccuauaaugacaucgcaaaccaacugaagggacuagguguuauaucugugcucgauaucccgaugauuaagaggaugcccgacgagaucagcggcucacugaaauacauugacaaucuugaaaccuaucaugagcaguugacugccgaauacgcuuuccugacccgguacugugauuauuacacacaguauaccgacaacaguggguacucccagacuguauggcguacauaucuccgcagccacgauuuuggagcgugcgucguguacccuaaucaacauuucuguagaugcguuaaguauggcgacaaauguaacucugcaaagugggauuuugccaaugagaugaaaacguucuacaccggucagaagaucaaguuuaacaaagaccugaaucuugcucuguuggugcuccacaaggccuucagggggacuggcacagcauacauagccgaagcuauggcccggaaagauaacggaucaauggcacacuucgcgcuggagguccgaaagaaauuuccaaccaaugcuuuacuggccgcacuaauugacuauaucguguaccuccagagucuggccgagauuagcacauucgaacuugaugaggacugggaagauuuuaaguauaaacccgagccuacugaauccccaucucaggcucgcucgcauagaagcgaccaauacaacuucaagaaugccgaguccaacucaaauguaaaggugugcaaaaacauccagaagguuuuguguauaagucccaggucucgggcaaaauuugagaacaucauugcuugcggcgaacacgccaauccgagcgucuauaugaugccuaacguguccaucuaccagucaaauagcgagcgcucucauuauuguauugcggauucccacugccuggaagacuacgagaucguggagaccgaacuccugagugccuuaaagaaaagcaagugcugggcuaaggagauggacgauauaguccugcacaaacagucugacgggcuuagauccuguaggaugaaggauacgggaaacugcgacguucaagaaaaugauuggaccauuguguugugugagaacgguaauuacuauuacucagaaauccauaaagacuaugauaaggaccaggaugugggccacuucugccucaguccccguuguagcacaauccgguacccaauuaacaaacgacauaucaagagaugcaauuggcagauuucgcacuccacuauagacaagaucucuguacaggagcuggcagauauugagcaauauaaaaaggccaucagccagaaacuacagaccucacugaguauuuuuaaguacgucaaaacaaagaaccucccucauaucaagcccgcuuauaaauacauaacuguggaagggaucgagaccguugaaggaauugagaaugccuucaucgaauccgagauuccagcacuggcgggcacggccaucgguuuuaagauaaacucuagggaggggaauuaccuuauggacgugauuggcuaugucaaaagcgcuuccuacucagccacauauaccaaguuguacacuacaggacccaccaucggcaucaacacucgccacgaugaaaaauguaccgggccuugcccagcagugauugaccacaaggacggauggcugacauucagcaaagagcggacgaguaccugggguugugaagaguuuggcugcuuagcuguuucugauggguguguguucggauccugccaagacauaaucaaggaugaacucgccguauauagaaagacuacagaggagcugaccacagucgaacuuugccugacuuuuagcgacaaaaccuacuguacgaauuugaacgcaauuacaccgaucauuaccgauaaguucgaggugcaguucaaaacuguggaaucguauacccuccccagggucaucgccguuaagaaccaugagauaaaagugggccagaucaaugaccuggguguauacucaaaggggugcggcaacgugcagaaggucaauggaacaaacuacggcaaugggaugccuaaauuugauuaucuaugucaccuggcuucucgcaaggaggugauucuccgaaaaugcuucgacaacgauuaccaagcguguaaguuucugcagaguccauccagcuaucggcuugaggaacaucagggaacuguuaccaucauugacuacaaaaagaucuugggcacaauaaagaugaaagccauucugggugaugugaaguauaaaaauuaccagucuaacaucgaaaucaaugcagaggggacgugcgcuggauguauuaacugcuucgaaaauauccacugugaguuuaccauacauacuacagucgaggccagcugccccauugugaccgacuguguuuccuuccacgaccguaucuuaauuacuccugaugaacacaaguaugcccucaaaguggucugccaagacaagccaaagguaucacugaaauuuaagaucugcaacacaaauauagaugcuaguaugaccauuguggacagcaaacccauccuugagcuggcaccgguugaucagacggccuacaucaaggaaaaagacgagagauguaagacuuggaugugcagggugcgcgaugaaggcuuccaggucauucuagagccuuuuaagaaccucuucgguucuuacaucggcauauuuuauaccgggauucuguccgugaucuguuugcugauuguaaucuacaucauuuuaccaauaugcuucaaacuccgggacacacugagacagcaugaggaugcguauaagaaagaaaugaagaucagguga

SEQ ID NO: 11006 - RNA, 4335 nt, Artificial Sequence
  derived and/or modified CDS sequence (opt3) from KEYV(KEYV/Ochlerotatus atlanticus/USA/KEYVLK01/2005)__KT630289.1__GP
augaugaucuggauucugcucaccguggucacaguuacuauagccaaccccguguaccagagaugcuuccaagacggcgcuaucguaaagcagaauccuagcaaagaggcagugacggaagucugucuuaaggaugacguguccaugauuaaaaccgaggccaaguauguuaaaaaccugacagggacuuuuucuaauaacguggcgaugaggaagugguuggucgcugauuggcacgacugccggccacagaagcgcgccggaggucauaucaaugugauugaaguaggcgaugacuuaucacugcacaccgagaguuacaucuguagcgcagauugcguuauauccguggacaaagaaacagcccagauccgacuacaaaccgauacuacaaaccauuucgaggucgcugggaccacggugaagucuggaugguuuaaaucgacuaccuauauuacacucgaccagacuugugagcaccugaaggugucaugcggcccgaaaagcauccaguuccaugcauguuuuaaucagcacaugaguugcguccguuuccuucacagaaccauucugcccgguuccaucgccaacucuauaugucaaaauauugaaaucauuaucuugguuacacucacccugcugaucuuuauucucuuaagcauacuguccaagacguacaucugcuauauucuuaugccuaucuucauaccaauugcuuacaucuauggguggguguacaacaagucauguaaaaagugcaaauugugcggacugguauaccaucccuuuacugaguguggcacacacugcguguguggcgccagguaugaaaccagugaucggaugaagcuacaucgcgcgagcgggcucugcccuggauacaaaucucugagagcagccagggucauguguaaguccaaagguccagcuucaauccuuagcauucugacugccguguugauccucacauucauuacccccaugaaugcaaugguucugggcaguucugaggagguguauaaguuagaagaccugccugaugacaugcucaacauggcugagaagauagacaucuacuaucuuuccauuguccugaauuacagcacgaccuggggguugcuaauccugcuccugaucgugucgugccuuuuuaaaaaguaucagcacguauuccugaacuacuacgccauguauugucacgaaugcgauauguaccaugagaaaaagaauuugguuuauaacggagacuuuucuaacaaaugucggcagugcacauguggccaguacgaagaugcgacuggucucauugugcaccaaaaguccuauaauugccugauaaaguacaaagccaagugguucaucaacauuuuaaucauuuauaccauccugguccuacucaaagacucagugcugauggcagcugccgaggggccagauuucaauacaugcauagagcagcgcaguaucagccuuaacuguacuggaccguuuauuaauuugggcggcugcgaaaagccccagaaacgagcuuccuaccaaucuaucgccgagcagcugaaggcaauuaacgccaucagcauacucgacaugccuaugauuucaaagaucccagaugacauuaguggggcucugagacauaucgaaaaucuuaaaaccuaccacgagcagcugacagcggaguucgcaauguugaccagguauugugauuacuauacucaguuuuccgacaacagcggauacucucaaacgucauggcggacauaucuccguagucaugauuucgaggucugcauagccuaccccaaucagcacuuuugucgcugcgugaagaacggugagaaauguaccagcgcuaauugggacuucgccaacgaaaugaagaauuauuacacuggcaaacagaucagauuugacaaggaucugaacuuagcacugaccacacuacacaccgccuucagggggacuuccacauacuauaugucugacauucucgcugagacgaaggccaauucgcugcgggauuacgcacuugcguugaaaagcaaguauccuggaaacgcucugcucaaagccauccuggacuuuauuauguacuuacagucccugaacgaagcaaccaaguucaaacuuucaagugauugggaggacuuuaaguauaauucugaauuggaggcccgagcucucaugccacgcgccagaagcuccggcgauuacaacuucucaaaugcagagagcacuaacaaaguuaagaucugcaagaauauacaaagggugaugugucugucuccccgguccaaagcuacaguagaagacauuaucgccugcggugagcaugaacacccgagugucuauauggugccuaacaccacaaucuaccagagcaauauugagcgcucucauuacuguaucgcggauucccacugccuagaggaauaugagcugguucagaacgaacuccugacugcccuuaagaaaucaaccugcuggacgggggaguuggaaaaugugauuccccacaagcagagugacggcauaagaagcuguaggaccaaaaacacaggacguugcaaugucaagggcgaggauuggacugugauccugugugagaacgacaaguacuauuacucggaauuaaauaaagauuaugacaaggaccaagauauugggcauguaugccucuccccacgguguaacucuauccgauacccuauuagccccagacacaucaccaauugcaaaugggagaacccagcuggaacaauaucaaggaucgaaacucauagucuggcagacauugagcaguauaagaaagccaucucccagaaacuucagaacucucugaccauuuuuaaguacgaaaagacgaagaauuugccccacaucaaaccuauauacaaguauauuacaaucgaggguaccgagacuguggaaggcguugagaacgcuuucaucgaagccgagauuccagcacucgcggggacaagcauaggauucaaagucaauucccgcgauggcgaccaucugauggauaucauugccuacaucaagguggcuucauauagcaguaccuacacuaagcuauauaccacagguccgacgauugggaucaacaccaaacacgacgaaaaguguacuggcaauugccccgcccggcuggagcacaaagugggauggcucacauuugcaaaggagagaaccucuacauggggcugugaagaguucgggugccuggcugucuccgauggauguguuuuugguagcugccaagacauaaucaaagaagaacuuucgguguacaggaaggauacugaggaagugucaaacguagaguugugccugaccuucgccgacaaaacguauuguacaucuuuaaaugcaauuaccccuaucauuacugaaaaguuugagguccaguucaagaccguggaaaguuacucccucccacgcaucguuggcauacgaaaccaugagauucggaucgggcagaucaaugaucugggaagcuacucuaaaggcugcgguaacgugcaacgugucaaugggacaaacuauggcagcggacagcccaaguuugacuaccuuugucaccuggccuccagaaaagaggugauuguuaggaagugcuucgauaaugacuaucaggcuuguaaauuucuacagacuccuucaaguuaccgccucgaggaacaugaaggcaccgugacaaucauagacuauaagaagauucuggggacgaucaaaaugaaggcgauuuugggagauguacgguacaaaaacuaugccagcgcaaucgacauaaaugcugagggcgucugcgccgguuguauuaacugcuucgaaaacauccacugugaguuuaccauccauacuacaauugaggccucuugcccaaucgaauccgauugugugucauuccacgacaggauucuggugacccccaaugagcacaaguacgcuuuaaaacucauaugcgaagauaagccggggaguacucugaaguuuaaaaucugcaacacaaagauugacgcagccaugacccuugucgaugcgaaaccuauccuggaguuggcuccaguugaccaaacggccuacaucagagaaaaggaugagcgauguaaaacuuggaugugccgcgugcgggacgagggaauuaagguacuccuggaacccuucaagaaucuauucggcagcuauauagguaucguguacuccauuauccugauuaucauagcagccaucauuaucauuuauaucauacuuccuauuuguuuuaaacucagagauacccugaagaaacaugaggacgcuuacaggaaggaaaugaaaauccguuga

SEQ ID NO: 11007 - RNA, 4332 nt, Artificial Sequence
  derived and/or modified CDS sequence (opt3) from KEYV(KEYV/Ochlerotatus atlanticus/USA/KEYVLK01/2005)__KT630289.1__GP
augaucuggauucugcucaccguggucacaguuacuauagccaaccccguguaccagagaugcuuccaagacggcgcuaucguaaagcagaauccuagcaaagaggcagugacggaagucugucuuaaggaugacguguccaugauuaaaaccgaggccaaguauguuaaaaaccugacagggacuuuuucuaauaacguggcgaugaggaagugguuggucgcugauuggcacgacugccggccacagaagcgcgccggaggucauaucaaugugauugaaguaggcgaugacuuaucacugcacaccgagaguuacaucuguagcgcagauugcguuauauccguggacaaagaaacagcccagauccgacuacaaaccgauacuacaaaccauuucgaggucgcugggaccacggugaagucuggaugguuuaaaucgacuaccuauauuacacucgaccagacuugugagcaccugaaggugucaugcggcccgaaaagcauccaguuccaugcauguuuuaaucagcacaugaguugcguccguuuccuucacagaaccauucugcccgguuccaucgccaacucuauaugucaaaauauugaaaucauuaucuugguuacacucacccugcugaucuuuauucucuuaagcauacuguccaagacguacaucugcuauauucuuaugccuaucuucauaccaauugcuuacaucuauggguggguguacaacaagucauguaaaaagugcaaauugugcggacugguauaccaucccuuuacugaguguggcacacacugcguguguggcgccagguaugaaaccagugaucggaugaagcuacaucgcgcgagcgggcucugcccuggauacaaaucucugagagcagccagggucauguguaaguccaaagguccagcuucaauccuuagcauucugacugccguguugauccucacauucauuacccccaugaaugcaaugguucugggcaguucugaggagguguauaaguuagaagaccugccugaugacaugcucaacauggcugagaagauagacaucuacuaucuuuccauuguccugaauuacagcacgaccuggggguugcuaauccugcuccugaucgugucgugccuuuuuaaaaaguaucagcacguauuccugaacuacuacgccauguauugucacgaaugcgauauguaccaugagaaaaagaauuugguuuauaacggagacuuuucuaacaaaugucggcagugcacauguggccaguacgaagaugcgacuggucucauugugcaccaaaaguccuauaauugccugauaaaguacaaagccaagugguucaucaacauuuuaaucauuuauaccauccugguccuacucaaagacucagugcugauggcagcugccgaggggccagauuucaauacaugcauagagcagcgcaguaucagccuuaacuguacuggaccguuuauuaauuugggcggcugcgaaaagccccagaaacgagcuuccuaccaaucuaucgccgagcagcugaaggcaauuaacgccaucagcauacucgacaugccuaugauuucaaagaucccagaugacauuaguggggcucugagacauaucgaaaaucuuaaaaccuaccacgagcagcugacagcggaguucgcaauguugaccagguauugugauuacuauacucaguuuuccgacaacagcggauacucucaaacgucauggcggacauaucuccguagucaugauuucgaggucugcauagccuaccccaaucagcacuuuugucgcugcgugaagaacggugagaaauguaccagcgcuaauugggacuucgccaacgaaaugaagaauuauuacacuggcaaacagaucagauuugacaaggaucugaacuuagcacugaccacacuacacaccgccuucagggggacuuccacauacuauaugucugacauucucgcugagacgaaggccaauucgcugcgggauuacgcacuugcguugaaaagcaaguauccuggaaacgcucugcucaaagccauccuggacuuuauuauguacuuacagucccugaacgaagcaaccaaguucaaacuuucaagugauugggaggacuuuaaguauaauucugaauuggaggcccgagcucucaugccacgcgccagaagcuccggcgauuacaacuucucaaaugcagagagcacuaacaaaguuaagaucugcaagaauauacaaagggugaugugucugucuccccgguccaaagcuacaguagaagacauuaucgccugcggugagcaugaacacccgagugucuauauggugccuaacaccacaaucuaccagagcaauauugagcgcucucauuacuguaucgcggauucccacugccuagaggaauaugagcugguucagaacgaacuccugacugcccuuaagaaaucaaccugcuggacgggggaguuggaaaaugugauuccccacaagcagagugacggcauaagaagcuguaggaccaaaaacacaggacguugcaaugucaagggcgaggauuggacugugauccugugugagaacgacaaguacuauuacucggaauuaaauaaagauuaugacaaggaccaagauauugggcauguaugccucuccccacgguguaacucuauccgauacccuauuagccccagacacaucaccaauugcaaaugggagaacccagcuggaacaauaucaaggaucgaaacucauagucuggcagacauugagcaguauaagaaagccaucucccagaaacuucagaacucucugaccauuuuuaaguacgaaaagacgaagaauuugccccacaucaaaccuauauacaaguauauuacaaucgaggguaccgagacuguggaaggcguugagaacgcuuucaucgaagccgagauuccagcacucgcggggacaagcauaggauucaaagucaauucccgcgauggcgaccaucugauggauaucauugccuacaucaagguggcuucauauagcaguaccuacacuaagcuauauaccacagguccgacgauugggaucaacaccaaacacgacgaaaaguguacuggcaauugccccgcccggcuggagcacaaagugggauggcucacauuugcaaaggagagaaccucuacauggggcugugaagaguucgggugccuggcugucuccgauggauguguuuuugguagcugccaagacauaaucaaagaagaacuuucgguguacaggaaggauacugaggaagugucaaacguagaguugugccugaccuucgccgacaaaacguauuguacaucuuuaaaugcaauuaccccuaucauuacugaaaaguuugagguccaguucaagaccguggaaaguuacucccucccacgcaucguuggcauacgaaaccaugagauucggaucgggcagaucaaugaucugggaagcuacucuaaaggcugcgguaacgugcaacgugucaaugggacaaacuauggcagcggacagcccaaguuugacuaccuuugucaccuggccuccagaaaagaggugauuguuaggaagugcuucgauaaugacuaucaggcuuguaaauuucuacagacuccuucaaguuaccgccucgaggaacaugaaggcaccgugacaaucauagacuauaagaagauucuggggacgaucaaaaugaaggcgauuuugggagauguacgguacaaaaacuaugccagcgcaaucgacauaaaugcugagggcgucugcgccgguuguauuaacugcuucgaaaacauccacugugaguuuaccauccauacuacaauugaggccucuugcccaaucgaauccgauugugugucauuccacgacaggauucuggugacccccaaugagcacaaguacgcuuuaaaacucauaugcgaagauaagccggggaguacucugaaguuuaaaaucugcaacacaaagauugacgcagccaugacccuugucgaugcgaaaccuauccuggaguuggcuccaguugaccaaacggccuacaucagagaaaaggaugagcgauguaaaacuuggaugugccgcgugcgggacgagggaauuaagguacuccuggaacccuucaagaaucuauucggcagcuauauagguaucguguacuccauuauccugauuaucauagcagccaucauuaucauuuauaucauacuuccuauuuguuuuaaacucagagauacccugaagaaacaugaggacgcuuacaggaaggaaaugaaaauccguuga

SEQ ID NO: 11008 - RNA, 4332 nt, Artificial Sequence
  derived and/or modified CDS sequence (opt3) from KEYV(KEYV/Ochlerotatus atlanticus/USA/KEYVLK02/2005)__KT630292.1__GP
augaucuggauucugcucaccguggucacagccacuauagcuaaccccguuuaccagagaugcuuccaagacggcgcaaucgugaagcagaauccuagcaaagaggccguaacggaagugugucuuaaggaugacgucuccaugauuaaaaccgaggcgaaguaugugaaaaaccugacagggacuuuuucuaauaacguugcuaugaggaagugguugguggccgauuggcacgacugccggccacagaagcgcgcaggaggucauaucaaugucauugaagugggcgaugacuuaucacugcacaccgagaguuacaucuguagcgccgauugcguaauauccguugacaaagaaacagcucagauccgacuacaaaccgauacuacaaaccauuucgagguggcagggaccacggucaagucuggaugguuuaaaucgacuaccuauauuacacucgaccagacuugugagcaccugaaggugucaugcggcccgaaaagcauccaguuccaugccuguuuuaaucagcacaugaguugcgugcguuuccuucacagaaccauucugcccgguuccaucgcuaacucuauaugucaaaauauugaaaucauuaucuuggucacacucacccugcugaucuuuauucucuuaagcauacuguccaagacguacaucugcuauauucuuaugccuaucuucauaccaauugccuacaucuauggguggguuuacaacaagucauguaaaaagugcaaauugugcggacugguguaccaucccuuuacugaguguggcacacacugcguauguggcgcgagguaugaaaccagugaucggaugaagcuacaucgcgcaagcgggcucugcccuggauacaaaucucugagagccgcuagggugauguguaaguccaaagguccagccucaauccuuagcauucugacugcagucuugauccucacauucauuacccccaugaaugcuauggugcugggcaguucugaggagguuuauaaguuagaagaccugccugaugacaugcucaacauggccgagaagauagacaucuacuaucuuuccauugugcugaauuacagcacgaccuggggguugcuaauccugcuccugaucgucucgugccuuuuuaaaaaguaucagcacguguuccugaacuacuacgcgauguauugucacgaaugcgauauguaccaugagaaaaagaauuugguauauaacggagacuuuucuaacaaaugucggcagugcacauguggccaguacgaagaugccacuggucucauuguucaccaaaaguccuauaauugccugauaaaguacaaagcaaagugguucaucaacauuuuaaucauuuauaccauccuggugcuacucaaagacucaguccugauggcugccgcugaggggccagauuucaauacaugcauagagcagcgcaguaucagccuuaacuguacuggaccguuuauuaauuugggcggcugcgaaaagccccagaaacgagccuccuaccaaucuaucgcagagcagcugaaggccauuaacgcuaucagcauacucgacaugccuaugauuucaaagaucccagaugacauuaguggggcgcugagacauaucgaaaaucuuaaaaccuaccacgagcagcugacagcagaguucgccauguugaccagguauugugauuacuauacucaguuuuccgacaacagcggauacucucaaacgucauggcggacauaucuccguagucaugauuucgaggugugcauagcuuaccccaaucagcacuuuugucgcugcgucaagaacggugagaaauguaccagcgccaauugggacuucgcaaacgaaaugaagaauuauuacacuggcaaacagaucagauuugacaaggaucugaacuuagcccugaccacacuacacaccgcuuucagggggacuuccacauacuauaugucugacauucucgccgagacgaaggcaaauucgcugcgggauuacgcgcuugcuuugaaaagcaaguauccuggaaacgcccugcucaaagcaauccuggacuuuauuauguacuuacagucccugaacgaagccaccaaguucaaacuuucaagugauugggaggacuuuaaguauaauucugaaccagaggcucgagccuugaugccccgcgcaagaagcuccggcgauuacaacuucucaaaugcugagagcacuaacaaagccaaggugugcaagaauauccaaaggguuaugugucucucuccgcgguccaaagcgacaguggaagacauaauugccugcggugagcaugaacacccuaguguauauaugguccccaacaccacaguguaccagagcaauaucgagcgcucucauuacuguaucgcugauucccacugccuggaggaauaugagcuaguucagaacgaacugcucacugcacugaagaaaucaaccugcuggacgggggagcuugaaaaugugauuccacacaagcagagugacggcaccagaagcuguaggacuaaaaacacaggacguugcaaugucaagggcgaggauuggaccgugaucuugugugagaacgacaaguacuauuacucggaacugaauaaagauuaugacaaggaccaagauauugggcauguaugcuuauccccucgguguaacucuauacgauaccccaucagcccaagacacauuacaaauugcaaaugggagaaccccgccggaacuaucucaaggauugaaacccauagucucgcugacaucgagcaguauaagaaagccauaucccagaagcugcagaacucucuuacgaucuuuaaguacgagaaaacaaagaaucugccucacauuaaaccaaucuacaaguauauuaccaucgaggguacugagacaguggaaggcguugagaacgcauucauagaagcggagauuccggccuuggcugggaccagcaucggauucaaagucaauucccgcgauggcgaccaucucauggauaucauugccuacauaaagguggcaucauauagcaguacuuacaccaagcuguauacaacgggucccaccaucgggauuaacacuaaacacgacgaaaaguguacaggcaauugcccugcucggcuagagcacaaagugggauggcugaccuuugccaaggagagaacaucuacuuggggcugugaagaguucgggugccucgcagucuccgauggauguguuuuugguagcugccaagacaucauuaaagaagaacugucgguguacaggaaggauaccgaggaagugacgaacguagagcuuugcuugacauucgccgacaaaaccuauuguacuucacugaaugcuaucaccccaauaaucacagaaaaguuugagguccaguucaagacuguggaaucuuacaguuuaccccgcauuguuggcauccgaaaccaugagauucggaucgggcagauaaaugaucucggauccuacagcaaaggcugcgguaacgugcaacgugucaaugacaccaacuaugggucuggccagccuaaguuugauuaccugugucaccuugcgagcagaaaagaggugauuguuaggaagugcuucgacaaugacuaucaggccuguaaauuucugcagacaccauccucauaccgccuagaagaacaugaaggaacggugaccaucaucgauuauaagaagauucucggcacuaucaaaaugaaggcaauacugggggacguacgguacaaaaacuaugcuagugccauugauaucaaugccgagggagucugcgcuggcuguauuaacugcuucgaaaacauccacugugaguuuacaauacauaccacuauugaggcaagcugccccaucgaaucugacuguguguccuuccacgauagaauguuggugacaccgaaugagcacaaguacgcccugaaauuaaucugcgaagacaagccugguucaacccucaaguuuaaaauuugcaacacgaagaucgaugcggcuaugacucuggucgacgccaaaccaauucuugagcuggcacccguugaucaaaccgccuacauaagggaaaaggacgagcgauguaaaacauggaugugccgcgugcgggaugaggggaucaagguauugcucgaaccuuucaagaaucuguucggaaguuauauuggcaucguguacagcaucauucuaauaaucauugcugcaaucauuaucauauaugucauccugcccauuuguuuuaaacuuagagacacccucaagaaacaugaggacgccuacaggaaggaaaugaaaauccguuga

SEQ ID NO: 11009 - RNA, 4332 nt, Artificial Sequence
  derived and/or modified CDS sequence (opt3) from KEYV(C14031-33)__AF123489.1__GP
augaucuggauucugcucaccguggucacaguuacuauagccaaccccguguaccagagaugcuuccaagacggcgcuaucguaaagcagaauccuagcaaagaggcagugacggaagucugucuuaaggaugacguguccaugauuaaaaccgaggccaaguauguuaaaaaccugacagggacuuuuucuaauaacguggcgaugaggaagugguuggucgcugauuggcacgacugccggccacagaagcgcgccggaggucauaucaaugugauugaaguaggcgaugacuuaucacugcacaccgagaguuacaucuguagcgcagauugcguuauauccguggacaaagaaacagcccagauccgacuacaaaccgauacuacaaaccauuucgaggucgcugggaccacggugaagucuggaugguuuaaaucgacuaccuauauuacacucgaccagacuugugagcgucugaaggugucaugcggcccgaaaagcauccaguuccacgcauguuuuaaucagcauaugaguugcgucagauuccuucacaggaccauucuguuggguuccaucgccaacucuauaugucaaaauauugaaaucauuauccucguuacacugacccugcucaucuuuauuuuacugagcauacuuuccaagacguacaucugcuauauuuugaugcccaucucaauaccuauugcuuacaucuauggguggguguacaacaagaguuguaaaaagugcaaacugugcggccuaguauaccacccauucacugaguguggcacacauugcguguguggcgcccgguaugaaaccagcgaucgcaugaagcuccacagagcgucugggcugugccccggauacaaaucccuuagggcagcccgggucauguguaagucaaaagguccugcuagcauccugaguauuuugacugccgugcucauccugacauuuauuaccccaaugaaugcaaugguuuuaggaucuuccgaggagguguauaagcuggaagaccuccccgaugacaugcuuaacauggcugagaagauagacaucuacuaucugagcauugucuugaauuacucgacgaccugggggcuacugauccuccugcuuaucgugucuugccuguucaaaaaguaucauuugguauuucucaacuacuacgcccuguauugucacgaaugcgauauguaccacgagaaaaagaauuuaguuuauaacggagacuucuccaacaaaugucugcagugcacauguggccaguacgaagaugcgacuggucuaauugugcaucagaagucauauaauugccucauaaacuacaaggccaaaugguuuaucaauauucugaucauuuauaccauccuugucuugcugaaggacagugugcucauggcagcugccgagcgcccugauuucaacacaugcauagagcaacgaagcaucucccugaauuguacugggccauucauuaaccuuggaggcugcaaaaagccgcagaaaagagcuucuuaccagagcaucgccgaacaacugaaggcaauuaaugccaucucaauauuggacaugcccaugauuaguaagaucccugaugacauuuccggcgcucucaggcacaucgagaaccugaaaaccuaccaugaacaguuaacagcggaguuugcaaugcugacccgguauugugauuacuauacucaguucagcgacaauucuggguacucacagacgaguuggcguacauaucuacgcagccacgauuuugaagucugcauagccuacccaaaccaacauuucuguagaugcgugaagaauggagagaaauguaccuccgcuaacugggacuuugccaaugagaugaagaacuauuacacugguaaacagaucagguucgacaaggaucucaaucuggcacuuaccacauugcacaccgccuuucggggcacuucuacauacuauaugucggacauucuggcugaaacgaaggccaacagccuccgagauuacgcacuggcguuaaaauccaaguaucccgggaacgcucugcuuaaagccaucuuggacuucauuauguaccuccagccucugaaugaggcaaccaaguuuaaacuaucaagugauugggaagacuucaaguauaacucugagccagaagcccgcgcucugaugcccagagccaggagcuccggagauuacaauuuuucaaacgcagagagcacuaauaaaguuaaggugugcaagaacauccagcggguaaugugucucucuccgcgcuccaaagcuacagucgaggacauaauugccugcggcgaacacgagcauccuaguguguauaugguucccaauaccacaaucuaccaaagcaacaucgaaagaucucacuacuguauugcggauucccauugccuggaggaguaugaacuugugcagaaugaguugcugacugccuuaaagaaaucaaccugcuggacgggugaacucgagaacgucaucccacacaagcagagugacgggauuaggagcugucguaccaaaaauacaggccggugcaacgugaagggagaagauuggacuguaauacugugugagaaugacaaguacuauuacucggagcuuaacaaagauuaugacaaggaccaggauaucggccacgugugccuguccccucgauguaauucuauuagauaccccaucagcccaaggcauauuaccaacugcaaaugggaaaaccccgcugggacaaucucacgcauagagacucacaguuuggcagacaucgaacaauauaagaaagccauuucccagaagcuccaaaauucucugaccaucuucaaguacgagaaaacgaagaaccuaccucauauuaaaccaaucuacaaguauauaacaauugaaggaaccgagacuguugagggugucgaaaaugcuuuuaucgaggccgaaaucccggcacuggcgggcacaagcauuggguucaaagugaacucccgggauggagaccaccucauggauauaaucgccuacauuaagguggcuucauauagcaguaccuacacuaagcuguauaccacaggccccacgaucgguauuaauaccaaacaugacgagaaguguacugggaacugcccugccagacuugaacacaaagucggcugguugacauucgcaaaggagaggaccucuacauggggaugugaggaauuuggcugccuggcuguuuccgauggguguguguucggaagcugccaggacaucauaaaagaggaauuaucgguguaccgcaaggauacugaggagguaaccaaugucgaacucugccugacguuugccgacaaaacauauuguaccucacuuaacgcaaucacuccaauuaucaccgagaaguucgaagugcaguuuaagacaguugagucuuacagucugccccgaauuguggguauccggaaucacgaaauacguauuggccagaucaacgaucuaggguccuacagcaaaggaugcggcaauguccagagagugaacgguacuaauuaugggucuggccaaccuaaguucgacuaccucugucaucuggccagcaggaaagagguuaucgugcgcaagugcuuugauaacgacuaucaggcuuguaaauucuugcagaccccauccucauaccggcuggaggaacacgagggaacaguaacgauuaucgacuauaagaagauauuaggcaccauuaaaaugaaggcgauccucggggaugucagauacaaaaauuaugccagugcaauugacaucaacgcugaaggagugugcgccggcuguauaaacugcuuugagaauauucauugugaguucacuauccacacaaccaucgaagccagcugccccauugagucugauuguguguccuuucaugacaggaugcuggucacuccgaacgaacacaaguacgcucuuaaacugaucugcgaggauaagccugguucagcauugaaguucaaaauuugcaauacaaagauagacgccgcgaugacccucguugaugcuaaaccaauccuggaacuagcccccguggaccagacggcauacauucgagagaaggaugaacgcuguaaaacuuggaugugccggguaagagacgaggggaucaaggugcugcuugagccuuuuaagaaccucuucggaaguuauaucggcauugucuacagcauaauccugauuaucauugccgcuaucauaaucauuuauaucauuuugcccaucuguuucaaacugagggauaccuuaaagaaacacgaagacgcauaccguaaggagaugaaaauacgcuga

SEQ ID NO: 11010 - RNA, 4326 nt, Artificial Sequence
  derived and/or modified CDS sequence (opt3) from LACV(Human/78)__NC_004109.1__GP
augaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgggugaugugcaaaucaaagggcccagccagcauucuuaguaucauuacagcaguucugguguugaccuucgucacucccauaaacucuauggugcucggggaauccaaagagacauuugagcuggaagauuuaccugacgacaugcuggagauggcuagccgcaucaauucguauuaccucaccuguauucuuaacuaugccguaucuuggggacugguuaucaucggcuugcuaauuggucugcucuuuaagaaguaccaacaccgauuucugaauguguaugcgauguacugcgaagagugugauauguaccacgacaaauccgggcuuaagagacauggagauuucacgaacaaaugcaggcaguguaccugcggccaguaugaagacgccgcaggccugauggcucaccggaagacauacaauugcuugguccaguauaaagccaaguggaugaugaacuuccucauaaucuacauuuuucugaucuuaauuaaggauucagcuaucgugguccaagccgcagggacugacuucaccacaugucuggagacugagaguauaaacuggaauugcaccggaccauuucuaaaccucgguaauugucagaaacagcaaaagaaagaaccguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacgacuucgaggcuuguauucuguacccaaaccagcauuuuuguaggugcgucaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauaucgcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaaaaugugaaggacguugccugcuuauccccgcgcucaggagcgauuuaugccagcaucaucgcuuguggugaaccuaacggccccucuguguacagaaagccauccgggggagucuuccagaguagcacugauaggucuauuuauugccugcuugacucccauugcuuggaggaguuugaagcaaucggccaagaggaacucgaugccgugaaaaagucaaaauguugggagauugaguacccugacguaaagcugauacaggaaggugacgggacaaaaaguugccggaugaaggauagcggcaauuguaacguggcuaccaaucgcuggcccguuauccagugcgagaacgacaaguucuacuauucggaacuacagaaagauuacgacaaggcccaagauauuggacacuauugucuguccccaggcugcacaacugucagauaccccaucaauccuaaacauauuucuaacuguaauuggcaagugagcaggucaaguaucgcaaagauagacgugcacaacaucgaggauauugaacaguauaaaaaggcgaucacccagaagcuccaaacgucccugucucuuuuuaaauacgccaagaccaaaaauuugccacacauuaagccgaucuauaaauacauaacaauugaggggacugagaccgcugaaggaaucgagagcgccuacaucgaauccgagguccccgcacuggcugguacaucaauuggcuucaagauaaacagcaaagaagggaagcauuuacucgacguuaucgccuaugugaagagugcaucuuacuccagcguguauacuaaacuguacucgaccggaccuacgucaggcauuaauacaaagcacgaugagcuuugcaccgguccaugucccgccaacaucaaucaucagguaggguggcugacuuuugcucgugagcggacaucuaguuggggcugcgaagaguucggauguuuggcggucuccgacggcugcguguuugggagcugccaggauauuaucaaagaggaacucucuguuuaucgaaaggaaaccgaggaggugacugacgucgaacugugucuaaccuucagcgauaaaacauacugcacgaaccugaacccugugaccccaauaaucacugaccucuuugagguucaauucaagacaguggaaaccuauucccugcccagaauuguagccguccagaaucacgagaucaagauuggacagaucaacgaccuuggcguguacucaaaagguugugggaaugugcagaaggucaacggaacaauauacggcaaugguguuccgagguuugauuauuugugccaucuggcaagucgcaaagaggugauuguacggaaguguuucgacaacgauuaccaggcuugcaaauuuuuacagagcccugccucuuauagacucgaagaggacuccggcacugugaccaucaucgauuacaagaagauucuggggacgaucaaaaugaaggccauacuuggagacgucaaauauaagacauucgcugauucaguggacauuaccgcagaaggcaguuguacugggugcaucaauuguuucgagaacauucacugcgaacugacccuacacacaacuaucgaggccagcuguccaauaaaauccucuugcaccguuuuucaugauaggauucucgugacacccaaugagcacaaguacgcgcugaagauggucugcacggaaaaaccuggaaacaccuugacuaucaagguguguaauacaaaaguugaggcuucgauggcccugguggacgcaaagcccaucauugaauuagccccagucgaucagaccgcuuauauccgcgagaaagacgaacgaugcaagacuuggaugugucggguacgugacgagggccuccaggugauucuggagccuuucaagaaccuuuuugguagcuacauagggaucuucuacacauuuauuaucucaaucguugugcuguuggucauuauauaugugcuccugcccaucugcuucaaacuaagagauacccugaggaagcaugaagacgcauacaaacgcgagaugaagauucgguga

SEQ ID NO: 11011 - RNA, 4326 nt, Artificial Sequence
  derived and/or modified CDS sequence (opt3) from LACV__KP271111.1__GP
augaucagaauacuggugcucauagccgucaccgcugcaagccccguuuaccagaggugcuuccaagacggcgccaucgugaagcagaacccuuccaaagaggcgguaacagaagugugucuuaaggaugacgucucuaugauuaaaacugaggcucgguaugugcgcaaugccacggggguuuuuagcaacaauguggcaauccgaaaguggcuggucagugauuggcacgacugccguccgaaaaagauuaucggaggucauauaaacgugaucgaaguaggcgaugacuugagcuuacacaccgaguccuacguuuguucugccgauugcucgauugggguggacaaggaaacagcucaggucagacugcagacugauaccacaaaucauuucgagaucgcaggaaccacugugaaaucaggcugguuuaagagcacaaccuauauuacgcuagaccaaacuugugagcaccucaaagugaguugcgguccaaaguccguccaguuccaugccuguuuuaaccagcacaugucuugcguuagguuccugcaccggaccauccuucccgggagcauagcuaauuccauuugucagaacaucgaaauuaucauccuggugacauugacucuccugauuuuuauacugcucucaaucuuaaguaaaaccuacauuugcuaucugcuuaugccuaucuucauaccaauugccuacauguauggaaucaucuacaauaagagcuguaagaaaugcaaguugugcggccugguauaccaucccuuuacagaguguggcacccacugcguguguggggcgcgcuaugauacgucugacagaaugaaacuacauagggcauccggacucugcccugguuacaagucacugcgggccgcucgcgucauguguaaaagcaagggcccagccaguauucuuucuaucauuacugcagugcugguuuugacauucgugacccccauaaacuccaugguccucggggaaagcaaagagacuuuugagcuggaagaguuaccugaugacaugcuggaaauggcuucgcgaaucaauucuuauuacuucacaugcauucucaacuaugccguguccuggggacuuguaaucaucggccuguugaccggucuacuguuuaagaaguaccaacacagauuccucaauguuuaugcgauguacugugaggaaugcgacauguaccacgauaaaucagggcugaagaggcauggagacuucacgaacaaaugucggcagugcaccuguggccaguaugaggaugccgcaggccuuauggcucaccguaagacauacaauugccuggugcaguauaaagccaaguggaugaugaacuuuuugauuauauacaucuuccucauucugaucaaggacagugcuauugucgugcaagccgcagggacugauuuuaccacaugcuuagagacugaaagcaucaacuggaauuguaccggaccauuccugaaccuagguaauugccagaaacagcaaaagaaagagccguauacaaacauagccacccagcucaagggccugaaagcuaucuccguccuugacauucccaucauuacugggaucccugaugacauagcgggagcauugcgcuacauugaagagagagaagauuuucaugugcagcugacgaucgaguaugccaugcucucuaaguacugugacuacuauacacaguucagcgauaauucaggcuacagucaaaccacuuggaggguuuaucugcggucccacgacuuugaggcuugcauucuuuacccaaaccagcauuucugucgaugcgugaagaauggugaaaaauguucaucuucaaacugggacuuugccaaugagaugaaggauuauuacagugggaaacagaccaaguucgacaaagaucugaacuuggcacucacagcccugcaccacgcuuuucgcggcaccagcuccgccuauaucgcaacuauguuaucuaagaagucgaaugacgaucugauagcguacacaaacaaaaucaaggcuaaauuccccggaaaugcccuacucaaggcaauuaucgacuacauugccuauaugaaaagccugccuggcauggcuaacuuuaaguacgaugaguucugggacgaacuuuuguauaaaccaaaucccgccaaggcauccaaccuggcuagagggaaggaaucaaguuacaacuucaaacucgccaucucuagcaaguccauaaaaacgugcaagaauguaaaagaugucgcgugucugucaccgaggagcggagccauuuaugcuucuaucaucgcaugcggugagccuaacggccccuccguguaccggaagccaagugggggaguuuuucagagcucuaccgaccgcuccauuuauuguuuacuggauucacauugccuugaggaguucgaagccaucaaucaagaagaguuggacgcugugaagaaaaguaagugcugggagauugaauacagcgaugucaaaccucuccaggagggcgacgguacuaagucguguagaaugaaagacuccgggaacugcaauguggccacaaacagguggcccguaauacagugugaaaaugauaaguuuuacuauucugagcugcagaaggacuacgauaaaacccaagacaucggccacuauugccuaagcccaggauguacaacugugcguuaccccauuaacccuaagcauaucucaaauugcaacuggcagguuagucgguccucuauugcaaaaaucgauguccacaauauagaagacaucgagcaguauaagaaagcgauuacccagaagcugcaaacgagccucucccuguucaaguacgccaaaaccaagaaccuuccacacaucaaaccgauuuauaaguacaucacaauagagggcacugaaaccgcugaggggauugaaucagccuacaucgagagcgaagugcccgcauuggcuggaacaaguaucgguuuuaaaauuaauucuaaggagggcaaacaucuguuagaugugauagccuaugucaaguccgcaagcuacucgucaguuuaugccaagcucuacucuacugggccuaccaguggaaucaacacgaaacacgacgagcuguguacaggcccaugccccgcuaauauuaaccaucagguggguuggcuuaccuucgcgaaggaacgaacuuccagcugggggugugaggaauuuggcugccuggccgugucugauggauguguauucggcagcugccaggacaucauuaaagaggaauuguccgucuauagaaaggagacagaggaagugaccgauguugagcucugccugacuuuuucagacaaaaccuacuguacaaaccuaaauccugugacgccaaucauaaccgaucuguucgaaguccaauuuaagacuguggagacauauagucuccccaggaucguugcagugcagaaccacgagauuaagaucgggcagauuaaugaccugggaguauacagcaaaggcugcgguaacguccagaagaucaaugggaccguguacggaaacggcgugccgcgcuucgacuaucuuugucauuuggcuucucggaaagaagucauaguuagaaagugcuuugauaaugacuaccaagccuguaaauuccugcaguccccugccucauauagguuagaggaagauagugguacagugacuauuaucgacuacaagaagauccucggcaccauuaaaaugaaggcuauccugggggauguaaaauauaagacguucgcagacagcguggauauaacagccgagggauccugcaccggcuguauuaacugcuuugaaaauauccacugugagcuuacucugcacaccacaauugaggcgucuugcccaaucaaaucgagcuguacugucuuccaugaccgcauucuagugacccccaacgaacacaaguacgcucucaagaugguuugcacagagaaaccugggaauacgcugaccauuaaggugugcaacacuaaaaucgaagccucaauggcauuggucgaugccaagcccaucauugagcuggcuccaguggaccagacagcauauauccgagaaaaagaugagcgguguaagaccuggaugugccguguuagagacgagggauuacaggugauucucgaaccuuuuaagaaucuguucggcuccuacauagguaucuuuuacacuuucauuaucaguaucgucgcccuucugguaauuguguauguuuugcuccccauauguuuuaaacugagggacacacuacgcaagcaugaggaugcguacaaacgggaaaugaagaucagauga

SEQ ID NO: 11012 - RNA, 4326 nt, Artificial Sequence
  derived and/or modified CDS sequence (opt3) from LACV__M87664.1__GP
augaucugcauucuggugcucauaaccgucgccacagcuagccccguucuucagagauguuuccaagacggcgcaaucgugaagcagaacccuuccaaagaggccuuuacugaaguaugccugaaggaugacgugucuaugauuaaaacggaggcgagguacguccggaaugcuaccgggguguucucaaacaauguugccauccgcaagugguuggugagugcauggcacgauugucgaccgaaaaagauugucggaggucauaucaacgugauagaaguaggcgacgauuuaagccugcacacagaguccuauguuugcucugccgacuguacuaucgggguggauaaggaaaccgcucagguccgucuacagacagacaccacuaaucauuuugagauugcaggaacaaccgugaaaucgggcugguucagaucaacgacuuacaucacccucgaucaaacaugcgagcaccugaaggugagcugugguccaaaaaguguccaguuucaugccugcuucaaccagcacauguccuguguuagguuucuucaccggacuauucugccccgcucuaucgcuaauagcauaugccagaacauugaaaucauuaucuuggugacccucacacugcugaucuucauucucuuauccauacugucaaagaccuauaucuguuaccuuuugaugccuauuuuuaucccaauagccuauauuuacgggacgaucuauaauaaaaguugcaagaagugcaaacuguguggacuagcgcaucaccccuucacugagugcggcacacauuguguaugcggcgcaagauacgacaccagcgauaggaugaagcuccaccgggccucugggcuguguccuggauacaaaucccuucgcgcugcccgagugaugugcaagucaaaagguccagcaagcauccugaguauuaucacugcugucuuggugcucacauuuguuacccccauuaacucuauggugcugggcgaauccaaggagacguucgaguuagaagaccugccugaugacaugcucgagauggccagcagaauaaauucguauuacccaaccuguauccuuaacuaugcggucucuugggggcuggugauuaucggauugcuaaucggccugcucuuuaaaaaguaccaacacagguuccugaauguauaugccauguacugcgaagagugugacauguaucaugauaaguccgguguuaaacggcacggggacuucacaaacaagugccgucaguguacuugcggacaguacgaagaugcagcuggccuuauggcccaucgcaaaaccuacaauugccuggugcaguauaaggcuaaauggaugaugaacuuuuugauuauauacaucuuccucauucugaucaaggacucagccauugucgugcaagcagccggcacagauuuuacuaccuguuuagagacagagaguaucaacuggaauugcaccgggccguuccugaaccuaggaaauugucagaagcagcagaaaaaggaacccuauacuaacauagcuacgcaacucaaaggucugaaggcgaucagcguccuugacauuccuaucauuacaggcaucccagaugacauagcaggggccuugagauacauugaggaaaaagaggauuuucacgugcagcugaccaucgaauaugcuaugcucuccaaguacugcgacuauuacacucaguucucugauaauagcggauacucacaaaccacauggaggguuuaucugcggagucaugacuuugaggccuguauucuuuaccccaaccagcacuucugccgaugugugaagaauggcgagaaaugcuccagcucuaaccgcgacuuugcaaaugaaaugaaggauuauuacucagguaaacagaccaaguucgacaaagaucugaacuuggcccucacugcucugcacagucagguaaugcauuguagcuccgccuauaucgcaacaauguuaucuaagaagucgaaugacgaucugauagcguacacgaacaaaaucaagaccaaauuuccugggaaugcucuacucaaggccauuaucgacuauauugcauacaugaaaagccugccaggcauggccaacuucaaguacgaugaguuuugggacgaacuuuuguauaaacccaauccggcuaaggccuccaaccuggcaagaggaaaggagucaaguuacaacuucaaacucgcuaucucuagcaaguccauaaaaacuugcaagaaugucaaagauguggccugucugucaccuaggagcggcgcgauuuaugccucuaucaucgcuugcggggaacccaacggaccauccguuuaccggaagccuagugguggcguguuccaaagcucuacagaccgcuccauuuauugcuuacuggauucacacugucuugaggaguuugaagcaaucagucaggaggaauuggacgccgucaagaaaagcaagugcugggagauugaguaccccgaugugaaacucauacaggaaggggacggaaccaagucguguagaaugaaagacuccggcaauugcaacguagcuacaaauagguggccagugacucagugugagaacgauaaguucuauuacucugaccugcaaaaggauuacgacaaaacccaggauaucggucauuauugccuaagccccggguguacgaccguucguuacccuauuaauccaaagcacaucucaaacugcaauuggcaggucagucgguccucuauugccgaaaucgacgugcacaacauagaggauaucgaacaguauaaaaaggcaauuacacaaaaacugcagacuagccucucccuguuuaaguacgcgaagaccaaaaaucuuccgcauaucaagcccauuuauaaauacaucacaaugaagggcacugagaccgccgagggaauagaaucagcuuauauugagagcgaagugccugccuuggcaggcacgaguaucggguucaaaaucaacucuaaggagggaaaacaccuguuagacgucauugcuuacguuaaguccgccagcuacucgucaguguauacaaagcucuacucuaccgguccaacaaguggcauaaauacuaaacaugaugaacuguguaccgggcccugcccugcaaacaucaaucaccaggugggauggcuuacuuuugcccgagagagaaccuccagcuggggcugugaggaguucgguugccuggcuguaucugacgggugcgucuuuggcagcugucaagauauuaucaaggaagaauuguccguguauaggaaagagacagaagagguuacgaacguggagcucugccugaccuucucagacaagacuuacuguacaaaccuaaauccagucacccccauuaucacagaucuguuugaagugcaguucaaaacuguugagaccuauagucucccgcgcauaguggcgguacagaaccaugaaaucaagauuggacagaucaaugaccugggcgucuacagcaaggggugcggaaacgugcaaaaagugaauggcacgauuuaugguaacggggucccucgguuugacuaccuuugucacuuggccucuagaaaggagguuaucgugaggaaaugcuucgauaaugacuaccaggcauguaaguuucugcaguccccagcuucauaucgcuuagaggaagauaguggaacaguaaccauaauugacuacaaaaagauccucggcacuaucaagaugaaagccauucugggugaugugaaguauaaaaccuucgccgacagcgucgauaucacagcugagggcuccugcacuggguguauaaacugcuucgaaaauauucacugugagcuuacccugcauacaacgaucgaagcaucuugccccauuaagucgagcugcaccguguuucacgaccgaauccuaguuacuccuaacgagcauaaauacgcccucaagaugguguguacagagaagcccggaaauacccugacuauaaaagucugcaacacaaagauugaagcgucaauggcuuugguggaugccaaaccaaucaucgagcuggcaccuguugaccagaccgccuauauucgggaaaaggaugagcguuguaaaacguggaugugcagagugagggacgaaggcuuacaagucauccucgagcccuucaagaaucuguuuggguccuacauuggaauauucuauacuuuuaucauuaguaucguagcacuucuggugaucauuuacguuuugcucccaauauguuucaagcugcgcgacacccuacggaaacacgaggaugcuuacaagagagaaaugaaaaucagguga

SEQ ID NO: 11013 - RNA, 4326 nt, Artificial Sequence
  derived and/or modified CDS sequence (opt3) from LACV__KP271105.1__GP
augaucaggauucuggugcucauagccgucaccgcugcaagccccguuuaccagagaugcuuccaagacggcgccaucgugaagcagaacccuuccaaagaggcgguaacagaagugugucuuaaggaugacgucucuaugauuaaaacugaggcucgguaugugcgcaaugccacggggguuuucucaaacaauguggcaauccgaaaguggcuggucagugauuggcacgacugccguccgaaaaagauuaucggaggucauauaaacgugaucgaaguaggcgaugacuugagcuuacacaccgaguccuacguuuguucugccgauugcucgauugggguggacaaggaaacagcucaggucagacugcagacugauaccacaaaucauuucgagaucgcaggaaccacugugaaaucaggcugguuuaagagcacaaccuauauuacgcuagaccaaacuugugagcaccucaaagugaguugcgguccaaaguccguccaguuccaugccuguuuuaaccagcacaugucuugcguuagguuccugcaccggaccauccuucccgggagcauagcuaauuccauuugucagaacaucgaaauuaucauccuggugacauugacucuccugauuuuuauacugcucucaaucuuaaguaaaaccuacauuugcuaucugcuuaugccuaucuucauaccaauugccuacauguauggaaucaucuacaauaagagcuguaagaaaugcaaguugugcggccugguauaccaucccuuuacagaguguggcacccacugcguguguggggcgcgcuaugauacgucugacagaaugaaacuacauagggcauccggacucugcccugguuacaagucacugcgggccgcucgcgucauguguaaaagcaagggcccagccaguauucuuucuaucauuacugcagugcugguuuugacauucgugacccccauaaacuccaugguccucggggaaagcaaagagacuuuugagcuggaagaguuaccugaugacaugcuggaaauggcuucgcgaaucaauucuuauuacuucacaugcauucucaacuaugccguguccuggggacuuguaaucaucggccuguugaccggucuacuguuuaagaaguaccaacacagauuccucaauguuuaugcgauguacugugaggaaugcgacauguaccacgauaaaucagggcugaagaggcauggagacuucacgaacaaaugucggcagugcaccuguggccaguaugaggaugccgcaggccuuauggcucaccguaagacauacaauugccuggugcaguauaaagccaaguggaugaugaacuuuuugauuauauacaucuuccucauucugaucaaggacagugcuauugucgugcaagccgcagggacugauuuuaccacaugcuuagagacugaaagcaucaacuggaauuguaccggaccauuccugaaccuagguaauugccagaaacagcaaaagaaagagccguauacaaacauagccacccagcucaagggccugaaagcuaucuccguccuugacauucccaucauuacugggaucccugaugacauagcgggagcauugcgcuacauugaagagagagaagauuuucaugugcagcugacgaucgaguaugccaugcucucuaaguacugugacuacuauacacaguucagcgauaauucaggcuacagucaaaccacuuggaggguuuaucugcggucccacgacuuugaggcuugcauucuuuacccaaaccagcauuucugucgaugcgugaagaauggugaaaaauguucaucuucaaacugggacuuugccaaugagaugaaggauuauuacagugggaaacagaccaaguucgacaaagaucugaacuuggcacucacagcccugcaccacgcuuuucgcggcaccagcuccgccuauaucgcaacuauguuaucuaagaagucgaaugacgaucugauagcguacacaaacaaaaucaaggcuaaauuccccggaaaugcccuacucaaggcaauuaucgacuacauugccuauaugaaaagccugccuggcauggcuaacuuuaaguacgaugaauuuugggacgagcuuuuguauaaaccaaaucccgccaaggcauccaaccuggcuagagggaaggaaucaaguuacaacuucaaacucgccaucucuagcaaguccauaaaaacgugcaagaauguaaaagaugucgcgugucugucaccgaggagcggagccauuuaugcuucuaucaucgcaugcggugagccuuccggccccaguguguaccggaagccaagcgggggaguuuuucagucuuccaccgaccgcucaauuuauuguuuacuggauagucauugccuugaggaguucgaagccaucaaccaagaagaguuggacgcugugaagaaaagcaagugcugggagauugaauacucggaugucaaaccucuccaggagggcgacgguacuaaguccuguaaaaugaaggacucugggaauugcaacguggccacaaauagauggcccguaauacagugugaaaacgauaaguuuuacuauagcgagcugcagaaagacuacgauaagacccaagacaucggccacuauugccuaucaccaggauguacaacugugagguaccccauuaauccuaaacauaucaguaacugcaauuggcagguuucccguucuagcauugcaaagaucgauguccacaacauagaagacaucgagcaguauaaaaaggcgauuacccagaagcugcaaacgucccucucacuguucaaauacgccaagaccaaaaaucuuccacacaucaagccgauuuauaaauacaucacaauagagggcacugaaaccgcugaggggauugaaagcgccuacaucgagagugaagugcccgcauuggcuggaacaucuaucgguuuuaagauuaacuccaaagagggcaagcaucuguuagaugugauagccuaugucaagagcgcaucguacucaucuguuuaugccaaacucuacaguacugggccuaccuccggaaucaauacgaagcacgacgagcuguguacaggcccaugccccgcuaacauuaaucaucagguggguuggcuuaccuucgcgaaagaacggacuagcucuugggggugugaggaauuuggcugccuggccgugagcgauggauguguauucggcuccugccaggacaucauuaaggaggaauugucagucuaucgaaaagagacagaggaagugaccgauguugagcucugccugacuuuuagugacaagaccuacuguacaaaccuaaacccugugacgccaaucauaaccgaucuguucgaaguccaauuuaagacuguggagacauauagccuccccagaaucguugcagugcagaaucacgagauuaaaaucgggcagauuaacgaccugggaguauacucuaagggcugcgguaauguccagaaagugaacgggaccguguacggaaauggcgucccgagguucgacuaucuuugucauuuggcuucccgcaaggaaguuaucgugcggaaaugcuuugauaacgacuaccaagccuguaaguuccugcagagcccugccaguuauagauuagaggaagauagcgguacaguaacuauaauugacuacaagaaaauccucggcaccaucaagaugaaagcuauucugggggaugugaaguauaaaacguucgcagacuccgucgauaucacagccgagggaucuugcaccggcuguauaaauugcuuugaaaacauucacugugagcuuacucugcacaccacaaucgaggcgucgugcccaauuaagagcucauguacuguguuccaugacaggauccuaguuacccccaaugaacacaaguacgcucucaaaauggugugcacagagaagccugggaacacgcugaccauaaaagucugcaauacuaagauugaagccuccauggcauugguggaugccaaacccaucaucgagcuggcuccaguugaccagacagcauauauucgcgaaaaggaugagcgauguaagaccuggaugugccgggugcgugacgagggauuacaggucauccucgaaccuuuuaaaaaccuguucggcaguuacauugguauauuuuacacuuucaucauuucuaucguagcccuucuggugaucguuuauguguugcuccccauuuguuuuaagcugagagacacacuaaggaaacaugaggaugcguacaagcgcgaaaugaaaauacgguga

SEQ ID NO: 11014 - RNA, 4326 nt, Artificial Sequence
  derived and/or modified CDS sequence (opt3) from LACV(74-32813)__D10370.1__GP
augaucagaaugcuggugcucauugucguuaccgccgcuagccccguguaccagaggugcuuccaagacggcgcaauaguaaagcagaacccuuccaaagaggccgugacagaagucugucuuaaggaugacgugucuaugaucaaaacugaggcgcgguauguuaagaaugcuacggggguguuuucaaacaaugucgccauucgcaaauggcuggugagugauuggcacgacugccgaccaaagaagaucguaggaggucauauuaacguuaucgaagugggcgaugacuugagcuuacacaccgaguccuacgucuguucugcagauugcacaauagggguggacaaagaaacugcccaggugcgucugcagaccgauacaaccaaucauuucgagaucgcuggaacuacagucaagucgggcugguuuaaaucaaccacguauauuacucuagaccaaaccugugagcaccucaagguuagcugcgcaccgaaaagugugcaguuccaugccuguuuuaaccagcacauguccugcguaagauuccugcacaggacaauccuucccgguucuauugcuaauagcaucugucagaacauagaaauuaucauucuggugacuuugacccuccugaucuuuauccugcucuccauuuuaucaaagacauacauaugcuaucugcuuaugccuaucuucauuccaaucgccuacauguauggggucauauacaauaagaguuguaaaaagugcaaauugugcggacugguguaccaucccuuuaccgaguguggcacgcacugcguuuguggcgcgcgguaugauacuagcgaccgcaugaagcuacauagagcaucugggcucugcccuggauacaaaucccugagggccgcucgggugauguguaagucaaaagguccagccagcauucuuaguaucaucacagcaguccugguguugaccuucguaacucccauuaacucuaugguucucggcgaauccaaggagacauuugagcuggaagaguuaccugaugacaugcuggaaauggcucuccgcaucaauagcuauuacuuuaccugcauucuuaacuaugccgugucgugggggcugauaaucgcgggauugcuagucggccugauuuucaagaaauaccaacaccgauuccucaauaucuaugccauguacugugaggaaugcaacauguaccacgacaagucuggucugaaaagacauggggauuucacgaauaaguguaggcagugcaccuguggacaguaugaggacgcaacaggccuuaucacucaccggaaaaccuacaacugccuggugcaguauaaggcuaaguggaugaugaacuuuuugauuauauacaucuuccucauucugaucaaagauuccgccauugucggccaagcuacagggacugacuuuaccacaugcuuagagaccgaaucaaucaauuggaacuguacuggaccauuccugaaucuagguaacugccagaagcagcagaaaaaggagccguauacgaauauagccacacaacucaaaggccugaaggcaaucagugugcuugauauucccaucauuaccagcaucccugacgauauagccggggcuuugcguuacauugaagagaaggaagacuuucauguucagcugacuaccgaguaugcgaugcucuccaaauacugugauuacuauacacaguucucugacaacagcggauacucacaaaccacuuggcgcguguaucugagaagucacgauuuugaggcaugcauccuuuacccaaaucagcauuucuguaagugcgucaaaaacggcgaaaaguguuccagcucuaauugggacuuugccaacgguaugaaaaauuauuacucagggaagcaggcuaaguucgacaaagaucugaacuuggcccucacagcacugcaccacgccuuuaggggcacgaguagcgcuuauauugccgcaauguuauccaagaaaucuaaugacgaucugaucgcguacaccaacaagauaaaagcuaaguuccccggaaaugcccuacucaaagcaaucauugacuacaucgccuauaugaagggccugccugagauggcuaacuuuaaguacgaugaguucugggacgaacuuuuguauaaaccaaaccccgccaaggcaucgaaucuggcucgggggaaagaaagcuccuacaacuucaagcucgccauuucaaguaaaucuaucaagacuugcaagaauguaaaagauguggcgugucugagcccgcgauccggagccauauauucaagcauuaucgcuugcggugagccuaacggccccucuguuuaccgcaagccauccgggggaguguuucagaguagcacagacagaucuaucuauuguuuacuggauucccauugccuugaggaguucgaagcaauuucacaagaagaguuggacgccgucaaaaagaguaaaugcugggagaucgaauacccugaugugaggccccuccaggagagcgacggcgcuaagucgugucggaugaaggauuccgguaauugcaacguagccaccaaucgcuggccagugaugcagugugaaaacgacaaauuuuacuauucugagcugcagaaggacuacgauaaaacacaagacauugggcacuauugccuaagccccggcuguacuaccauaagauacccuaucaauccaaagcauauuucaaacugcaauuggcagguuaguagguccucuaucgcaaaaauugauguccacaacguggaagacaucgagcaguauaagaaggcgauaacgcagaaacugcaaaccagccucucccuguucaaguacgccaaaacaaagaaucuuccgcacauccgucccauuuauaaauacaucacuaugaaggagaccgaaacagcugagggaauugaaucagccuacaucgagagcgaagugccugcauuggcuggcaccagugucggguuuaaaauaaacucuaaggagggaaagcaucuguuagauguuauugccuaugugaaauccgcaagcuacucgucaguguaugccaagcucuacucuacugguccaacgaguggcaucaauacaaaacacgacgagcuguguaccgggcccugcccugcuaacaucaaccaucagguaggauggcuuacuuucgcgcgggaacgaacauccagcuggggcugugaggaauuugguugccuggccgucucugauggguguguguucggcagcugccaggacauuauaaaggaggaauuguccguuuauagaaaagagaccgaggaagugacuaaugucgagcucugccugaccuuuucagauaagacauacuguacgaaccuaaauccagugacccccaucauuacugaccuguucgaaguucaauuuaagacaguggagaccuauagucucccgaggaucguagcaguccagaaccacgagauuaaaaucggacagauaaaugaucugggcguguacagcaaggggugcggaaacgugcagaaagucaauggcacaguuuacgguaacggggugccucgcuucgacuaucuuugucauuuggcuucucggaaggaaguaaucgugagaaaaugcuuugauaaugacuaccaagccuguaaguuccugcaguccccagccucauauagguuagaggaagacaguggaacugucaccauuaucgauuacaagaaaauucucggcacgaucaagaugaaagcuauacugggugacgugaaguauaaaacauucgcagauagcguugacauuaccgccgagggcuccugcgcgggguguaucaacugcuuucagaauauccacugugaacuuacucugcacaccacaauugaggcuucuugccccaucaagucgagcuguacuguguuccaugaucgcauucuagucaccccuaacgagcacaaguacgcccucaaaauugugugcacagaaaagcccggaaauacgcugaccaucaaaguuugcaacacucgaauugaggcaucaauggccuugguggacgcuaagccaaucauagaacuggcaccugucgaucagacagccuauauucgggagaaagacgaacguuguaagaccuggaugugcagaguaagggaugagggcuuacaagugauccucgagcccuuuaagaaucuguucggguccuacaucggaauauuuuacacuuucaucauuaguauaaucgcgcuucugguuauuaucuauguguugcucccaaucuguuuuaaacugcgcgacacacuacggaagcaugaugacgcuuacaaaagagaaaugaagauuagguga

SEQ ID NO: 11015 - RNA, 4326 nt, Artificial Sequence
  derived and/or modified CDS sequence (opt3) from LACV(Craig County/VA/2009)__KP226848.1__GP
augaucaggauucuggugcucauagccgucaccgcugcaagccccguuuaccagagaugcuuccaagacggcgccaucgugaagcagaacccuuccaaagaggcgguaacagaagugugucuuaaggaugacgucucuaugauuaaaacugaggcucgguaugugcgcaaugccacggggguguuuucaaacaauguggcaauccgaaaguggcuggucagugauuggcacgacugccguccgaaaaagauuaucggaggucauauaaacgugaucgaaguaggcgaugacuugagcuuacacaccgaguccuacguuuguucugccgauugcacaauugggguggacaaggaaacugcucaggucagacugcagaccgauacaaccaaucauuucgagaucgcaggaacuacagugaaaucgggcugguuuaagucaaccacguauauuacucuagaccaaaccugugagcaccucaaagugagcugcgguccaaagaguguccaguuccaugccuguuuuaaccagcacauguccugcguuagguuccugcaccggacaauccuucccgggucuauagcuaauagcauuugucagaacaucgaaauuaucauccuggugacuuugacccuccugauuuuuauacugcucuccaucuuaucaaaaacauacauuugcuaucugcuuaugccuguauucaucccaauagccuguauuuacggaaucaucuauaauaagaguugcaagaaaugcaaguuguguggccugguguaccaucccuuuaccgagugcggcacgcacugugucugcggggcgcgcuacgauacuagcgacagaaugaaacuacauagggcaucuggacucuguccugguuauaagucccugcgggccgcucgcgugaugugcaaaucaaagggcccagccagcauucuuaguaucauuacagcaguucugguguugaccuucgucacucccauaaacucuauggugcucggggaauccaaagagacauuugagcuggaagaguuaccugaugacaugcuggaaauggcuagccgaaucaauucguacuauuucaccuguauucucaacuacgccguaucuuggggacuuguuaucaucggccuguugauuggucuacuguuuaagaaguaucaacacagauuccucaauauauacgcgauguauugcgaggaaugugacauguaccacgauaaauccgggcugaagaggcauggagacuucacgaacaaaugccggcaguguaccugcggccaguacgaggaugccgcaggccuuauggcucaccguaagacauauaauugccuggugcaguacaaagccaaguggaucaugaacuuuuugauuaucuauauuuuccucauccugauaaaggacucagcuaucgucgugcaagccgcagggacugauuuuaccacauguuuagagacugaaaguauuaacuggaauugcaccggaccauuccugaaccuagguaauugucagaaacagcaaaagaaagagccguacacaaacaucgccacccagcucaagggccugaaagcuauuagcguccuugacauccccauaauuacugggaucccugaugacauugcgggagcauugcgcuauaucgaagagagagaagauuuucaugugcagcugacgauagaguacgccaugcucuccaaguauugcgacuacuacacacaguucucugauaauagcggcuauucacaaaccacuuggaggguuuaccugcggagucacgacuuugaggcuuguauccuuuauccaaaccagcauuucugccgaugugugaagaauggugaaaaaugcuccagcucuaacugggacuuugccaaugggaugaaggauuacuauucaggcaaacaggcaaaguucgacaaagaucugaacuuggcccucaccgcucugcaccacgccuuucgcggaacaaguagcgcauacauugcgaccauguuauccaagaagucuaaugacgaucugaucacuuauacaaacaaaauuaagacgaaauuccccggcaaugcucuacucaaggccaucauagacuacauugcauacaugaaaucgcugccugggauggccaacuuuaaguaugaugaguucugggacgaacuuuuguacaaaccaaaucccgcuaaggccagcaaccuggcaagaggaaaggaguccucauauaacuucaaacucgcuaucaguucuaagagcaucaaaaccuguaagaauguaaaagaugucgccugccuguccccgaggucaggugcgauuuacgccagcaucauugcuuguggcgaaccuaacgggcccucuguguaucggaagccauccggaggcguuuuucagaguagcacugaccgcucuauauacugcuuacuggauucccauugccuugaggaguucgaagcaaucucacaagaggaauuggacgccgugaagaaaaguaaguguugggagauugaguauccugaugucaaaccccuccaggaaagcgacgguacaaagucgugcagaaugaaagacuccgggaauuguaacguggcuaccaauagguggccaaucauucagugcgagaacgauaaguuuuacuacucugaacugcagaaggacuaugauaaaacacaagacaucggccacuacugucuaagccccggaugcacuaccguacguuauccuauaaauccaaagcauaucucaaacuguaauuggcagguuagucgguccucuauugccaaaaucgauguucacaacauugaggacaucgaacaguacaagaaagcaauaacgcagaagcugcaaaccagccucucccuguucaaguaugcgaaaacaaagaaucuuccgcacauuaaacccaucuacaaguauaucacuauugagggcaccgagacagccgaagggauagagucagcuuacaucgaaagcgaggucccugccuuggcaggagcuaguauugguuuuaaaaucaacucuaaggaaggcaaacaucuguuagaugugauugccuacgugaaguccgcaagcuauucgucagucuacgccaagcucuauucuacugggccaaccaguggaaucaauacgaaacacgacgagcugugcacaggccccuguccugcuaacauaaaucaucagguugguuggcuuaccuucgcgcgagagagaacuuccagcugggggugcgaagaguuuggcugucuggccgugucugauggaugcguguucggcagcugccaggacaucauuaaggaagaguuguccguauacaggaaagaaacagaggaggucaccgauguggaacucugucugacuuuuucagacaagaccuauugcacaaaccuaaacccaguuacgcccaucauuaccgaucuguucgaggugcaauuuaaaacugucgaaacauacagucucccgcgcaucguggcaguucagaaucacgagauaaagauugggcagaucaacgaccugggaguguauagcaagggcugugguaauguacagaaagucaacgggaccguguacggaaauggcgugccucgguucgacuaccuuugccauuuggcuucuagaaaggaggucaucguuaggaaauguuuugauaacgacuaucaagccugcaaguuccugcaguccccagccucauaccgcuuagaagaggauagugguacagugacuauuaucgacuauaaaaagauacucggcaccauuaagaugaaagcuauccugggggauguaaaguacaaaacguucgcagacagcguggauauuacagccgaaggauccuguaccggcugcaucaauuguuuugagaacauacacugcgaacuuacucugcacaccacaauugaggcgucuugucccaucaagucgagcugcacugucuuccaugaccgaauccuagugaccccuaaugagcacaaauaugcucucaagaugguuugcacagaaaagcccgggaacacgcugaccauuaaaguguguaauacuaagaucgaggccucaauggcauuggucgaugccaaaccaauuauagaacuggcuccuguggaccagacagcauacauccgggagaaggaugaacguugcaaaaccuggauguguagaguuagggacgagggauuacaggugauucucgagcccuuuaagaaccuguucggcuccuauaucgguaucuuuuacacuuucauuauaaguaucgucgccauucuuguaaucauuuacgugcuguugccaaucugcuuuaagcuccgcgacacacugcggaaacaugaagaugcguauaagagagagaugaaaauaagguga

SEQ ID NO: 11016 - RNA, 4326 nt, Artificial Sequence
  derived and/or modified CDS sequence (opt3) from LACV(Dallas/TX/2009)__GU591165.1__GP
augaucagaauuuuggugcucauagucguuaccgccgcuagccccguguaccagaggugcuuccaagacggcgcaaucguaaagcagaacccuuccaaagaggccgugacagaagucugucuuaaggaugacgugucuaugauuaaaacugaggcgcgguauguuaagaaugcuacggggguguuuucaaacaaugucgccauccgcaaauggcuggugagugauuggcacgacugccgaccaaagaagauuguaggaggucauaucaacguuauagaagugggcgaugacuugagcuuacacaccgaguccuacgucuguucugcagauugcacaaucgggguggacaaagaaacugcccaggugcgucugcagaccgauacaaccaaucauuucgagauugcuggaacuacagucaagucgggcugguuuaaaucaaccacguauaucacucuagaccaaaccugugagcaccucaagguuagcugcgguccgaaaagugugcaguuccaugcauguuuuaaccagcacauguccugcguaagauuccugcacaggacaauucuucccgggucuaucgccaauagcauaugucagaacauugaaaucauuauccuggugacuuugacccuccugaucuuuauucugcucuccauauuaucaaagacauacaucugcuaucugcuuaugccuauuuucaucccaauggcuuacauguauggagucauauacaauaagaguuguaaaaagugcaaauugugcggccugguguaccaucccuuuaccgaguguggcacgcacugcguuuguggggcccgguaugauacuagcgaccgcaugaagcuacauagagcgucuggacucugcccugguuacaaaucccugagggcagcccgggugauguguaagucaaaaggcccagcuagcauucuuaguaucaucacagccguccugguguugaccuucguaacucccauuaacucuaugguucucggggaauccaaggagacauuugagcuggaagaguuaccugaugacaugcuggaaauggcacuccgcaucaauagcuauuacuuuaccugcauucuuaacuaugcugugucguggggacugauaaucgccggcuugcuagucggucugauuuuuaagaaauaccaacaccgauuccucaauaucuaugcgauguacugugaggaaugcgacauguaccacgauaagucugggcugaaaagacauggagacuucacguccaaguguaggcagugcaccuguggccaguaugaggaugccacaggccuuaucacucaccggaaaaccuacaacugccuggugcaguauaaggcaaaguggaugaugaauuuucugauuauauacaucuuccucauucugaucaaagacucagcuauugucgugcaagccacagggacugauuuuaccacaugcuuagagaccgaaaguaucaacuggaacuguacuggaccauuccugaaucuagguaacugccagaagcagcagaaaaaggagccguauacgaauauagcuacacagcucaaaggccugaaggccaucagcguucuugacauucccaucauuaccgggaucccugaugacauagcaggagccuugcguuacauugaagagaaggaagauuuucaugugcagcugacuaccgaguaugcuaugcucuccaaauacugugacuacuauacacaguucucugauaacagcggcuacucacaaaccacuuggcgcguauaucugagaagucacgacuuugaggcgugcauccuuuacccaaaucagcauuucuguaggugcgucaagaacggugaaaaauguuccagcucuaauugggacuuugcaaacgagaugaagaauuauuacucagggaaacaggccaaguucgauaaggaccugaacuuggcucucacagcccugcaccacgcauuucggggcacgaguagcgccuauauugcuaccauguuauccaaaaagucuaaugaugaccugguggccuacacuaacaaaaucaaggcaaaauuccccggaaaugcgcuacucaaggcuauaaucgauuacauugccuauaugaaaggccugccugacauggcaaacuuuaaguacgaugaguucugggacgaacuuuuguauaagccaaaucccgccaaggcuucgaaccuggcccgagggaaagaaagcuccuacaacuucaaacucgcaguuucaaguaagucuauccgcacaugcaaaaaugugaaggaugucgcuugucugagcccgagauccggagccauuuauucaagcaucauagcgugcggugagccuaacggccccucuguguacaggaagccauccgggggaguauuucagaguagcaccgaccggucuauuuauuguuuacuggauucccauugccuugaggaguucgaagccaucucacaagaagaguuggacgcugugaaaaagaguaaaugcugggagaucgaauacccugauauucgcccccuccaggagagcgacggcucgaaguccuguagaaugaaagacucugguaauugcaacguugcaacaaauagguggccagucaugcagugugaaaacgauaaguuuuacuauagcgagcugcagaaggacuacgauaaaacucaagacaucgggcacuauugccuaucacccggcuguaccacgauucguuacccuauaaauccaaagcauaucaguaacugcaauuggcaagugucccggucuagcauugccaaaaucgaugugcacaacgucgaagacauugagcaguauaagaaagcuaucacccagaagcugcaaacaucccucucacuguucaaguacgccaaaacuaagaaucuuccgcacauaaaacccaucuauaaguacauuaccaucgagggaacagaaacugcagagggcauugaaagcgcguacaucgagagugaaguuccugccuuggcugggaccucuauaggauuuaaaauuaacuccaaggaggguaaacaucuguuagaugugaucgccuauguaaagagcgcaucguacucaucuguguaugcuaagcucuacaguacgggcccaacauccgggaucaauaccaaacacgacgagcuguguacuggacccugcccugccaacauuaaucaucaggucggcuggcuuacauucgcacgagaaagaaccagcucuugggguugugaggaauuugggugccuggccgugagcgauggcuguguuuucggauccugccaggacauaaucaaggaggaauugucaguguauaggaaagauacugaggaggucaccaacguggaacucugccugacauuuagugacaagacguacuguaccaaccuaaauccaguuacucccauuaucacagaucuguucgaggugcaauuuaaaaccguagaaacauauagccucccgcgcauugucgcugugcagaaccacgagaucaagauaggccagaucaaugaccuggggguguacucuaagggaugcggcaacguccagaaaguuaaugguacuguguacgggaacggaguaccucgguucgacuaucuuugucauuuggcguccagaaaggaggugauugucaggaaaugcuuugauaaugacuaccaagccuguaaguuccugcagucaccagcaaguuaucgcuuagaagaggauagcggcaccgugacgaucauugacuacaaaaagauccucgguacaauaaagaugaaagcuauucugggcgauguuaaguauaaaaccuucgccgacuccguggauaucacugccgaagggucuugcgcuggauguaucaacugcuuugagaauauucacugugaacuuacccugcacacaacuaucgaggcaucgugccccauaaagagcucauguaccgucuuccaugaccggauucuagugacaccuaacgagcacaaauacgcccucaagaugguuugcacggaaaagcccggcaauacccugacuaucaaagugugcaacacacgaauugaggucuccauggcguugguagaugcuaagccaaucauagaacuggccccuguggaccagaccgcauauauucgugagaaagaugaaagauguaagacuuggaugugcaggguucgcgacgagggguuacaggugauccucgagcccuuuaaaaaucuguucggaaguuacaucggcauuuucuacacauucaucauuucuauaaucgcccuucuggucauuaucuauguguugcucccaaucuguuuuaagcugcgggacacccuaagaaagcaugaugacgcuuacaaaagggaaaugaagauucgauga

SEQ ID NO: 11017 - RNA, 4326 nt, Artificial Sequence
  derived and/or modified CDS sequence (opt3) from LACV(Fort Bend County/TX/2009)__GU591168.1__GP
augaucagaaugcuggugcucauugucguuaccgccgcuagccccguguaccagaggugcuuccaagacggcgcaauaguaaagcagaacccuuccaaagaggccgugacagaagucugucuuaaggaugacgugucuaugaucaaaacugaggcgcgguauguuaagaaugcuacggggguguuuucaaacaaugucgccauucgcaaauggcuggugagugauuggcacgacugccgaccaaagaagaucguaggaggucauauuaacguuaucgaagugggcgaugacuugagcuuacacaccgaguccuacgucuguucugcagauugcacaauagggguggacaaagaaacugcccaggugcgucugcagaccgauacaaccaaucauuucgagaucgcuggaacuacagucaagucgggcugguuuaaaucaaccacguauauuacucuagaccaaaccugugagcaccucaagguuagcugcgguccgaaaagugugcaguuccaugcauguuuuaaccagcacauguccugcguaagauuccugcacaggacaauccuucccgggucuauugccaauagcaucugucagaacauagaaauuaucauucuggugacuuugacccuccugaucuuuauccugcucuccauuuuaucacggacauacauaugcuaucugcuuaugccuaucuucauuccaaucgcuuacauguauggagucauauacaauaagaguuguaagaaaugcaaguugugcggccugguguaccaucccuuuaccgaguguggcacgcacugcguuuguggggcccgcuaugauacuagcgacagaaugaaacuacauagggcgucuggacucugcccugguuacaagucccugcgggcagcccgcgugauguguaaaucaaagggcccagcuagcauucuuaguaucaucacagccguccugguguugaccuucguaacucccauuaacucuaugguucucggggaauccaaagagacauuugagcuggaagaguuaccugaugacaugcuggaaauggcacuccgaaucaauagcuauuacuucacuugcauucuuaacuaugcugugucguggggacugauaaucgccggcuugcuagucggucugauuuuuaagaaguaccaacacagauuccucaauaucuaugcgauguacugugaggaaugcgacauguaccacgauaaaucugggcugaagaggcauggagacuucacgaacaaaugucggcagugcaccuguggccaguaugaggaugccgcaggccuuauggcucaccguaagacauacaauugccuggugcaguauaaagccaaguggaugaugaacuuuuugaucauuuacauauuccucauccugauuaaggacuccgcuaucgucgugcaagccacugggaccgauuuuacaacuugcuuagagaccgaaucaauuaacuggaauuguacaggaccauuccugaaccuagguaauugccagaaacagcaaaagaaagagccguauaccaacaucgcaacucagcucaagggccugaaagccauaaguguucuugacauccccauuaucacggggauuccugaugacaucgcuggagcguugcgcuacauagaagagaaggaagauuuucauauucagcugacaaccgaguaugcaaugcucagcaaguacugugacuacuauacucaguucuccgauaauucuggcuacagccaaaccacauggagaguguaucugaggucacacgacuuugaggccugcauccuuuacccaaaccagcauuucugucggugcgucaaaaauggugaaaaguguaguuccagcaacugggacuuugcuaaugagaugaaaaacuauuacucugggaagcaggccaaauucgauaaggaccugaauuuggcacucaccgcccugcaccacgcuuuucgaggcacuucaagugccuauauugcaacaauguuaagcaagaaauccaacgaugaccugaucgcguacacgaauaagauaaaagcuaaguuccccggaaacgcccuacucaaagcaaucauugauuacaucgccuauaugaagggccugccugacauggcuaauuuuaaauacgaugaguucugggacgaacuuuuguauaagccaaaccccgccaaggcaucuaaccuggcucgcgggaaagaaucgagcuacaauuucaagcucgccauuuccucaaaaaguaucaagaccugcaaaaacguaaaggauguggcgugucugucuccgagaagcggagccauauauuccucaauuaucgcuugcggugagccuaauggccccagcguuuacaggaagccaucugggggaguguuucaguccaguacugaccggagcaucuauuguuuacuggauucucauugccuugaggaguucgaagcaauuucccaagaagaguuggacgccgucaaaaagucaaaaugcugggagaucgaauacccugaugugcgcccccuccaggagagugacggcgcuaagagcuguagaaugaaagacucggguaacugcaauguagccacaaacagguggccagugaugcagugugaaaaugauaaguuuuacuauuccgagcugcagaaggacuacgauaaaacccaagacauugggcacuauugccuaucucccggcuguacaacuauacguuacccuaucaacccaaagcauauuagcaauugcaacuggcagguuucacggaguuccaucgcaaaaauugauguccacaauguggaagacaucgagcaguauaagaaagcgauaacccagaagcugcaaacgucucucagccuguucaaguacgccaaaaccaagaaccuuccgcacaucaaacccauuuauaaguacaucacaauugagggaacugaaaccgcugagggcaucgaauccgccuacauagagucagaagugccugcauuggcugggacaagcauuggauuuaaaaucaauaguaaggaggguaaacaucuguuagaugucaucgccuauguuaagucugcauccuacagcucgguguaugccaagcucuacucaacuggcccaaccucugggauuaacacgaaacacgacgagcuguguacaggacccugcccugcuaauauaaaccaucaggugggcuggcuuaccuucgcgcgagaaagaaccaguuccugggguugugaggaauuugggugccuggccguaagcgauggcugugucuucggaucuugccaggacaucauuaaggaggaauugagcguguauaggaaagagacagaggaaguuaccaacguggagcucugccugacuuuuuccgauaagaccuacuguacaucacuaaauccagucacgcccaucauuaccgaccuguucgaagugcaauuuaaaacuguugagacauauagucucccgcgcaucguggcaguacagaaccacgagauaaagaucggccagauuaaugaucugggggucuacagcaagggaugcggcaacgugcagaaagugaaugguaccgucuacgggaacggaguuccucgguucgacuaucuuugucauuuggcuucuagaaaggaagugaucguaaggaaaugcuuugacaaugauuaccaagccuguaaguuccugcaguccccagccucauaucgcuuagaggaagacaguggcacagugacuauuaucgauuacaaaaagauacucgguaccauuaagaugaaagcuauccugggcgacgucaaguauaaaacguucgcagauagcguggacaucacagccgagggguccugcgcgggauguauuaacugcuuugaaaauauccacugugagcuuacccugcacacuaccauagaggcuucuugccccauuaagucgagcuguacaguuuuccaugaucgaauccuagugacuccuaacgaacacaaauacgcccucaagauggucugcaccgagaagcccggcaauacacugacgauuaaagugugcaacacccggaucgaagcaucaauggccuugguugacgcuaagccaauaauugagcuggcaccuguggaucagacugccuauauccgugaaaaagacgagagauguaagacauggaugugcaggguccgcgaugagggguuacagguaauccucgaacccuuuaaaaaucuguucggauccuacauuggcaucuuuuacaccuucauuauaaguaucauugcgcuucuggugaucaucuauguuuugcucccaauuuguuuuaagcugcgggacacucuaagaaagcaugacgaugcuuacaaaagggagaugaagauacgauga

SEQ ID NO: 11018 - RNA, 4326 nt, Artificial Sequence
  derived and/or modified CDS sequence (opt3) from LACV(LAC22988-89)__U18980.1__GP
augaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgggugaugugcaaaucaaagggcccagccagcauucuuaguaucauuacagcaguucugguguugaccuucgucacucccauaaacucuauggugcucggggaauccaaagagacauuugagcuggaagauuuaccugacgacaugcuggagauggcuagccgcaucaauucguauuaccucaccuguauucuuaacuaugccguaucuuggggacugguuaucaucggcuugcuaauuggucugcucuuuaagaaguaccaacaccgauuucugaauguguaugcgauguacugcgaagagugugauauguaccacgacaaauccgggcuuaagagacauggagauuucacgaacaaaugcaggcaguguaccugcggccaguaugaagacgccgcaggccugauggcucaccggaagacauacaauugcuugguccaguauaaagccaaguggaugaugaacuuccucauaaucuacauuuuucugaucuuaauuaaggauucagcuaucgugguccaagccgcagggacugacuucaccacaugucuggagacugagaguauaaacuggaauugcaccggaccauuucuaaaccucgguaauugucagaaacagcaaaagaaagaaccguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacaacuucgaggcuuguauucuguacccaaaucagcauuuuuguaggugcgucaaaaacggugagaagugcuccagcucuaauugggacuucgccaacgaaaugaaagauuauuacucagggaagcagaccaaauuugacaaggauuugaaucucgcacugacagccuuacaccacgcuuuccggggcaccaguagcgccuauaucgcaacuaugcuguccaagaaaucuaacgacgaucuaauagcguacacaaauaagaucaaaacgaaguuucccggaaacgcucuccugaaagccauuaucgacuacauugcauauaugaagucgcuuccuggcauggccaauuucaaauacgaugaguuuugggacgaauugcuguauaagccaaaccccgcuaaggccagcaaccucgcacgagggaaagaguccucauacaauuucaagcuggcuaucaguucuaaaagcauaaagauuuguaaaaacgugaaggauguugccugcuuauccccgcgcucaggagcgaucuaugccagcaucauugcuuguggugaaccuaauggccccucuguguacagaaagccauccgggggagucuuccagaguagcaccgacaggucuaucuauugccugcuugauucccauugcuuggaggaguuugaagcaauuggccaagaggaacucgacgccgugaaaaagucaaaauguugggagauagaguacccugauguaaagcugauccaggaaggugacgggacuaaaaguugccggaugaaggacagcggcaacuguaauguggcuacaaaccgcuggcccguuauucagugcgagaaugauaaguucuacuauucggaacuacagaaagacuacgauaaggcccaagacaucggacacuauugucuguccccaggcugcaccacagucagauaccccauuaacccuaaacauaucucuaauuguaacuggcaagugagcaggucaaguauagcaaagaucgaugugcacaauauugaggacaucgaacaguauaaaaaggcgauuacucagaagcuccaaaccucccugucucuuuuuaaauacgccaagacgaaaaacuugccacacaucaagccgauauauaaauacauuaccaucgaggggacagagacugcugaaggaaucgagagcgccuacauugaauccgagguccccgcacuggcugguaccucaauaggcuucaagaucaauagcaaagaagggaagcauuuacucgauguuauugccuaugugaagagugcaucuuacuccagcguguauacaaaacuguacucgacuggaccuaccucaggcaucaacacgaagcacgacgagcuuugcacagguccaugucccgccaauauuaaccaucagguaggguggcugaccuuugcucgugagcggacuucuaguuggggcugcgaagaguucggauguuuggcggucuccgauggcugcguguuugggagcugccaggacaucauaaaagaggaacucucuguuuaucgaaaggaaacagaggaggugaccgaugucgaacugugucuaacuuucagcgacaaaaccuacugcacaaaccugaauccugugacgccaaucauuaccgaucucuuugagguucaauucaagacuguggaaacauauucccugcccagaaucguagccguccagaaccacgagauuaagaucggacagauaaaugaccuuggcguguacucaaaagguugugggaacgugcagaaggucaauggaaccauuuacggcaacgguguuccgagguuugacuauuugugccaucuggcaagucgcaaagaggugaucguacggaaguguuucgauaaugacuaccaggcuugcaaauuuuuacagagcccugccucuuauagacucgaagaggauuccggcacagugacuaucauugacuacaagaagauccuggggaccauaaaaaugaaggccauucuuggagaugucaaauauaagacguucgcugacucaguggauaucacagcagaaggcaguuguaccgggugcauuaacuguuucgagaauauccacugcgaacugacucuacacaccacaauagaggccagcuguccaauuaaauccucuugcacuguuuuucaugacaggauccucgugacccccaacgagcacaaguacgcgcugaagauggucugcacagaaaaaccuggaaauacguugaccaucaagguguguaacacuaaaguugaggcuucgauggcccugguggaugcaaagcccauuaucgaauuagccccagucgaccagacagcuuauauucgcgagaaagaugaacgaugcaagaccuggaugugucggguacgugacgagggccuccaggugauacuggagccuuucaagaaucuuuuugguagcuacaucgggauuuucuacacuuuuaucaucucaauuguugugcuguuggucauaaucuaugugcuccugcccauuugcuucaaacuaagagacacacugaggaagcaugaagaugcauacaaacgcgagaugaagauccgguga

SEQ ID NO: 11019 - RNA, 4326 nt, Artificial Sequence
  derived and/or modified CDS sequence (opt3) from LACV(LAC30928-31)__U18979.1__GP
augaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaccaucuacaauaagaguugcaagaaaugcaaguuguguggccugguguaccaucccuuuacggagugcggcacucacugugucugcggggcgcgguaugauacaagcgaccgcaugaaacuacauagagcaucuggacucuguccugguuacaagucccugagggccgcucgggugaugugcaaaucaaagggcccagccagcauccuuaguauuaucaccgcaguucugguguugacuuucgucacacccauuaacucuauggugcucggggaauccaaagagaccuuugagcuggaagauuuaccugacgacaugcuggagauggcuagccgcauaaauucguauuaccucacguguauccuuaacuaugccguaucuuggggacugguuauuaucggcuugcuaaucggucugcucuuuaagaaguaccaacaccgauuucugaauguguaugcgauguacugcgaagagugugauauguaccacgacaaauccgggcuuaagagacauggagauuucaccaacaaaugcaggcaguguacaugcggccaguaugaagacgccgcaggccugauggcucaccggaagacuuacaauugcuugguccaguauaaagccaaguggaugaugaacuuccucauuauauacaucuuucugauuuuaaucaaggauucagcuauugugguccaagccgcagggaccgacuucacaacuugucuggagaccgagaguaucaacuggaauugcacaggaccauuucuaaaccucgguaauugucagaaacagcaaaagaaagaaccguauaccaacauagccacucagcugaagggccuuaaagcuaucagcguguuggauguucccauuaucacggggauuccugacgauaucgcgggagcacugcguuacauagaggaaaaggaggacuuccaugugcagcucacaauugaauaugccaugcuguccaaguacugcgauuacuauacccaguuuucugacaauagcggcuacucacaaacuaccuggcgcguauaucuuagaagucacgacuucgaggcuuguauccuguacccaaaccagcauuuuuguaggugcgucaaaaauggugagaagugcuccagcucuaaccgggauuucgccaaugaaaugaaagacuauuacucagggaagcagacaaaauuugauaaggacuugaaccucgcacugaccgccuuacaccacgcuuuccgaggcacaaguagcgccuauauugcaacaaugcuguccaagaaaucuaaugaugaccuaaucgcguacacgaacaagauaaaaaccaaguuucccggaaaugcucuccugaaagccaucauugauuacaucgcauauaugaagucgcuuccuggcauggccaacuucaaauacgacgaguuuugggaugaauugcuguauaagccaaaucccgcuaaggccagcaaccucgcacgcgggaaagaguccucauacaacuucaagcuggcuauuaguucuaaaagcaucaagauauguaaaaaugugaaggacguugccugcuuauccccgagaucaggagcgauuuaugccagcaucaucgcuuguggugaaccuaacggccccucuguguacaggaagccauccgggggagucuuccagaguagcacugauccuucuauuuauugccugcuugacucccauugcuuggaggaguuugaagcaaucggccaagaggaacucgaugccgugaaaaagucaaaauguugggagauugaguaccccgacguaaagcugauacaggaaggugacgggacaaaaaguugccggaugaaggauagcggcaauuguaacguggcuaccaaucgcuggccaguuauccagugcgagaacgacaaguucuacuauucggaacuacagaaagauuacgacaagacacaagauauuggacacuauugucugucccccggcugcacuaccgucagauacccuaucaauccaaaacauauuucuaacuguaauuggcaagugagcaggucaaguaucgccaagauagacgugcacaacaucgaggauauugaacaguauaaaaaggcaaucacgcagaagcuccagaccucccugucucuuuuuaaauacgcgaagacuaaaaauuugccgcacauuaagcccaucuauaaauacauaacuauugaggggaccgagacagccgaaggaaucgagagcgcuuacaucgaauccgaggucccugcccuggcagguacuucaauuggcuucaagauaaacagcaaagaagggaagcauuuacucgacguuaucgcuuaugugaagagugccucuuacuccagcguguauaccaaacuguacucgacgggaccaacaucaggcauuaauaccaagcacgaugagcuuugcacuggucccuguccugcaaacaucaaucaucagguaggguggcugacauuugcccgugagcggaccucuaguuggggcugcgaagaguucggauguuuggcugucuccgacggcugcguguuugggagcugccaggauauuaucaaagaggaacucucuguuuaucgaaaggaaacugaggaggugaccgacgucgaacugugucuaacauucagcgauaaaacguacugcaccaaccugaacccagugacucccauaaucacagaccucuuugagguucaauucaagaccguggaaacauauucccugccgagaauuguagcgguccagaaucacgagaucaagauuggacagaucaacgaccuuggcguguacucaaaagguugugggaaugugcagaaggucaacggaacuauauacggcaaugguguuccuagguuugauuauuugugccaucuggccagucgcaaagaggugauuguacggaaguguuucgacaacgauuaccaagcaugcaaauuuuuacagagcccagcuucuuauagacucgaagaggacuccggcaccgugacgaucaucgauuacaagaagauucuggggacaaucaaaaugaaggccauacuuggagacgucaaauauaagaccuucgccgauucaguggacauuacugcugaaggcaguuguaccgggugcaucaauuguuucgagaacauucacugcgaacugacacuacacacuaccaucgaggcaagcugucccauaaaauccucuugcacaguuuuucaugauaggauucucgugacgccuaaugagcacaaguacgcccugaagauggucugcaccgaaaaacccggaaacacuuugacaaucaagguguguaauaccaaaaucgaggcgucgauggcucugguugacgccaagccaauuaucgaauuagcaccuguggaucagacugccuauauucgcgagaaagacgaacgaugcaagacauggaugugucggguccgugacgagggccuccagguaauacuggagcccuucaagaaccuuuuugguagcuacaucgggauuuucuacaccuuuaucaucucaauuguggcucuguugguuauaaucuaugugcuccugccaauuugcuucaaacuaagagauacgcugaggaagcaugaagacgcauacaaacgcgagaugaagauccgguga

SEQ ID NO: 11020 - RNA, 4326 nt, Artificial Sequence
  derived and/or modified CDS sequence (opt3) from LACV(LAC76-40)__U70206.1__GP
augaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgggugaugugcaaaucaaagggcccagccagcauucuuaguaucauuacagcaguucugguguugaccuucgucacucccauaaacucuauggugcucggggaauccaaagagacauuugagcuggaagauuuaccugacgacaugcuggagauggcuagccgcaucaauucguauuaccucaccuguauucuuaacuaugccguaucuuggggacugguuaucaucggcuugcuaauuggucugcucuuuaagaaguaccaacaccgauuucugaauguguaugcgauguacugcgaagagugugauauguaccacgacaaauccgggcuuaagagacauggagauuucacgaacaaaugcaggcaguguaccugcggccaguaugaagacgccgcaggccugauggcucaccggaagacauacaauugcuugguccaguauaaagccaaguggaugaugaacuuccucauaaucuacauuuuucugaucuuaauuaaggauucagcuaucgugguccaagccgcagggacugacuucaccacaugucuggagacugagaguauaaacuggaauugcaccggaccauuucuaaaccucgguaauugucagaaacagcaaaagaaagaaccguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacgacuucgaggcuuguauucuguacccaaaccagcauuuuuguaggugcgucaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauaucgcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaagacgugaaggauguugccugcuuauccccgcgcucaggagcgauuuaugccagcaucaucgcuuguggugaaccuaauggccccucuguguacagaaagccauccgggggagucuuccagaguagcacugacaggucuauuuauugccugcuugauucccauugcuuggaggaguuugaagcaaucggccaagaggaacucgacgccgugaaaaagucaaaauguugggagauugaguacccugacguaaagcugauacaggaaggugaugggacaaaaaguugccggaugaaggacagcggcaacuguaauguggcuaccaaccgcuggcccguuauccagugcgagaaugauaaguucuacuauucggaacuacagaaagacuacgauaagacacaagacauuggacacuauugucuguccccaggcugcacuaccgucagauaccccaucaacccuaaacauauuucuaauuguaacuggcaagugagcaggucaaguaucgccaagauagaugugcacaauaucgaggacauugaacaguauaaaaaggcaaucacgcagaagcuccaaaccucccugucucuuuuuaaauacgcgaagacuaaaaacuugccacacauuaagccgaucuauaaauacauaacaauugaggggaccgagacagccgaaggaaucgagagcgcuuacaucgaauccgagguccccgcccuggcagguacuucaauuggcuucaagauaaauagcaaagaagggaagcauuuacucgauguuaucgcuuaugugaagagugccucuuacuccagcguguaugcaaaacuguacucgaccggaccuacgucaggcauuaacacaaagcacgacgagcuuugcaccgguccaugucccgccaauaucaaccaucagguaggguggcugacuuuugcucgugagcggacaucuaguuggggcugcgaagaguucggauguuuggcggucuccgauggcugcguguuugggagcugccaggacauuaucaaagaggaacucucuguuuaucgaaaggaaaccgaggaggugacugaugucgaacugugucuaaccuucagcgacaaaacauacugcacgaaucugaacccugugaccccaauaaucacugaccucuuugagguucaauucaagacaguggaaaccuauucccugcccagaauuguagccguccagaaccacgagaucaagauuggacagaucaaugaucuuggcguguacucaaaagguugugggaacgugcagaaggucaauggaacaauauacggcaacgguguuccgagguuugacuauuugugccaucuggcaagucgcaaagaggugauuguacggaaguguuucgauaaugacuaccaggcuugcaaauuuuuacagagcccugccucuuauagacucgaagaggauuccggcacugugaccaucaucgacuacaagaagauucuggggacgaucaaaaugaaggccauacuuggagaugucaaauauaagacauucgcugacucaguggauauuaccgcagaaggcaguuguacugggugcaucaacuguuucgagaauauucacugcgaacugacccuacacacaacuaucgaggccagcuguccaauaaaauccucuugcaccguuuuucaugacaggauucucgugacacccaacgagcacaaguacgcgcugaagauggucugcacggaaaaaccuggaaauaccuugacuaucaagguguguaacacaaaaaucgaggcuucgauggcccugguugaugcaaagcccauuaucgaauuagccccaguggaccagaccgcuuauauucgcgagaaagacgaacgaugcaagacuuggaugugucggguccgugaugagggccuccagguaauacuggagccuuucaagaaucuuuuugguagcuacaucgggauuuucuacacauuuaucaucucaauuguggcacuguugguuauaaucuaugugcuccugcccauuugcuucaaacuaagagacacccugaggaagcaugaagaugccuacaaacgcgagaugaagauccgguga

SEQ ID NO: 11021 - RNA, 4326 nt, Artificial Sequence
  derived and/or modified CDS sequence (opt3) from LACV(LAC79-283)__U70207.1__GP
augaucagaauacuggugcucauagccgucaccgcugcaagccccguuuaccagaggugcuuccaagacggcgccaucgugaagcagaacccuuccaaagaggcgguaacagaagugugucuuaaggaugacgucucuaugauuaaaacugaggcucgguauauccgcaaugccacggggguguuuucaaacaauguugcaauucgaaaguggcuggugagugauuggcacgacugccguccaaaaagaaucauaggaggucauaucaacgucauugaagugggcgaugacuugagcuuacacaccgaguccuacguauguucugccgauugcacaaucgggguugacaaggaaacugcucaggugaggcugcagaccgauacaaccaaucauuucgagauugcaggaacuacagucaagucgggcugguuuaaaucaaccacguauaucacucuagaccaaaccugugagcaccucaaggugagcugcgguccgaaaagugugcaguuccaugccuguuuuaaccagcacauguccugcguccgguuccugcaccgcacaauacuucccgggucuauugcuaauagcaucugucagaacauugaaaucaucauucugguuacuuugacccuccugauauuuauccugcucuccauuuuaucaaagacauacaucugcuaucugcuuaugccuauauucauuccaaucgccuacaucuauggaauuaucuacaauaaaaguuguaagaagugcaaauugugcggccugguguaccaucccuuuaccgaguguggcacgcacugcguauguggggcgagauaugauacuagcgacaggaugaagcuacaucgggcaucuggacucugcccugguuacaaaucccugcgcgccgcucgagugauguguaagucaaaaggcccagccagcauucuuaguauaaucacagcaguccugguguugaccuucguuacucccauuaacucuauggugcucggggaauccaaggagacauuugagcuggaagaguuaccugaugacaugcugggaauggcuagcagaaucaauucguauuacuucacuugcauccucaacuaugccgucucuuggggccuugugauuauaggucuguugacggggcuacuguuuaaaaaguaccaacacagguuccucaauguauaugcgauguacugugaagagugcgacauguaccacgauaaguccggacugaaacggcauggcgacuucaccaacaagugucgucagugcacauguggccaguaugaagaugccacugggcuuauggcacaccgcaaaaccuacaauugccugguucaguauaaggcuaaauggaugaugaacuuuuuggugaucuacauuuuccucauccugauuaaggacucagccaucgucgugcaagcugccggaacagauuuuacuaccugcuuagagacagagaguauaaacuggaauuguaccgguccauuccugaaccuaggcaauugccagaagcagcagaaaaaggaaccguauacuaacaucgcaacgcaacucaaagggcugaaggccauuagcguccuugacauccccauuaucacaggaauaccugaugacauugcuggcgcguugagauacaucgaggaaagggaggauuuucaugugcagcugaccauugaauaugcaaugcucuccaaauacugugacuacuauacucaguucucugauaauagcgguuacucacaaaccacauggcggguuuaucugcgaagucacgacuuugaggccugcauccuuuacccaaaccagcauuucugucgcugcgugaagaauggggagaaguguuccagcucuaacugggacuuugcuaaugaaaugaaagauuucuauucaggcaagcagaccaaauuugacaaggaucugaacuuggcccucacugcacugcaccacgccuucagaggaacaaguagcgcuuacauagccacgauguuauccaaaaagucuaaugacgaucugaucgcauauaccaacaagauuaaaacuaaguuucccggcaaugcgcuacucaaagcuaucauugacuacaucgccuacaugaagucgcugccugggauggcaaacuucaaacaugaugaguucugggacgaacuuuuguauaagccaaaucccgccaaagcuagcaaccuggccaggggaaaggaguccucauacaacuuuaagcucgcaauaaguucuaaaagcauuaagacaugcaaaaauguaaaggaugucgcuugucuguccccgcggucaggugccaucuaugcgagcaucauugccugcggcgaaccuaacgggcccucuguguaccgcaaaccauccggaggcguuuuccagaguagcaccgacagaucuaucuauuguuuacuggauucccacugccuugaggaguuugaagcuauuucacaagaggaauuggacgcagugaagaagaguaaaugcugggagauagaguacccugaugucaagccccuccaggaaggugacgggacaaaaagcuguaggaugaaggacucgggcaauugcaacguggccacuaaucguuggccaguaauccagugugagaacgauaaauucuauuacuccgaacugcagaaggacuacgauaagacccaagacauuggacauuauugccuaucucccggcuguacgaccgugcgguacccuaucaauccaaaacacauuagcaacugcaauuggcagguuucacgaaguuccaucgcuaagauagauguccacaacaucgaggacauugaacaguauaaaaaggccaucacacagaaacugcaaacuucucucagccuguuuaaguacgcaaagaccaaaaaucuuccgcauauuaagcccaucuauaaauacauaacaauugaggggacugagaccgcggaaggaaucgaguccgccuauaucgaaucagaggugccugcuuuggccgguacgagcauuggcuucaagauaaacaguaaagaagggaagcaccuguuagaugugaucgcauacgucaaaucugcuuccuacagcucgguuuaugccaagcucuacucaacaggaccaaccucuggcauuaauacuaagcaugacgagcuguguacaggucccugcccugcaaacaucaaucaccaggugggguggcuuaccuuugccagagagaggaccaguuccuggggcugugaagaguucggaugccuggcugugagcgauggcuguguauuugggucuugccaggacauuaucaaagaagaguugagcgucuaucgcaaggaaaccgaggaggugacagauguugaacucugccugacguucuccgacaaaaccuacuguacuaaccuaaacccagugacacccauaaucaccgaucuguuugagguccaauucaauacaguggaaacuuauucacucccgcggauuguugcggugcagaaccaugagaucaagauuggacagaucaaugaccugggcguauacaguaaagguugcgggaacguccagaaggugaauggaaccguguauggcaacggugucccuagauuugacuaccuuugucacuuggccagcaggaaggagguuauagugcgcaaaugcuucgauaaugacuaccaagcauguaaguuccugcagucuccagcuuccuaucgauuagaagaggauucaggcacgguaacaauuaucgacuacaaaaagauccucgggaccauuaaaaugaaggccauccugggagaugugaaguauaaaacuuuugccgacagugucgauauaaccgcugaaggcagcugcacaggguguauuaacugcuucgagaauauccacugugaacuuacucugcauaccacaauugaggcauccugccccaucaagucuucguguacgguguuucacgaccggauucuaguuaccccuaacgagccccaguacgcccucaaaauggugugcacugaacguccaggaaauacacugaccauuaaggucugcaacacuaaaaucgaggcgagcauggcuuugguggaugccaagccuaucauugaacuggcacccguugaccagacagccuauaucagagagaaggaugaaagguguaaaaccuggaugugccgcgugcgggacgagggcuuacaagucauucucgagccauucaagaaucuguuugguucauacauagggaucuucuauacguuuauuaucuccaugguagcacuucuggugaucauuuacguuuugcucccgauauguuucaaacugagagacacucuaaggaagcaugaagaugcuuacaaacgagagaugaagauccgcuga

SEQ ID NO: 11022 - RNA, 4326 nt, Artificial Sequence
  derived and/or modified CDS sequence (opt3) from LACV(LAC81-4)__U70208.1__GP
augaucaggauucuggugcucauagccgucaccgcugcaagccccguuuaccagagaugcuuccaagacggcgccaucgugaagcagaacccuuccaaagaggcgguaacagaagugugucuuaaggaugacgucucuaugauuaaaacugaggcucgguauauccgcaaugccacggggguguuuucaaacaauguugcaauucgaaaguggcuggugagugauuggcacgacugccguccgaaaaagaucauaggaggucauaucaacgucauugaagugggcgaugacuugagcuuacacaccgaguccuacguauguucugccgauugcacaaucgggguugacaaggaaacugcucaggugagacugcagaccgauacaaccaaucauuucgagauugcaggaacuacagucaaaucgggcugguuuaagucaaccacguauaucacucuagaccaaaccugugagcaccucaaagugagcugcgguccaaagagugugcaguuccaugccuguuuuaaccagcacauguccugcgucagguuccugcaccggacaauacuucccgggucuauugcuaauagcaucugucagaacauugaaaucaucauucugguuacuuugacccuccugauauuuauccugcucuccauuuuaucaaaaacauacaucugcuaucugcuuaugccuauauucauuccaaucgccuacguguauggaaucauuuacaauaagaguuguaagaaaugcaaguugugcggccugguauaccaucccuuuaccgaguguggcacgcacugcguguguggggcgcgcuaugauacuagcgacagaaugaaacuacauagggcaucuggacucugcccugguuacaagucccugcgggccgcucgcgucauguguaaaucaaagggcccagccagcauccuuaguauuauaacagcagugcugguuuugaccuucgugacucccaucaacucuaugguccucggggaauccaaagagacauuugagcuggaagaguuaccugaugacaugcugggaauggcuagccgaauuaauucguauuacuucacuugcauccucaacuaugccgugucuuggggccuuguaaucauuggucuguugacggggcuacuguuuaagaaguaccaacacagauuccucaauguuuaugcgauguacugugaagagugcgacauguaccacgauaaauccggacugaagaggcauggcgacuucaccaacaaaugucggcagugcacauguggccaguaugaagaugccacugggcuuauggcacaccguaagaccuacaauugccuggugcaguauaaagcuaaguggaugaugaacuuuuuggucauauacaucuuccucauucugaucaaggacucagccauugugguccaagcugccggaacagauuuuacuaccugcuuagagacagagaguaucaacuggaauuguaccgguccauuccugaaccuaggcaauugccagaaacagcaaaagaaagaaccguauacuaacauagcaacgcagcucaaggggcugaaagccaucagcgugcuugacauucccaucauuacaggaaucccugaugacauagcuggcgcguugcgcuacauugaggaaagagaggauuuucauguucagcugaccaucgaauaugcaaugcucuccaaguacugugacuacuauacucaguucucugauaauagcgguuacucacaaaccacauggaggguguaucugcggagucacgacuuugaggccugcauucuuuacccaaaccagcauuucugucgaugcguaaagaauggggagaaauguuccagcucuaacugggacuuugcuaaugaaaugaaggauuucuauucaggcaaacagaccaaguuugacaaagaucugaacuuggcccucacugcacugcaccacgccuuccgcggaacaaguagcgcuuacaucgccacgauguuauccaagaagucuaaugacgaucugauagcauauaccaacaaaaucaagacuaaauuucccggcaaugcgcuacucaaggcuauuaucgacuacauugccuacaugaaaucgcugccugggauggcaaacuucaagcaugaugaguucugggacgaacuuuuguauaaaccaaaucccgccaaggcuagcaaccuggccagaggaaaggaguccucauacaacuuuaaacucgcaaucaguucuaagagcauaaaaacaugcaagaaugucaaagauguggcuugucuguccccgaggucaggugccauuuaugcgagcaucaucgccugcggcgaaccuaacgggcccucuguuuaccggaagccauccggaggcguguuccagaguagcaccgaccgcucuauuuauuguuuacuggauucccacugccuugaggaguuugaagcuaucucacaagaggaauuggacgcagucaagaaaaguaagugcugggagauugaguacccugaugugaaaccccuccaggaaggugacgggacaaagagcuguagaaugaaagacucgggcaauugcaacguagccacuaauagguggccagugauacagugugagaacgauaaguucuauuacuccgaacugcagaaggacuacgauaaaacccaagacaucggacauuauugccuaucucccggcuguacgaccguucguuacccuauuaauccaaagcacaucagcaacugcaauuggcaggucucacggaguuccauugcuaaaaucgaugugcacaacauagaggacaucgaacaguauaagaaagccauuacacagaagcugcaaacuucucucagccuguuuaaguacgcaaaaaccaagaaucuuccgcauaucaaacccauuuauaaguacaucacaauagaggggacugagaccgcggaaggaauugaguccgccuauaucgaaucagaggugccugcuuuggccgguacgagcaucggcuucaaaauuaacaguaaggaagggaaacaccuguuagaugucauagcauacguuaagucugcuuccuacagcucgguguaugccaagcucuacucaacaggaccaaccucuggcaucaauacuaaacaugacgagcuguguacaggucccugcccugcaaacauuaaucaccaggugggguggcuuaccuuugcccgagagagaaccaguuccuggggcugugaagaguucggaugccuggcuguaagcgauggcugugucuuugggucuugccaggacaucauuaaggaagaguugagcguguauaggaaagaaaccgaggagguuacagauguggaacucugccugacguucuccgacaagaccuacuguacuaaccuaaacccagucacacccaucauaaccgaucuguuugaggugcaauucaaaacaguugaaacuuauucacucccgcgcaucguggcgguacagaaucaugagauuaagaucggacagauuaacgaccugggcgucuacaguaaggguugcgggaaugugcagaaagugaacggaaccgucuauggcaaugguguuccucgguuugacuaccuuugucacuuggccagcagaaaggaggugaucguaaggaaaugcuucgauaacgacuaccaagcauguaaguuccugcagucuccagcuuccuaucgcuuagaagaggauucaggcacggugacaauaauugacuacaaaaagauccucgggaccaucaagaugaaagccauucugggagaugucaaguauaaaacuuuugccgacaguguggauaucaccgcugaaggcagcugcacaggguguauaaauugcuucgagaacauucacugugaacuuacucugcauaccacaaucgaggcauccugccccauuaagucuucguguacgguuuuucacgaccgaauccuagugaccccuaaugagccccaguacgcccucaaaauggucugcacugaacggccaggaaacacacugaccauaaaggugugcaauacuaagauugaggcgagcauggcuuugguugaugccaaaccuaucaucgaacuggcacccguggaccagacagccuauauucgugagaaggaugaaagauguaaaaccuggaugugcaggguccgcgacgagggcuuacaaguaauccucgagccauucaagaaccuguuugguucauacauugggauauucuauacguuuaucauuuccaugguggcacuucugguuaucaucuacguguugcucccgauuuguuucaaacugcgggacacucuaagaaagcaugaagaugcuuacaagagggagaugaaaauacgauga

SEQ ID NO: 11023 - RNA, 4326 nt, Artificial Sequence
  derived and/or modified CDS sequence (opt3) from LACV(LACR56869)__U70205.1__GP
augaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguauuuucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgggugaugugcaaaucaaagggcccagccagcauucuuaguaucauuacagcaguucugguguugaccuucgucacucccauaaacucuauggugcucggggaauccaaagagacauuugagcuggaagauuuaccugacgacaugcuggagauggcuagccgcaucaauucguauuaccucaccuguauucuuaacuaugccguaucuuggggacugguuaucaucggcuugcuaauuggucuccuguucaagaaguaccaacaccgauuucugaauauauaugcgauguacugcgaagagugugauauguaccacgacaaauccgggcuuaagagacauggagauuucacgaacaaaugcaggcaguguaccugcggccaguaugaagacgccgcaggccugauggcucaccggaagacauacaauugcuuggugcaguauaaagccaaguggaugaugaacuuccucaucauuuacaucuuucugauuuuaaucaaggauucagcuauagucgugcaagccgcagggacugacuucaccacaugucuggagacugagaguaucaacuggaauugcaccggaccauuucuaaaccucgguaauugucagaaacagcaaaagaaagaaccguauacaaacauugccacccagcugaagggccuuaaagcuaucagcgucuuggaugugcccauuaucacugggauaccugacgauauugcgggagcacugcguuacaucgaggaaaaggaggacuuccauguucagcucacgauugaauaugccaugcuguccaaguacugcgauuacuauacacaguuuucugacaauagcggcuacucacaaaccacuuggcgcguguaucuuagaagucacgacuucgaggcuuguauccuguacccaaaccagcauuuuuguaggugcguuaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauauggcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaaaaugucaaggacguggccugcuuauccccgcgcucaggagcgauuuaugccagcaucaucgcuuguggugaaccuaacggccccucuguuuacagaaagccauccgggggaguguuccagaguagcacugauaggucuauuuauugccugcuugacucccauugcuuggaggaguuugaagcaaucggccaagaggaacucgaugccgucaaaaagucaaaauguugggagauugaguacccugacgugaagcugauacaggaaggugacgggacaaaaaguugccggaugaaggauagcggcaauuguaacguagcuaccaaucgcuggcccgugauccagugcgagaacgacaaguucuacuauucggaacuacagaaagauuacgacaagacacaagauauuggacacuauugucuguccccaggcugcacuaccguuagauaccccaucaauccuaaacauauuucuaacuguaauuggcaggucagcaggucaaguaucgccaagauagacgugcacaacaucgaggauauugaacaguauaaaaaggcaaucacgcagaagcuccaaaccucccugucucuuuuuaaauacgcgaagacuaaaaauuugccacacauuaagccgaucuauaaauacauaacaauugaggggaccgagacagccgaaggaaucgagagcgcuuacaucgaauccgaggugcccgcccuggcagguacuucaauuggcuucaagauaaacagcaaagaagggaagcauuuacucgacgucaucgcuuauguuaagagugccucuuacuccagcguguauaccaaacuguacucgacgggaccuacaucaggcauuaauaccaagcacgaugagcuuugcacugguccaugucccgcaaacaucaaucaucaggacggguggcugacauuugcccgugagcggaccucuaguuggggcugcgaagaguucggauguuuggcuguguccgauggcugcguauuugggagcugccaggacauuaucaaagaggaacucucugucuaucgaaaggaaacugaggaggugaccgauguugaacugugucuaacauucagcgacaaaacguacugcaccaaccugaacccugugacuccaauaaucacagaccucuuugagguccaauucaagaccguggaaacauauucccugcccagaauuguugcggugcagaaucacgagaucaagauuggacagaucaacgaucuuggcguauacucaaaagguugugggaauguccagaaggugaacggaacuauauacggcaauggugugccgagguuugacuauuugugccaucuggccagucgcaaagaggucauuguucggaaguguuucgauaacgacuaccaagcaugcaaauuuuuacagagcccugcuucuuauagacucgaagaggauuccggcaccgugacgaucaucgacuacaagaagauucuggggacaaucaaaaugaaggccauacuuggagauguaaaauauaagaccuucgccgacucaguggauauuacugcugaaggcaguuguaccgggugcaucaauuguuucgagaacauucacugcgaacugacacuacacacuaccaucgaggcaagcuguccaauaaaauccucuugcacagucuuucaugacaggauucucgugacgcccaaugagcacaaguacgcccugaagaugguuugcaccgaaaaaccuggaaacacuuugacaaucgagguguguaauaccaagaucgaagcgucgauggcucuggucgaugccaaacccauuaucgaguuagcaccaguggaccagacuacauauauucgcgaaaaggacgagcgaugcaaaaccuggaugugucggguucgugaugagggccuccaggugauacuggaaccuuucaagaaccuuuuugguagcuacaucgggauuuucuacacguuuaucaucucaauugucgcccuguugguaauaaucuaugugcuccugcccauuugcuucaagcuaagagacacucugaggaaacaugaggaugcuuacaagcgcgaaaugaaaauccgguga

SEQ ID NO: 11024 - RNA, 4326 nt, Artificial Sequence
  derived and/or modified CDS sequence (opt3) from LACV(NAT_Crawford_WI_2007)__GU596383.1__GP
augaucaggauucuggugcucauagccgucaccgcugcaagccccguuuaccagagaugcuuccaagacggcgccaucgugaagcagaacccuuccaaagaggcgguaacagaagugugucuuaaggaugacgucucuaugauuaaaacugaggcucgguaugugcgcaaugccacggggguuuucucaaacaauguggcaauccgaaaguggcuggucagugauuggcacgacugccguccgaaaaagauuaucggaggucauauaaacgugaucgaaguaggcgaugacuugagcuuacacaccgaguccuacguuuguucugccgauugcacaauugggguggacaaggaaacugcucaggucagacugcagaccgauacaaccaaucauuucgagaucgcaggaacuacagugaaaucgggcugguuuaagucaaccacguauauuacucuagaccaaaccugugagcaccucaaagugagcugcgguccaaagaguguccaguuccaugccuguuuuaaccagcacauguccugcguuagguuccugcaccggacaauccuucccgggucuauagcuaauagcauuugucagaacaucgaaauuaucauccuggugacuuugacccuccugauuuuuauacugcucuccaucuuaucaaaaacauacauuugcuaucugcuuaugccuaucuucauaccaauugccuacguauauggaaucaucuacaauaagaguuguaagaaaugcaaguugugcggccugguguaccaucccuuuaccgaguguggcacgcacugcgucuguggggcgcgcuaugauacuagcgacagaaugaaacuacauagggcaucuggacucugcccugguuacaagucccugcgggccgcucgcgugauguguaaaucaaagggcccagccagcauucuuaguaucauuacagcaguucugguguugaccuucgucacucccauaaacucuauggugcucggggaauccaaagagacauuugagcuggaagaguuaccugaugacaugcuggaaauggcuagccgaaucaauucguauuacuuuaccugcauucucaacuaugccguaucuuggggacuuguuaucaucggccuguugacgggucuacuguuuaagaaguaccaacacagauuccucaauguguaugcgauguacugugaggaaugcgacauguaccacgauaaauccgggcugaagaggcauggagacuucaccaacaaaugucggcagugcacauguggccaguaugaggaugccacuggccuuauggcacaccguaagaccuacaauugccugguccaguauaaagcuaaguggaugaugaacuuuuugauuauauacaucuuccucauucugaucaaggacucagccauugugguccaagcugccgggacagauuuuacuaccugcuuagagacagaaaguaucaacuggaauuguaccggaccauuccugaaccuagguaauugccagaaacagcaaaagaaagagccguauacuaacauagcaacgcagcucaagggccugaaagccaucagcgugcuugacauucccaucauuacagggaucccugaugacauagcuggagcguugcgcuacauugaagagagagaagauuuucauguucagcugaccaucgaguaugcaaugcucuccaaguacugugacuacuauacucaguucucugauaauagcggcuacucacaagccaccuggaggguguaucugcggagucacgacuuugaggcuugcauucuuuacccaaaccagcauuucugucgaugcguaaagaauggugaaaaauguuccagcucuaacugggacuuugccaaugagaugaaggauuucuauucagggaaacagacaaaguuugacaaagaucugaacuuggcacucaccgcccugcaccacgcuuuccgcggcacuucaagcgccuacaucgcaacaauguuauccaagaagucuaaugacgaucugauagcguauacgaacaaaaucaagaccaaauuucccggaaaugcucuacucaaggccauuaucgacuacauugcauacaugaaaucgcugccuggcauggccaacuucaaguaugaugaguucugggacgaacuuuuguacaaaccaaaucccgcuaaggccagcaaccuggcaagagggaaggaauccucauauaacuuuaaacucgcuaucaguucuaagagcauaaaaacuugcaagaaugucaaagauguggccugucuguccccgaggucaggagcgauuuacgccagcaucaucgcuugcggugagccuaacggccccucuguuuaucggaagccauccgggggaguguuccagaguagcacagaccgcucuauuuacuguuuacuggauucccauugccuugaggaauuugaggcaaucucacaagaagaguuggacgccgucaagaaaaguaagugcugggagauugaauauccugaugugaaaccccuccaggagagcgacggcaccaagucguguagaaugaaagacuccgguaauugcaacguagcuacaaauagguggccagugauacagugugaaaacgauaaguucuacuacucugagcugcagaaggacuaugauaaaacucaagacaucgggcacuacugccuaagccccggcuguaccacgguucguuauccuauuaauccaaagcauaucucaaacugcaauuggcaggucagucgguccucuauugccaaaaucgaugugcacaacauagaagacaucgagcaguacaagaaagcaauuacccagaagcugcaaacaagccucucccuguuuaaguaugcgaaaacuaagaaucuuccgcacaucaaacccauuuacaaguauaucaccauagagggaacagaaacugccgagggcauugaaucagcuuacaucgagagcgaagugccugccuuggcagggaccaguaucggauucaaaauuaacucuaaggaggguaaacaucuguuagaugucauagcuuacguuaaguccgccagcuauucgucaguguacgcaaagcucuauucuacgggcccaacaagugggaucaauaccaaacacgacgagcuguguacuggacccugcccugccaacauuaaucaucaggugggcuggcuuacauuugcucgagaaagaaccuccagcugggguugugaggaguucgggugccuggcgguaucugauggcugugucuuuggaagcugccaggacaucauuaaggaagaauuguccguguacaggaaagagacugaggaaguuaccgauguggagcucugccugacauucucagacaagacguauuguaccaaccuaaacccagucacucccaucauaacagaucuguuugaagugcaauucaaaaccguugagacauacagucucccgcgcaucguggccguacagaaucacgagauuaagaucggccagauuaacgaccugggggucuauagcaagggaugcggcaaugugcagaaagugaacgguacugucuacgggaauggaguuccucgguuugacuaccuuugucauuuggcaucuagaaaggaagugaucguaaggaaaugcuucgauaacgacuaucaggcuuguaaguuccugcaauccccagccucauaccgcuuagaggaagauaguggcaccgugacgauaauugacuauaaaaagauccucgguacaaucaagaugaaagccauucugggcgaugucaaguacaaaaccuuugcugacagcguggauaucacugcagagggguccugcaccggauguauaaauugcuucgaaaacauucacugugagcuuacacugcacacuaccaucgaggccucuugccccauuaagucgagcuguacaguuuuucaugaccgaauccuagugacgccuaaugaacacaaauaugcgcucaagauggucugcaccgagcggcccggcaacacucugacaauaaaggugugcaauaccaaaauugaagcuaguauggccuugguugaugcaaagccaaucaucgagcuggccccuguggaccagacugcuuacauucgugaaaaagaugagagauguaagacauggaugugcaggguccgcgacgagggguuacagguaauccucgaacccuucaaaaaccuguuuggauccuauauuggcauauucuacaccuuuaucauuaguaucguggcacuucugguuaucauuuacguguugcucccaauauguuucaagcugcgggacacgcuaagaaagcaugaggaugccuauaaaagggaaaugaagauccgauga
